United States Patent 7,745,391 (HUMAN THROMBOSPONDIN POLYPEPTIDE) - sequence listing, part 56

SEQ ID NO: 174669 - DNA, 457 bp, Homo sapiens
agaggactccgtgatgttatgcccaacacatacccataggtctctaggtctcctttccggatgctgactttctgccgaatactgtgctacatgctttaagtacattatcttgttacatcttcacaacaagagcaagtctattattatctccatttttcagatgaggaaactgaaaagccctagaaaagtgaagtgacttgcccaaggtcacacagccagtaagaagcaatgctcagactggaactcagagaagtcggaagccaggccctgtattttcaactctctcatctctctgtggtaggagctggcaaagacgctttacccagaaacccttcttaattaaaagcaaaacaaacaaaaaccaggaagggcaagaacaccgcatctgcagtctacatgcagaactgtgtgtccgacctccattttggggctgcccctggagcaagctgccagcaag

SEQ ID NO: 174670 - DNA, 339 bp, Homo sapiens
agttcgagaccagcctggccaacatggtgaaacccccgtctctactaaaaatacaaaaattagccagccatggtagtgcatgtctgtaatcctggctgctagggaggttgaggcaggagaattgcttgaacccagggggcagaggttgaagtgagcagagatcatgccactgcactccagcctgggcgacagagtgagactctgtctcaaaaaaaaaaaaaaaagaaaaaaaaacccctaattatatatctaaaattcttgtggcttttttcacgctcccttccgtcccaggcctcaaaatcagaacagaggcaggttattgtttgttttttaagtttc

SEQ ID NO: 174671 - DNA, 253 bp, Homo sapiens
tctcaaaaaacaaaaaaaagaaaggcatattgaccatctttggttttggtgtgtataaataaaataaaggcagccacaccaatctgtgatgtgaggcggccagcagctacaggacaaggcacagctgaaatacagaggcaaggctgtttgtcttaatagttcactatacagtttgttttaggcagctttctgtaccttttattttataataaaaatatagaagatacagttaaccattatatatatatatggg

SEQ ID NO: 174672 - DNA, 173 bp, Homo sapiens
  misc_feature (34)..(34): n is a, c, g, or t
gaggatctctcagacagcggaccccctcagacantgccgacccccacttccgggcctgcaggttctcagggggcccgacccacccatcaggctgcaaacccacccccaaatgggcatgttgcttgggactgcactgaagtggtaacgaattccacttggagtgaacgaacccc

SEQ ID NO: 174673 - DNA, 671 bp, Homo sapiens
cacacacacacacacacacacacacactgtatgtctccttattttgttcttttaggattttctttctgttaaagccagcagttcaagatagttgcaacagagggcagaatggtgtaagaaatttaaatatctttttcttcttatctgaaaatcaccccaaaatacaaattagagcaatgcatggattgagctataaatactctttattgactagttttcaacatttacatacaaagattattagttatttttcatgtcatagtataaactgtttggcattatatgtaaatcttaatacaagcaaagtgctgaacccttgagagagaacctgaactatggctaatgcatttaacttctatatcaatattaagattaagcaatgggtactctttgttcttttccaaacatgctgtgggattatttacttttctttccattctagtgctgcagtgcaggcttattgaacttactgtccttgacaaatgtcgattaatgttctttattgggagttttttgaagtttatgggcaagaccaatgaagcagaagagttgttcttgagtgttgaggacatgttagtacaggtaaactgagagtatattttaaatccttcaaactttattccttttgtgttagatattttcagatattatttacctttgttcatgtaaaa

SEQ ID NO: 174674 - DNA, 569 bp, Homo sapiens
ctcaggctgcagtgcagtggcatgatcatggcttactgcagcctcaacctcctgggctcaagtgatcgatcctcccaccttagcctcctgaatagttgggaccacaggcacatgccaccatgcatgattaatttttgtattttttgtagagacagggtttcaccatgttgcccaggctggtctccaactcctgagctcaagcaatctgcctgcctctgcctcccaaaatgctgggattacaggtgtgagccacagcacctggccaaaattcagcatttttaagaaataagagaatatgagaggaaaaggcacatcaacttacctaagatgtttagggcgaggaaaagcttttaaacaaattacaacattgatctacctctcagggtagtcatgaaagaaaaaaccaaagcattgcgaaacatgggggaacataaaggacaaaccagcagtggcattgatccacatacacattccatttcagcgtatgcctggtaagattcagctcttttctgatccagagcagccccgtggtcactccaactagctctttacccagtgaaccaagctac

SEQ ID NO: 174675 - DNA, 561 bp, Homo sapiens
agtggttaaggtactgttttcccaggagattgcttcagttctggcccaaggtgctagagggaaggataggtatagaagctccacctctgtttggcctcacacggtaagatgtaacagctgcttccagcatggcttaagaattttgggccaccaggctggagtgattcagccgtgccttaacctctaagttgaagggatgtcatggctacttgccccaagaacaagacagactacagttgtaattccaataccaagatggcatagcacagtagctatgtggccacagggcatgagacagattgtcagctccttctctgaggcaacacagctatgtagaatccaggcagtaggagattataatagtgaagtctgaagatataatatgtagataagggttgctgggatccttttgcttacctcttcactgaaagaaaaagtgtttcttggttcccagaagatcttggtttgggaatggggtggtagatgcctaacactgtcttccattctttatgtggctatccaagtttctgcactaacctggatttctgttacattagacag

SEQ ID NO: 174676 - DNA, 640 bp, Homo sapiens
ttgcggatggagatggacacctagtgaatgatttaatccaccaacaattgtggcacacaggcatcgtcttccccacgccaggactcagaggctgagcccagggtgctgagaggctgagcccacagctccggggtgaggaatggagctccccgagcgcggcttatctttcaagggagctcacactcttttacaacaaccctcgaggtgagggctccttcagactctcccaactccacccatggccacagcctccggggcagggctcctgttcctacccacccctcaagctccttctcatccacatgcccaggctaacgttagccacactggcagcgggggaactgaccctgagcagcaggcgctggcccctgctccaagccctgctttccgagtgaactcttgtaccagctggaattgtctccgggtgcttcctccgtcagaccacggtcaagtgcaggtccagtgttttgggtcagatgtcagtgggcaggctcagcattcatccaaagaaatagcagcttcgtaattggttacttgtaggggtaattagctatctgcataaattaactgattcctcctcatagtatgtcccctatagacagtgagggttcaatttgctgttggtgaatttgctaatgtg

SEQ ID NO: 174677 - DNA, 169 bp, Homo sapiens
acctttttgtaagtccctcccacactgactctggaattggctatgtcacttactttgatcaataggaccttgacaaacacgatacaaacagagagttgatcagtgctggcatatggaagcttgtcctcttggaatctagtcatcatgctgtgaggatgtcccaattacc

SEQ ID NO: 174678 - DNA, 183 bp, Homo sapiens
ttatttacaagaaatggccaaactgttgtctagagtgtctgtaccattttgtacacccaccagcaatgtatgaatgttctagttattccatatcctcaccagcacttggtattgtcattttttgtttttaattttagccattctaactggtgtggttttgatttacatttccccaacagctaa

SEQ ID NO: 174679 - DNA, 370 bp, Homo sapiens
gctagacaatattggaagaatagttaaaatggaataatttgaattgaaaaagggaaagaagcagtctgtaaggcatgtgaatgactaacttcatttcaattgggctccttgaccagaagatgggtgcaaagttaaatgaccttccgtgatagtattatgtcttttatgacacgttacagtagagtatctgaaaaagattgttaatatgaagaaaatagaattgagaagccaacaggatgtgtacacaacatcttctttaacgctggcagtacacacacttcaatgaaatgaggaaggccgaaccaaatataaaatgtcttagttgtcttgttatcaccaagagataggagcaagatacattgttgtcatg

SEQ ID NO: 174680 - DNA, 407 bp, Homo sapiens
ctagataagacaaataagtgctcatctttgatagcactgcagggtgactataattaataatttaattgggaggatacaataaattagtaatttatattgtgtatttaagaacatacagtagaatattatattgtatatattcattattgattgtatatatttatttattgtatgtttataatttattgtatataaattatatacaatatattgtctatattaataatttattttatatattcagatagctagaagagcagattttgaatgttcccaacacaacaaaatgatatatgtttgctatgtgaataaccctgatttgatcattacacgttgtatgcatgtatcgaaatatcacactgtgccccataaatatgtacaatgatgtgtcagttaaaaataaaaga

SEQ ID NO: 174681 - DNA, 165 bp, Homo sapiens
caccagaaagaaaaaggccaaagagacgctgagacgggtcgctcatggggggcgtggcctaggaattccagtcacacacggttgcagggccgagcaggcggatcgcaagagagaaataggcaaagaactaaagctgtgatggaggaataatacggaggaggcgtg

SEQ ID NO: 174682 - DNA, 499 bp, Homo sapiens
actgcagcctaagctccaacaagagcgaaattccatctcaaaaaataaacaaaaatacaggaaacgtgttgactgttttagtaatctgttatattgacaggaccatagagtttgtggaggaatgtagcttgcacgacttctttttttaaaaagaagaaaaggcaggagttcaactatgtcttaagatatttcttaaagaaaattggtaagacaacatctcatttcttgcaaagtctctgagcagttttttaaaaattatttttgtctgctaaatattgctttaggtgtgccaagaagactagaatttgagctaagaatttaagaaaattaactttatctgcatttcatatttactttatcttggttttaaatgattgcttataccctagcttttaaaactaaacattcatagcctaaggatttttcatatcttttgactcttggaatgaaaacccattttgaaattaagtctatcgctcagctcttctgctttcacatg

SEQ ID NO: 174683 - DNA, 367 bp, Homo sapiens
tcattgaggatacagaaatgaaagagatcgtcttgtgctgaaaatgtggagtaactaaagtaccttagggactgatagcaggattgctagcagaggtcacagctgaattgacccttacaatttatttcagcagagcggtgagatagtatacgcaaggcacagggacgcccaagcagaaaaacatgaaatctcagaggtgtgtgcattctaccaccaccaattcccccttgaagtgccttcttcccactcctgcgaccaaccttccctttacccacactccatttcttggaataccctctatgctccatcccatgatccaggcttatgctcctcacactggttacctcccccaatatgagttacttag

SEQ ID NO: 174684 - DNA, 105 bp, Homo sapiens
aactctggaatgtgtgcactgaaaaataaaatgtactaaactatttacaatagttaggctgggaatacagaattacaaatagaattctcccacctaccccacctg

SEQ ID NO: 174685 - DNA, 359 bp, Homo sapiens
gcggctgtctagaggatcccagagataagcaggacactagtgataatgtagaaagaagtttcaaacacacagtgagggagaattcagaggaagcagaacccgagaagtactacaacagcaaaaatactacatgtaaaggtaagagcacttactttgaagacaagatgtctacagcgctaggaaaaacagggctggaaatggaaaaacttcttctttcaaaactagggtttgccctgagactgggaaatattaacagagaaaccaagtattaagtgtctcacattaacaacacaagaaggagtctttaatctctgaagggatgaaagctactttgggcaatttctacctcctcctcagaa

SEQ ID NO: 174686 - DNA, 254 bp, Homo sapiens
gtaacaagctactggtgaagactgatgattccagaaggatcaattctgaaacagtaactatgtataaagacccagttccctcagaggagactcacagaaagaccttcgcctgcttcctgcacctgggctccacacctgtccttattcagatattgtcattagccatgaactcctatgggcagctaaactccctccagtgatcagttgctcatccacagcatattaatgttattaaagatggatattacagaggt

SEQ ID NO: 174687 - DNA, 141 bp, Homo sapiens
gaagttcaaggatcagcctgggcaacaaagtgagaccccaacactacaaaaataaaaatacatagatataaaaataaataaataaataatccaatgttactttgttttattgcccaaaatgtttcagctttgccttctggt

SEQ ID NO: 174688 - DNA, 234 bp, Homo sapiens
tgcactccagcctgggcaacagagagagacacgtttcgaaaaaaaggaaaagaaaaatcagttttcttccactaaaacaattcccaagattaactggcgttctgtaggtcggcacaaagtcgtggctttgccatctgacggaggacgcgcagcggtcgtctctggctgggtagactgagacctgaacgctgagggacttaggaccagcagtgccgtccaggcctggctgcagac

SEQ ID NO: 174689 - DNA, 548 bp, Homo sapiens
tagctgagggacgccctgatatcaatcccacagccccggcactcgtgccctggagtgccagctccgtcttccctgcagaggcgtcagtggcctgctgtgtgaggcgatggttctcctggctgagttcctgcttcgcattcctaactcccagtcttggttaacctccatttccattactaatttgaacataattttggctttattcaaactatgatcagatccccataaaataccaaactggggatgtttagaacccaagttgtggagcactcactcttgtggtgagagaagcagggcccaccacaatggggggatctggggacctgcggtgagcgtgaccgggaggtggggccagatcccggcctcacccggcaatctgtggagcttgtggtgtctgtggacacttggtagtttaagaagagacacatgcatggaagtatatatgataggagaattcacataaaaaataaaattatgcttgctaggtacccaattttccaaattatttacatgcttgttattacatctgttggaaacttatatctgtt

SEQ ID NO: 174690 - DNA, 276 bp, Homo sapiens
attctacaaacccacatggagcacctcctggggaggtgttgtgctagaagtcacggaacctcagaggtgagtgagaaagccacggtcctgcctgatggatgcccaagagccttgggtcttcacacacatgtgaaatgtgggttttagcagcaggtacctttcatacaccatcaatagtcttccctatgtgggtaaaaccctaggggctgaggtctcccattggtgccttcagggctttttgctcattccacacaaatggtcagtcagagaccacag

SEQ ID NO: 174691 - DNA, 608 bp, Homo sapiens
ctcacagaagtaaaaagtagaacagaggatattagaggctgggaagggtaagaaggaggaggcaatagggagagatttttaaaagtatacaaaattagagctagataggaggaataaattctagtgttctacagcaatgtaggataactacagttaacaataatatattacatagtttcaaatagtgagaaggaggatattgaatgttcacaatacaaagaaatgataaatgtttgagatgatggatatgctaattgctctgctctgatcaccatacattatatgtatcaaaacatcacgatgggcagggtgttgtggctcacgcccataatcccagcaatttgagaggccaaggtgagaggatcgtttaagctcaggagtttgagaccagcctgggcaacacagcgagacctcatctctaataaaaataaaaaaaattagccaggtgtggtggcatgtgcctgtagtcccagctactcaggaggccgagttgggaaaatctcttgagcctgcaagatacgggttgcagtgagctgtgatcacgccactgcactctggccttctggcctcggtgacagagcaagaccctctcttaaaacaccaaaccc

SEQ ID NO: 174692 - DNA, 573 bp, Homo sapiens
tacatggggtgcagaggggaagaggcttagatattttctgtagtggaagaggtgtctcatcaaagtagtaggttcccaattagagcatcctcctaggcagtggtgcccattagcatgatttggtaggattctttttatttatttttttgctactgataacttagccatttgccttcttgtcttaactattagggtaattcacttttctttgggaggcactagaacatagcagttgagagattaaactctggattcagtcggcctgggtttggatcgtggctctgctctttactagatgtgtgcctttggacaaatcacataattaatgtctcagtgtccttatggatagaataggcctaataatagtctgtatcttcttttgaggaataaatgagttaatacctgaaaaatattttaaatggtacctgacattagaagcactcagtatgtattggctaccattttttttcttttctagctttagcatgcagttacgccatgtttttgatttcctttttgtttctgtatgtttaggtctcagtttctggtactagaccatactctttgcaggtc

SEQ ID NO: 174693 - DNA, 291 bp, Homo sapiens
tttgatgagtgtctcatatgatagggaacctcgtcttctgagggccaaacaagctaagagttaaatcttatcaattatgtgcctactgtatacctgtattagtttgctcgggcttccataacaaaatccacagattgggtggcttaacaacagaaatgcattttctcacagttctggaggctggaagtacatgatcaagatgctggcaaattaggtctctggtgagggctctattcctggcttgcagatggctgccttctctctgtgtcctcacatggccttttcttcatg

SEQ ID NO: 174694 - DNA, 355 bp, Homo sapiens
ttcccccccaaaaaaaataataaaagagaaagaactgagatttgtttgttagttataaacagcaacaacagatccgggaaaagaccaccacagctttatccagacttggaaagaaaaattgtgtgagaccttaaagggctacaagaaccctacaaagtttttcttagcccaagttttaatgactttgttaaaatttctgttgttaatttgttgtgtgcctacaggccctgacaggaatactagaaacccattgtaaattaaggtcttgaagacatatttatcaatcattcaataaaagtattgatatttaccaggttctgttttaaacagaagagacataataacagagtcaaat

SEQ ID NO: 174695 - DNA, 814 bp, Homo sapiens
gcctcctgagtagctggaactacaggcaagtgccaccatggggatctggccatgttgcccaggtgggtcgtaaactcctggcctcaagcagccctcctgcttcagcctcctgagtagctgggactaccgctgcacaccagcaggccctgccaattgactgcttttacagtgagtgcacccagggcggccgcagatggcagtgtctctggggacagcagctgcgaatgagtccacgggccaacgctgagctgctcaggctgaggcggtgtgctcagcacagagcccccggaactggcatctgcagggcgtgagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcggccgtcagggcgtcgcagcacggcccccacaacccctatcacgccaaataccaacgccccaacagtccctccaccctcacctccaaccactaagggccacgagggaacagcacatcggaacgatggggagctaacgccagcgtaagagaagaagggaggatgtcaacacatcaaagtagccaggaaagggcaccacagcacgcggacgacagggacaccacatgaggccatcacagaagcaga

SEQ ID NO: 174696 - DNA, 644 bp, Homo sapiens
gcctcctgagtagctggaactacaggcaagtgccaccatggggatctggccatgttgcccaggtgggtcgtaaactcctggcctcaagcagccctcctgcttcagcctcctgagtagctgggactaccgctgcacaccagcaggccctgccaattgactgcttttacagtgagtgcacccagggcggccgcagatggcagtgtctctggggacagcagctgcgaatgagtccacgggccaacgctgagctgctcaggctgaggcggtgtgctcagcacagagcccccggaactggcatctgcagggcgtgaggtgggtctttgggcacacggagggcaccgagtggtgccaatggcttgggaggtagggagaggggctctgcaaactcacactgtctcaggcagcacattggctgaaatgaggctggaaaattccatatagatcatctggtaaccccatccccaccctgtcaccgtgcacaggggaccctgaggcccagagagggtgaagaaggggccaagataacacaggaggccagtgagtgtgttgcttttccacctaggtcagttccctgagaaatcaggaagagaccacggggtcctcagtcagcctcagaatgcctgggattttgtgcacagggctgg

SEQ ID NO: 174697 - DNA, 741 bp, Homo sapiens
agccagtccaggactgccccctcctggcccactcagagcccctgggtgtgagaagctcgtctcccgtgggttgcattggctctgccctatctctgcctccagcacccagggcggccgcagatggcagtgtctctggggacagcagctgcgaatgagtccacgggccaacgctgagctgctcaggctgaggcggtgtgctcagcacagagcccccggaactggcatctgcagggcgtgagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcggccgtcagggcgtcgcagcacggcccccacaacccctatcacgccaaataccaacgccccaacagtccctccaccctcacctccaaccactaagggccacgagggaacagcacatcggaacgatggggagctaacgccagcgtaagagaagaagggaggatgtcaacacatcaaagtagccaggaaagggcaccacagcacgcggacgacagggacaccacatgaggccatcacagaagcaga

SEQ ID NO: 174698 - DNA, 850 bp, Homo sapiens
gaggttgcagtgagcagagatcacgccattgcactccttgtgactaatttgagtcacgacctaaagttggaatgaagacggtgcctgggtgtggactagctaattgcatgtgggcagcttgagttctttctttggtaaatggtcacctaacttttcttcctttgaggtccttgtgtgtttgagtctcaatgttattgttcgtctcactgtaatttgataccacgtactttaactcatatttttagtattgagtgccggattacacatattaggtattccttgatttctctccatcatttggcactttgaccactgtccttgagactctcacttcccttgccttatttctatattgtgacaataaactctggtagttttttcatacacctctagctgtttcttcataatctccttttccgtgccttaaatactgatgttctctagcagtccatgtttttctgttcttctcattctctttcacctgtgtagttgcttctgttgtaagtggtgaacttttatccaaactgctgacgtcaaatatgtaccctcagctcaaaccactctctgagatgcacactcctgaccatcttcatggcatattccaccagcaccctcaattcatgatgtccccagctgagttctgatattctgtctccaagtcaccattccagtccttctccttccatcctgaagcagcctagagggagagacagggaaggaaaattaagtttcagcacaaggttgagaagggtcttgagacagatgggcttgtggagcaataagtgggctctcatccagccctcaagggaaggaatgtaggaatcagtcccaaaaagtgatgcttgagcag

SEQ ID NO: 174699 - DNA, 322 bp, Homo sapiens
cccatcttaagcactcagaactgtctccatttcccttttgcccactcacttctgacgtggccccttgcaggctggctgtggattgcactctcctctgacaccttgacttcctgaggcccttgtttctttggcctcctgggcattgttggtcaccatttctcctagacctccttctccctgtccttctctgcactctgtcctgtccgagtctcccccttctccttgccctcaatgcctccacatcctccagctccctaatgctaggaatacccaacacctcggctgcccttctgcataatcctccagccttcacaggagccaa

SEQ ID NO: 174700 - DNA, 294 bp, Homo sapiens
catgtttgttgagaacagccacttccaattagagacccagtaaaatgttaatttattttaataaattttccctctagggcaagacaaagaatacttttgacaggttacagaaatatctgttcatggaacagagtactgttcaaaagttattgtatgccagtgattaatttttcaatttggcatttagagaatgatgagcagtattcatgacctccccctccatttttctccttacaacctcatgtatatataagagaccaggatttttcatatttgaaattatgttgctttacg

SEQ ID NO: 174701 - DNA, 716 bp, Homo sapiens
cagcttcttggacaacaaaactttaaaaagaaatagcttactaaatgctttcactccttgtcaggtagctacaggctacagcaatgccagtagtcaatgtggaaacctctttccagactgtatgagacatggtatgaggtagtagcctataacagattcactacccaattaaattcatcatgtcaataatttcaggacaagaaaaggcctaagttttcttaaggcatttaaacaaaaataaggtaaggtaggtccatgaaaataataaaccaataccacttctctaacttggttaagctactttccctattgaagatgtgtttccctaatataattgcaggttttgttaaggataataatactgagttaactattttagtcaaatccactttgaaactaatatgctagaataatatgaatatatactataatttattttcaaaggagatagatgtgccaagaatccagattaaactatggactgattaataagcttttcccatctcaacttcatgatactgccttcttcttttcctaatataaattctacctgtttaatttttctaatatgaaacattacacccaccttcatttacattctggcacagtcttccaatgacagcaatatccaaaaacaggaatatattgtccactgaaaaatttgtattagttatctctgtctataaattactccaaaacttgtcgggctcagatgg

SEQ ID NO: 174702 - DNA, 467 bp, Homo sapiens
actttgacacagcagcagactccctctctcttgatcccctctgtcaagttccaagacgtgacactgctggttttcctcctcctcccttctcaagctctcctatctgctcctccagctgacaaatactaaagggactcaaggctgtttctgagtcacctttctttctagatgtatttctctctacaggcagtcttatccctggtcacacatagaattaatcatttaaatacccatgactcttaagctatttctttggcccattgcttttctgacctccagaaagataccccaaagtgcttacttgtaattgtcactttgctgtttcagaggaaactcaaagtcaacaggtcccaaactgtgacctccattgtgcctaccactgctgcctcacacacacacaaaaaagctagtcctccttcagccatacctatctagatgaatgcagtaaccatccacctagccatgaa

SEQ ID NO: 174703 - DNA, 419 bp, Homo sapiens
tgcccctcgtcctgttgccttttcctgctggctggaatgagaacatggtggcagtgagccatcttgggtcatacagaaaaggataacactctcgggatggaataagaagcctgacagccctggatggctaacacctagactatgacatcagagagaaatcaacctctatcttgtgtatgccattattacttggggtctattacatcagccaaacttatatctttaccaaatcagacatgcctaagatgcctttcctatgccaatgtcaaattttcagttgccagcaaatgtttcaagcttgtcttagtgatgctgactgccaggtaccaattctgtttcagcaggatggttgtctctgcacagcaatgcttgtgctgtgcacacattttaacacttggttatcttttgcaacacaaaaa

SEQ ID NO: 174704 - DNA, 543 bp, Homo sapiens
gctcagtggggagagatggaaccgagtgagaggtcaaggtcagtggggagagacaggaaccgagggagaggtcagggtcagaggaggagagacaggaaccgagggagaggtcaaggtcagtggaggagagacaggaaccgagggagaggtcagggtcagaggaggagagacaggaaccgagggagaggtcaaggtcagtgaggagagacgggaaccgagggagaggtcaaggtcagtgacaagagatgggaaccgagcaagagcgtgaggggcagccgagggtcagaggaggagagacgggaacccagggagagggcagggtcagaggaggagagacgggaacttgggagcagagtaagaggtcagggtcggtgaggagagatgggaactgagcgaggggtcaaatcagggaggagccatgtgttcttgatcatgcccccctgaaggagccttggtacaaataataactcaacataaaagacgctgacatcaggccaggtgcagtgggcacctacagtcccagctcttcaccggccataggag

SEQ ID NO: 174705 - DNA, 414 bp, Homo sapiens
tctgagaggaaaaatacactaagtggcactgagcttctttcctgcaaagaaagcaggcaaaggacgtaacacaaataaaacatccaaacaaccacatttctttgcaatgtttgcattttccttcaccagggaaaaaaactctcttctaatctcaagactttatattaaacaaaatcatttcctgtaataagaattttgaaattaactggtaaattaactttcaaagaacaagcctagtttgtggaaaattaactggtgatgatataaggcactaatttaatgaataatgatgaggggaaataaattatacatcatataagaaaaactgcttatttgcaactttgttctggatagtaggaacagcatagtctaggacaaatccgcatcccatgatcttcatctcttctatcttct

SEQ ID NO: 174706 - DNA, 992 bp, Homo sapiens
  misc_feature (842)..(843): n is a, c, g, or t
  misc_feature (870)..(870): n is a, c, g, or t
  misc_feature (873)..(873): n is a, c, g, or t
  misc_feature (878)..(878): n is a, c, g, or t
  misc_feature (897)..(897): n is a, c, g, or t
  misc_feature (899)..(899): n is a, c, g, or t
  misc_feature (903)..(903): n is a, c, g, or t
  misc_feature (910)..(910): n is a, c, g, or t
  misc_feature (916)..(916): n is a, c, g, or t
  misc_feature (920)..(920): n is a, c, g, or t
  misc_feature (925)..(925): n is a, c, g, or t
  misc_feature (938)..(938): n is a, c, g, or t
  misc_feature (940)..(940): n is a, c, g, or t
ttttttcaagttcctgtatttttatgtggagttgctcactgcccaacgtagaggactaggaatcaggagtcggtggccgtatgctggaggctggagccgcgggagcgcggctcgcctcgctgcggttgtggcagtgacggagagagagcagcgcggctggagcagtgacacaaatcactatgtaatatagttagcctttgaacaacacggatttgaactgcaggggtctacttatgagcagattttctcccacctctaccacctgagacagcgaagaccaatcttcctcttcctccttctccttagcctgctcaacttgaagactatgatgaagagttatataatgatctacttgcatttaatgaacaatagtttcccttgcaaagttatcaaagtgctccccagaagacattaggtattgctttctagtctacatacaatgaaaaggaaaaaacgtcagttcctgaagctctctcaaaacatcaacagatggaaagacgtgcccatgtcctcccctccctccactctgggggcttggaaatgctgcagcagggagcaggccccaggctggacctgccctgtcctcacgacgagtgtgtgcaaaagtgaacaataaatcatttcaaagatgcaaggaagaaaaaccaaaacatcaacagaatcttctttcccataatcttcatgcacctcctggtccggatgagtttatgttcccatctccgagcacagggattgattgtgatggcatttataggactgagtggcccaaactctgtgatccagcatggagttatgatttacatcaccacaggaagagtacagaggcttcaacagaaaaaaannaaaaaaagaccttattcagttaggacntantaatnggaggagttgataacgaangngggngggagtntccgangganagggngtggcaagaaagncnggtgggaaagggggtgtgacggttggggttaagggagaagggggagcctgta

SEQ ID NO: 174707 - DNA, 989 bp, Homo sapiens
  misc_feature (976)..(976): n is a, c, g, or t
  misc_feature (983)..(983): n is a, c, g, or t
ttttttcaagttcctgtatttttatgtggagttgctcactgcccaacgtagaggactaggaatcaggagtcggtggccgtatgctggaggctggagccgcgggagcgcggctcgcctcgctgcggttgtggcagtgacggagagagagcagcgcggctggagcagtgacacaaatcactatgtaatatagttagcctttgaacaacacggatttgaactgcaggggtctacttatgagcagattttctcccacctctaccacctgagacagcgaagaccaatcttcctcttcctccttctccttagcctgctcaacttgaagactatgatgaagagttatataatgatctacttgcatttaatgaacagaagtctaatgcctacatttaaaggatagcccggcccccagtaaacgcggattcctgctcgtggccttctacgcccattactggagcagcagccatcagcgtagacgacgacgaagtctcccatgtaggaaaacgtgtctctgctaactggaggcgccggcttcaccctcggcttcatgtgcttgcatatggctctgcgctttcatctccatctccatccagtggctcacggagtcgcttgctggctttcgtctctgattcttgtccatgttgattttcctgcccttctgaaacttccgggcttgcagatttcctgacaaagtcccaggtctcatcctctgtggcaaacttcttaaatctggcagcaggaaaccggtccacctgtgctttgcactcattcccggtcagaaagaccccggtcttgcggcccctcctcacggcatagaacatcccgaacccgtgagagcagcggggcagggcaaggcggccaaggcgactctgcggccaggaacagaagccggctcatcgctcactcccggcaccaggaagcatttcgactcccggcccagcgtgggcgcgagccgccggcgatcaacccggtgggtcanaacagtncgtcaa

SEQ ID NO: 174708 - DNA, 460 bp, Homo sapiens
tgtcatccaggttgtgatcatgatcacagctcactacagccttgactcccaggctcaagcgagcctcccatctcagtctcccaagtagctggggttacaggtgtgcaccaaaacacccagctaattttgtatttgtttttgtagagatgtggtctcactatgtcacccaggctggtctggaacttctggacagaagcgatcctcccacctaggcctcccaacttgctgggactacaggtgtgggcagcacacctggccatttcacagttcttattgccatttgtttatggtgccagaaaggtattgctgagtttccagttttgaaactaatttctttttttcagtgacacaaatcactatgtaatatagttagcctttgaacaacacggatttgaactgcaggggtctacttatgagcagattttctcccacctctaccacctgagacagcgaagaccaa

SEQ ID NO: 174709 - DNA, 347 bp, Homo sapiens
tcttccaaccttgaacccagttacaccatttatcgtaaacatactgtctgtatacagaaccagtttattgatgttttgagtctttgcttgttcaatggccttgtaggctgcatgaatttccgctctttggtttgtctgccacccaggaagtctaatgcctacatttaaaggatagcccggcccccagtaaacgcggattcctgctcgtggccttctacgcccattactggagcagcagccatcagcgtagacgacgacgaagtctcccatgtaggaaaacgtgtctctgctaactggaggcgccggcttcaccctcggcttcatgtgcttgcatatggctctgcgct

SEQ ID NO: 174710 - DNA, 471 bp, Homo sapiens
gtttcccagaagtgagtatttgatccctaccccaccccatttttagaaaactcaggaaaacgctctcgtatttctatctgaaaaggacactttagagaaatacgttccattacagtctttgtgttcgcattgtattccttctcgatgaaacaggtataagtccattggtattttacgcacgacaagacaactttgcagcccgactcatgacctttagattaagaaacactctccgggagctctgctgatcgctgggtcttacgaggttgatgccttctgtcccaaagagaactatttccctgcgtgtttccgcctggctgcccacttctccagtagagaaacagctgttcctcgggattcatttttggaagttctttgggtcctgggtaatggggccgcatcctgcagcgtcgacaaggtggttgaatacgcaggaacacccacagtacccagggactaataaatagctca

SEQ ID NO: 174711 - DNA, 251 bp, Homo sapiens
tggccggaccgccaagagcttagtatactagtacttaggataacaaacagcgtactttactgttctgcagtaaataaccggatactaaaatttatcactaagattatcatcttaaaattaccaagaatgctaacatcaggcataaaaaacctgatgtaaggctgaggcgggcaggtcacttgaggtcaggagttcgagaccagccttgccaacatggtgaaaccctgtctctactagaaatacaaaaatta

SEQ ID NO: 174712 - DNA, 358 bp, Homo sapiens
aggtgttatagtgcaatggttaaagtgaaacaccttcggtccaaaatgcggctctactgcttactactactcatagtatctgccttgtagggttgtggagatggctggctgagatgatgcatataaaccacatcgtccagggcctggcatggagaagagttaacagtagttcttaccatcctcacagaccatggcagataggagctgactgatggaggattctaaccaggaaggtaggtggtcagatttatttcttaggaagatccctgaggcagtgagatctgagttttaattaggctctaccacttaactagttgtgtgaccttacacaagtaacatatcctctctgtaccctagt

SEQ ID NO: 174713 - DNA, 554 bp, Homo sapiens
ttatatcgccaacacacgctggtaattttttgtgtttttagcagaggcagggtttcatcatgttggccaggctggtctcgaactcctgaccttaggtgatctgccctcctcgtgctcccaaagtgttgggattataggtgtgagccaccatgcctggctgaaagtgtttttatatagtcatttatgtagacatacagaagagacttttccatattcctttactatgaccagattgaatttttcatgccaaggacagtgcttaatttgaacacacatgtttagccagttctctgtgctctaccttagagttagttcatactgcctttgttatgggaactattctgggaaataggaaggaaagccgagtgaaaaggagtagaaactgcttaagaaggtttgtcaggatgcagattggtaggttgggggtaaggacagaaaagtcttcatacagcttaactttaaaatttaattttattttttgtctggatttctaccaggagctttatttgggttaacaagtatgttctaaagcctaggagtgtaggggatatcat

SEQ ID NO: 174714 - DNA, 608 bp, Homo sapiens
tgtagcagtttggatcccagacaaggtgactaactgaggaagcaagcaggggctaaaattgaaactctttccccaagccagcctgtgtttactgaaaagaaaagggcctttaaaaatccaccaacactccctttagctgagcagccacttatagtcccagctactcgggagtttgaggtggaaggatcccttgagcccaggagttccagtccacctgagcaacagaacaagaccccatctctaaaacaaacaaacaaacaaaataaaaaatgccattccatccccctcacctgcagtgccttcccctatgttccagtggctgcctgtaggatgctgtaagagtttgaaacaggggccctgacctagagcgagggttagagaatccctcctaaagaaatgactttcaagttgagacctggaagctgagcatgagttaaccagttgaaaggaggaaaggaaggagagtgagccaagcagaacacagtccaaggctgcaagtcagagaagagctttgaaagaaagtgcttgtggctggggggcagtgagccaatggcagaaggaatgagtgctgtggctggagtgatgggctttttaagccacattaggaa

SEQ ID NO: 174715 - DNA, 354 bp, Homo sapiens
tcggtttttaacagtctcactccgtcatcatatgagtggctgtactgggaattcttttgaaacttgcagagaacaggattatttctggcggcctctgctgagttggcgtgtgtgtgtgtgtttgtgtgtgtgtgtattagggagaggaaatcgtaggtccagtgtggacccagagctaaggggaatcttggagagtagtggctctggcagatgaggattcagaaatcgagtgcaaggactgttctggactttcactgctaacctgctttttctcagtgcctggctctgagggcagggtccagctggtgtcatgctctccaagggcttcattttatgttccagccaggcaaagga

SEQ ID NO: 174716 - DNA, 172 bp, Homo sapiens
tcaggaccttggaatcaccgcggtatttggtaagtatccctatattgtatgcagtttgtaaatatgtagtgctgggttcttgcgtgtgtgtgtgtgtgtgatttgttaaacttacctaaatggtactgtattctcttggtactatttagggactgtgtcgctgtgtattccg

SEQ ID NO: 174717 - DNA, 365 bp, Homo sapiens
catttttaaaaatagaagtgtgtattcagggtgcactcaataggattacatctggctggcagtcccttcctacttcagtccattatcctgctaccagaatgatcttcatggtttcatttaaaaaaaaaaaaaatgagatcctgtttctgtcttaaagttctcttctaattccttgtattaatcaggattctccagagaaacaagaccaataggatgcatatgtgtatacacatatatgtatagctctctccctcatatatacacatatcatgtatatacatatatatcatatatgtacatatatatatatatatatgagggagagaaagatttataaggaattagttcatgcacttaggctgaga

SEQ ID NO: 174718 - DNA, 450 bp, Homo sapiens
actctcatgatagcataagcttccaaagcaccaattaggcaactaattatttggattggtgatatcttttttatttgccttcttattgcttaaaggtagtgaccatctctcttaattaatttacatggcctcattggaagaagagtcaagtaaaaacttttgacaatgaactaggttaacaatgaggggcattgtcagcactgctaagctagatactgtaagttctaaagggaaaatacaaaatgacagctgactctccgtcttctttcactttcctcaaagaaaagtttcagtgaagggaaaatcttatgaaatatattggacaataaatattttaaggaaccaaggcatctggagacccacttcccagaagaaagaaagtatcttgtattaagtgagatgtatcattatgtgagtcaattaataaaataaattaattatggactatta

SEQ ID NO: 174719 - DNA, 106 bp, Homo sapiens
aatccagagctagtctttgtctttaaaaaaaaatgtcttaggagcttaagtaataattaactaacaaattattatttcataaagcaacaaccataccccttcccat

SEQ ID NO: 174720 - DNA, 346 bp, Homo sapiens
tagaacaatgcctgcagtgaggaggtactcaataagtatttgttgaatcaattagggaatgaagctcttccatctccattatcaccaataccacctctacagttataattagtgagaattatggcagtgctaatgttattttttcatttccatgtgtgcctttttggaaagacttgctgcaacaagcttcacatatcttcctctgcagagtagaagtatgtcactaagccatggagttgatttcttggctccttgtatagcaaatagccttgcatttggttcgtgtcagtctttgcatctttttttagtcacgttgcctacacccttcacaatcctctagcttaaa

SEQ ID NO: 174721 - DNA, 636 bp, Homo sapiens
gcaaaatataaaaaaaattagccaggtgtggtggctgtatgcacctgtggtctcagctactcgggaccacaggcatgcgccatcacgcccggctaacttttgtatttttagtagagactggttgcactatgttggccaggctggtcttgaactcccgaccccaggtcatccacctgccttggcctcccaaagtgctggtattacaggcatgagccaccacacctggccttattaaatacttttataaaattaaaactattttacggttctggcatttggcatccatctagttgccgagggtctagtgtcattgtcattgtcttgtacatgttaagtttcaacctacacatctatttaccaatttttgagtactaagagagtctgagcccagcctctaccatgaaccgctgctagccagcacatgcactggaaccatggattggagatgagagggaggaaagggaaaatgagattagctaggcaagaatcaattgcatttatgccaagagggaggattcaacaagttaaataattagtcttacctcaaagtttccatagctcatatcctgcctgtatctgaaggggtgaccttctgtggtgtcacagatgtctgtatcagtgagacacagcagcttt

SEQ ID NO: 174722 - DNA, 772 bp, Homo sapiens
  misc_feature (33)..(33): n is a, c, g, or t
gctggtatggatctctaggcaagtcttagttanacttagggatccaattaccaagagtttcagttcaccctaaccagattttctgggtagtgggtagcaccatggcacaggcatcaaatgcttggaccaagtaccagtttctagttgtgtgcagctggacaagctactcctcttccctaaacctcagttttctcatctgtaaaacaggaatcaagcatgtagcacagagactgacacatggaaaggacccctcagtggtataactgctgctgggatgagagtgatttcccaagtcccccagccatactgtacgtagagaacaaggctcagcccagtactctcaacagggcaatgtggccctccaggagacatgtggcaatgtctggagacactctaggtgtcacaacgcaggcaatgtcctactagcatctgacgggtggaggccaggggtgctgctcaccctcctacatcacacaggacgcccccaaccaccaccaggaactcctccagccctaaaagtcaacagtgctgagactgagaagtcctagctctgaggaatgacggcgcagccacagatccttcccccattttcccccaatgattcgcgtcactgggaggtgggaggcagtaaagataagcaagaaaactgagcatggccatcaataccttgtgcctaaattttgctactccaggaagcccagaataaatgcccggaaagtcttcattgaatatggaaccgtggagacaaaagtgactgcatctcaagctgggt

SEQ ID NO: 174723 - DNA, 1123 bp, Homo sapiens
ccctacccgtgccccgagtgcggcgaggccttcagcctcagctcgcatctgttgagccaccggcgcgcgcacgcggcggccagcggcgcgggggcggcggcgctgcggcccttcgcctgcggggagtgcggcaagggcttcgtgcgccgttcgcacctggccaaccaccagcgcatccacacgggcgagaagccgcacggctgtggcgagtgcggcaagcgcttcagctggcgctcggacttggtgaagcaccagcgcgtgcacacgggcgagaagccctacatgtgctccgagtgcggcgagaccttcagcgtcagctcgcacctcttcacgcacaagcgcacgcactcgggtgagcggccctacgtgtgccgcgagtgcgggaagggcttcgggcgtaactcgcacctggtgaaccacctgcgcgtgcacaccggcgagaagcccttccgctgtggccagtgcgagaagcgcttcagcgacttctccacgctcacgcagcaccagcgcacgcacacgggcgagaagccctacacgtgcatcgagtgcggcaagagctttatccagagctcccacctgatccgccaccgccgcatccacacgggcaacaagccgcacaagtgtgcgggctgcggcaaaggcttccgctataaaacgcacctcgcgcagcaccagaagctgcacctgtgttaggggctgggtccgcgggaggctgccgtctggggagcctgtggggggtagatatcctgggactgacccaggggaaggaagtggggaaggggcgggagggacaatctgagagtgactggggagcctttggtgtttggggtttcctgaagtgggaggagtgttgagtaagttggtctttcccggtgctatacttgcctcctctccacggaagaattgttcaggagatgcgcttggggtgatgacttccttaaatacacgctgtagggggtgaagagcttggaggaccaggcactttgaggaagggcagttcgtgggctggggtgggaacaggatggcgggcaatagactagggtaggccgcgatggcctgtagaaggttgcggggagagggtttaaatgagggttatggggcgaaataaaaccaagtataagtg

SEQ ID NO: 174724 - DNA, 379 bp, Homo sapiens
aaacagaaatcatagcgctgaataatactatgactgaactgaaaaattaaatagagggattcaacagctgactagatcaagcagaagaaacgatcatttaacttaaagacggatcattagaaagcatccaatctgaggaacaaaaacaaaaaagaacttaaaagagtaatgatagcttaaaagacttatgggacaccatcaaatgtaacagcataagcattactggtatacctgaaggagaggggagagataaaaggacagaaaacattttcaaagtaataatggcagaaaacttcctaagcctgggtgaagaaaatagaaatcctgattcaggaagcccaaaagaaaccaaataggatgaatcaaaagagactcatgc

SEQ ID NO: 174725 - DNA, 1004 bp, Homo sapiens
aatttggccttcactgttgtgaatcagggattaccaatcccaattttaacagaagttactgacttggcatttgttgcccattaaacctaaacatcaactatcctgaagttctgttgacaatttagtcaggtatgctccagttcatatttctgatcttgaaaaatacctaccagattctttaatggtttttcaaaatatatttacactacatatgctgtctaggtgaggaaacatctttgaaaattgagtttaccttaacgctactttttgtgctttaagtctctcctatctcagggcactcttttaaatatacaaggcatccatccagaatttactggacatgctgaaagaaggctgtaatggtcagattaatctttatttttacagcattagctttagcactgtttggctgacatatcacttattaataaggtaaaacgtgtataatggcaagaactctgttactatttttgttttataaacttatctaccaaggattaaattattttaaaacacaaatactgtatttttttgtgaaataatttcaatatttaaaaaatgtgaatgaaattaacagaaaaatataactagatataaaatacataaagcttacagacatgcataaccaattatgtaactcatatataaaatacaagaactaagtaacaaccaatgtacagatttagatccaaaatgtaacttatagacatatagagatatttattttcaacaatgaaaaattaagctaaaaaatcatgttacatgctattttgtaacacataggctctcctttattttgaaaatatagtatactagtctacatacattaataaaatatgaattaaattcttaaactgagtaaaaataaaatgtcacccaattatgagtctttaaaattagtatttaaaaactcaacagagtaagcgaaaaatatataagggtaaacacatttcagaaagagaacaagtgttaaatttcagtttatctgactttatactcaaaaa

SEQ ID NO: 174726 - DNA, 175 bp, Homo sapiens
tggtagttgctgggggctggagggaaaggagagagtgaggatgtttaatgaataaagagttttagttttgcaaaatgaagagttctggacatgaatggtgataatggtgaatgtaattttttttttttttttttttttttttttttttttttttttttttttttttttttttttt

SEQ ID NO: 174727 - DNA, 380 bp, Homo sapiens
gtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtca

SEQ ID NO: 174728 - DNA, 323 bp, Homo sapiens
ggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcct

SEQ ID NO: 174729 - DNA, 635 bp, Homo sapiens
gggaggggagagaggtgaggatttgctgctcactgcatgatagtagtgatagtcagcccttgcccaggtctgacagcaggcacttctacacagggataaggtggcgtgctcatgctgggagcaggtacctttgccctctccattccttggataggtggagctcagctcaaaagcacacagcccataggcaagaaaacctgggtgaggagccagcactgcccctggggtttttccccggggtgacatgagatgtcccctccagagaaaggctgccggtaggaggcacccatcttcccattactgagccagaaccctactgagggggctctcaactcctcgtgctggtcctagcttgttggacagtcatgccttcatccagttaaaattacagttgaaaacgtgcatttctcagagcatttatgggattcagtggtgacagaacatactctttcaacttgcttgggacctgattgcacaagccaagccctactcccctccgcagccttggcttatgactgggtcctgcactaaggtaccacctgccttgtggggcactgaccacctacagacgggaagcctgaccaggcttacagtcaggttttgccttttacaggcagtagtggccttggggagct

SEQ ID NO: 174730 - DNA, 1134 bp, Homo sapiens
tgcctcggcctcccaaagtgctgggattacaggcgtaagccactgcacccggcccacattcctttccttaccctcaccaccccctcctcacaaagtcagagatctcccacttgactcaagtccctgggttccctccagccagtaaaccccgtgtgcaaatgtcctgactcttgcaaaagtgttaaaaaacaaaccttaaaaagcttccagatgttctgtttgtattgtggtgcttctctgcgctggtctccagaggccaatacgcagtgcacagcatcctgactgcccagataaaatatgaggcagccaagaggcacagcctgggggtgagtggggatgacccttcccccaggaccacggctcccccagttcacccattaactcttccattgccaaagggcaactttccacgcaaaaaccttcaaaagactgcaaaggaacaagtctgataagcttttaggttttgtctcctctgagtgtccacctcacctcaccattaaacttctcacaccaactgcctttgggatgtcgagtcagggactcaacgacacaagagtgaccctcctacttaagatgctaagttaccattttcaaggacatcttaggagctggaccatccagaatgcgggaacagagttcatgagttgtcgaggcccctctggggctggtggcctctgatctacagaaaggtaattgccaacgggccagcttgtgcacacacagccacacacgcaacccaaggtgcacgcacctgagggcccacgattctttgcacagggtgacgcctgctccctttgatgcttgccggatgtgttcccaatgggcaaaaaccagacctcaataaaacccggcattatcaagaggccggtggtttgtgattgcaccagcctgttatctccgaggccctgggtggggctgctttgcggttctccattgaaaagcattaacttataggtagatcaaagaccctcccgaaccagccgacctggtcccttgtttgtcccggtggactgtgccaaaagatggactttaaagataataggtaccccagtcccagactcccttctgccctccctctccttctcatgcactacgtccctcaggggccatccaacagccaatcataaggccttt

SEQ ID NO: 174731 - DNA, 379 bp, Homo sapiens
ttttaattttatactggaaagccaaatgcccatgaagagacattaaatcaagaatggcaaattcacacgcacaaaaaataaaaataaaaataaaaaaagaaattaaagaatggcaaattgaaaacatggaacactatgcagcagtttttttaaaaaaatagaatgacgacactgattttttaataggaaaaatacatctaagataaccaaaaaatgcaagatgtagaacagtggaaagtatgtaaccctttgcataaaaagagactgaaaaactaggaaacatctttgcttgttctgcaccaagagaaactaagcgggaaggaactggacagatagaagactagatgtgagaaaaacttccgtgtgtgtgtgtgtgtgt

SEQ ID NO: 174732 - DNA, 306 bp, Homo sapiens
gggctcatcacacggacctccaaggcagttgtgagcggtgagtaagacacaaggaaacttgtagtatcctgtgatttcaggtgctcaacatgctttagccaatcaggaaacttcccctcttccttccaagtcttgcgtggtctgggaaggaagtgcaaccctaaaccaggctgcagctaaccaggagtgacactacggggcagtcgataggatactatggcaattctatatggggcacaggtcccaggcggtggaccagaagtggtgggagtgtgcatgtcaggaaagtggggccgggctggctga

SEQ ID NO: 174733 - DNA, 482 bp, Homo sapiens
caaagtgttacctggattcctacccaggattttcctattgtctcaggacctaaagggaaaagaccggccatggggcatgtgagcctctgggaaatctgcctcaagcccataatgccatccgtctacagcagttggaacagtgtaagagtcagacctcgccagatcccaagcgctgcaacatgaagaacaaaaccaaggttaagccacagaccaggccccgtggagatttcgctgcttctagcctgaccgtcaggatttgggtcctgaccgctcccctggctgttgggctggtcccagctctgggcctccgttttctcacccacagaatggggacgatacaggacctccctcatcagagctgtcacaagtggtaagtgaatgggttcgtgagaagctctgcagtgcctggcgcagaccaagggccccaccgatggtggctgtgagttttcccactaatgtattttttgatatgtaacatttta

SEQ ID NO: 174734 - DNA, 387 bp, Homo sapiens
cctaatcctaattttaatgcccatactacacacatccaaacaacgaagcataatatttcgaccactaagtcaatgcctattctgaatactagtagcagacctcattacatccaagtcatcatgttggatgaaaatggcttcttgctacattcacattaaaacttgaaaatggaaaagaaaaagagagggggaaaaagtagctaaatagcagtgttcgctcagcatgattttgctttaatccaagcctgtgagcttaccagggctcagaaatcaccatcctttagttaatgtcttgctcttgttactaaatatttattattctattcaaaatatcacagaattaagataatagcttcacaaaacagattcagagatattaattacttc

SEQ ID NO: 174735 - DNA, 462 bp, Homo sapiens
tttaaatgcaataaaattcaccaatgttaagtgcacaataaatgagttttaacaaatataccatcatatagtcactaccacaatcatgaaattgataggatattttcattacccccaaaaaattaccttgaaacatttttcagtcattctacacccctaccctctgcctcctggcaaccactaatctgctttttataactaagattttggacttttttttagcacttcacataaatggaattatatagtagatagtcttgagtctgactcctttcacatagcatgaagcttttgagattcattcgtgttttacatatcagtggttcattctttattattgctgagtagcatttcactgtaaggttttactacattttatatattcatttaccagttcttgggcatttggattgattccagtttttaatgagtatgaataaaaccactataaacaaaattgtg

SEQ ID NO: 174736 - DNA, 567 bp, Homo sapiens
tcacctcattccaatctgcgatctctctaccactcagctcaactgctctttcaggtcactgacaacctccagacaaggctaaatccaaatgaaactcttctgtcctcacgtacacctcactctcagcagcatgcaaggcagtcccccagaagacgctcctcattagaacattctcctcgcctggcttctctgatgtcacacactcgttgttttctcactggccatttctcagtctccctagttggagggctgctcctctccttccttccttccttcttctgtcccactgataacacagaggctcccacagaggtcaggctgtggacctagcacacttccctgagtgcagcacatttgctcgaagtaaattcacatttgttttatttgtgctgtttccccagcaactaaaacaaagcgctgggagattcaagacaagttctgttgaataaacgaagccgtttccgtgggtttttaaaatattcttctccaggccgggcacggtggctcacgcctgtaatcccagctactcaggaggccaaagaccggataatcgcttgaacccgggag

SEQ ID NO: 174737 - DNA, 722 bp, Homo sapiens
ttaataattaagagacgctaacccaaagaaagatatcacatagactacttccatccaccagtgctaacaattatcaccaatactttaaaaatcatttttatattaggaaataatatttgtaagtgactttggatcttcttctagaataagatttcctgggagaaactgcgtaattattatttctcagtagcctcatattactttaaaggcctactttccagagttttatttatccttatttgagggaaacagcaaagggtaaagagaaaagaggaaagcagataccaagaatttaaatcacaaacaagtagttctagattcgtctgaaatcctttgttttttagtggagagaacagggttttttatagttcatttattaaagatttgttattgttatattttatataacagaaaaattaaaattgtgtttaaactcgctattaaaaatccagctaaagaaaaccattgcccttaaaatccaatggattaggagagtgggggagatcattggacaaatttggggcttatcattatcaacagtgcccttttaagcttgtggatttctgagccaatgtggaaaatgtaacaacagggatttcccagcagcaagaggcactctccaagggagtaaattgtcaactattgcctctcgtgagaaacttaagagtaaccttgatccaatctcaatagtcaacccatgtattatcacccagttggggcat

SEQ ID NO: 174738 - DNA, 689 bp, Homo sapiens
cctgggcaatagagcaagactctgtcccaaaaaataaaaataataaaaataataaaataaaggaacattactggagataaaaaggaaatttcaccattatcctcagcaaactaatgcagaaacagaaaaccaaatgctgcatgttctcacttataagtgggagctgaatgatgggaacacatggacacatgtgggggaacaacacacctaggggaacaacacacattggggcctgggtggcagggggagagcatgtggaagaatagctaatggatgctgggcttaatacctaggtgatgggttaatcggtgcagcaaaccactatggcacacgtttacctatgtaacaaacctgcacatcctgcacatgtagccctggaacttaaaataaaagctgaagattaaaaaaaagaataataacaaatggggaaatctaccaggcagatacaataattctaagtgtgctcatgcctagtgacattcctccaaatacataaagcaaaaaattacaaaactaaaaggagaaacaggcaaatctacaatcacactcggagatttcaacatctcttttccagtaactgatcctaccagccaatttttgaagagcaataaggatagagaagattagaaccacaaaattaataaactaatttacctatgttggatccacaacaaaaaatgcagtcaagt

SEQ ID NO: 174739 - DNA, 128 bp, Homo sapiens
agaatcaagactacaatatcaactcttacttgaatttctagcctgccagccttccctacaaattccaacttgcccaccatcataattgcatgagccatttcctcacattctctttatacacacacaca

SEQ ID NO: 174740 - DNA, 614 bp, Homo sapiens
aaatagttatcagacaaaggctcctgcctttgggcattcaaggaaccaccagcataatggcctcctccctaaccaaggaatcctgccaaataacacacatttcctgcacactcaagctcctaatgaggtttttcctgatttgctatgaaatatgaatcactgcacctggcccaatttctgtatttattcacactaaaataactttgaatactttactaccctaatttattaatttgggttgctaagtgtgattatttctttttaaataatctataagggtttgtttgtttgtttgcttgtttgtttttgagacggagtttcgttcttgttgcccaggctggagtgcaatggcgccatcttggctcactgcaacctccccttgccgggtcaagtgattatcctgcctcagccttccaagtagctgggattacaggcatgcaccaccatgcccgggtaattttctatttttagtagagatggagtttcactatgtcaaccaggccaacatggtgaaaccccgtctctactaaaaatacaaaaattagccagatgtggttggcgggagcctgtaatcccagctactcaggaggctgagacagggcagaattgcttga

SEQ ID NO: 174741 - DNA, 405 bp, Homo sapiens
tcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtg

SEQ ID NO: 174742 - DNA, 356 bp, Homo sapiens
gtgaggctagtagatataaagaactgtgacagacctgagatgtcaacctatttgcaagccaacaaattagctcgttggcagatgctgacaaaagatagcagcttcctggatcagagccaaaagactttactccagcacggcaggcagccttaagtttcatgtttacatcatttctacttgtaccccaagacccacgggcttgcttcatagatgaggaaccacaatcttttattataatgggctgcaagtgaacctactcaacttctctcttggagggaggcattatctttatgatactggagagtaagcacacctgagccctgctctggaaggagacactatctctatgttccagg

SEQ ID NO: 174743 - DNA, 628 bp, Homo sapiens
gagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggagg

SEQ ID NO: 174744 - DNA, 266 bp, Homo sapiens
ggagaccctgtctcggcaagggaaggggaaggggaaggggagggacatattcaagtttagatgatgtgatagtataaaagtgatgtcctgaaaagctctttttttaacatgtccaatcctattttctcactatcttcaggacaaaattaggggaagattcttctctagtccatgtatatgtatacgtacatataaaaacttaactctgcaagtctttttaacttttggctgggcgcggtggctcacacctgtaatcccaacacctt

SEQ ID NO: 174745 - DNA, 759 bp, Homo sapiens
catccttcccttatatacctctcaacataatgactgtacaatatggccaatgaaacggatagtaaaatgaaacataggcaagtaataaagtgagatatgaagacagtagtacaacctggatgagggtggaatgcaaaattgtcatcagagaagacgacaggaggacctgagagctggagggacggacgcttatctacccaaatgaggctataaaaagtagaaagatggcagggtaaaaatgggggagggctgccacttaagactctcaggaaacagtgatgcatcagactttatcattaagtcccaggggagaggagtggatctggggatccctttagatatggtagaattctcctgggtcctgctctggtcttaaatctcagaccagtagcaggaaaaccctaactgtactgtggtcctgaatgtcactgcaacttcagccctgctgtggtggtgtatctgctcctctggctggctctgccaccttgaaaggtgagaccatgtggagcagagccaaggggcctcagctgacagccagcaccaaccatcagtcatgtgagtgagaccaccttggacccccaaccccagttgggttgtcagatgactatagctgcaggtacaagagtgacccagtgacaccagcagatgaaccggctagcttagctcagcccaaactgctgacttagaactgttgttatgttaagccagtacattttcagtgactcattacaaagcagtagataactgtgacagtctaag

SEQ ID NO: 174746 - DNA, 967 bp, Homo sapiens
  misc_feature (356)..(356): n is a, c, g, or t
  misc_feature (422)..(422): n is a, c, g, or t
  misc_feature (449)..(449): n is a, c, g, or t
  misc_feature (479)..(480): n is a, c, g, or t
  misc_feature (508)..(508): n is a, c, g, or t
  misc_feature (512)..(512): n is a, c, g, or t
  misc_feature (965)..(965): n is a, c, g, or t
gagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgtttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatntctttgggaaaacataaagctgccattgaagtatataatgaagcgctaaactcaaccagaaagatngggagatcagccataacctaggagttngtacatatacctgaagcagttcaacaaggnncaagaccagttgcacaatgccctgaatnttantaggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcagaagaaatatgtggcggcatcagctgcctgaaacgagcaactacttggcaccttcgattggaagatctgtataatttgggcttgtcatttgacatgcagngt

SEQ ID NO: 174747 - DNA, 426 bp, Homo sapiens
cgcacttcaggcaggattaacatcatgggcaactccaggaggtgtgagagcacacaattttgccgctgttggatgtcacacacgatgggagaattgaagctcatgaataaacaagttgtcctcgccaaaattccacccagtgatagatgggagaattgaagcacatgaataaacaagttgtcctcgccaaaattccacccaggtcagagaaagcaaagtcaggatttgaacccaaatcttccttcaaattcagatctcttcctctaccactggttttctggaactctcaaatcagcctgtcctcaatccctatggctggcacaccaggagatcttctgagtgcgatcttcacacccctctggaattggcattcttcttctagtgtcccttccactgctccttggaaacagcaagttctgtttttag

SEQ ID NO: 174748 - DNA, 643 bp, Homo sapiens
gaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatg

SEQ ID NO: 174749 - DNA, 395 bp, Homo sapiens
aatcccccacaaaatggtattaagaggtgtggcctttgggaggtaattaagtcatgagagtcccaccctcacggatgggatcagcatccttccaaaagggcttggggttgaagggagtgcctgtgtacccttctgccctcggccacgtgaagacacaacagcaaggtgccatcttggaagcggatagcagccctcacccgacaccactgctggcaccttggtcttggacctcccagactccagaactgtgagaaataaatgtctgttctttaaaattacccagactgaggtatttttttatagcaggaactaagtgaattaagtgaacgaagtgaacccctcaagacaacccttgaagcctgtttccttatctgtgaagtcggaggtggcactta

SEQ ID NO: 174750 - DNA, 587 bp, Homo sapiens
cagggtttctgaggaaaagttccttttggaaaattcccacccagccccagctgactaaaagggaggaaggatttttccacagggtgctctgggttggtgtgggatttagagcccccggcagccacttgtctgaaggaacaaggagctgggctagacagaaagggagtcccaggcaggctggagctgaggtcacccgggagggcaggagctgaggtcacccaggagggcaggagctgaggtcagccgggtggtgcttccccttggaccccactgcccctccttggcatggatacgggtggagttttcactctctgacttgctcttctagaactcaacactttggtttcatctgaatcctaattatccaatatattaaatcaagtgataagataaacatttttccacctctttctatccctaagcctctggtgacttctttttttcccttttgataagtatttaaatgtttttaaaaattaaaatataattcgcccaattcactaaatatgaaattcatcattttaaagtgcacaattcagtgatatttagtgtagtcactatttcctgtgacttcctgtcctggtggc

SEQ ID NO: 174751 - DNA, 426 bp, Homo sapiens
taaaaatgtgcctgttcttcaacataactgagttctaggggatgccacagatttaagaaccaactagtgttggcataatatgcaataactatttctgggtctataatttattcatttgagaagagtgttaatgtggcccaagtcaaatgttcaatctcaggatccatgcagttatgtaattagtatttgttgaagactaaccacatgcatgtcacccctgtttacccagccattgctggaggcagaggagaccctcaacatttcaaataaaaataaataaataaatctatgtcacctaagttgtcctccctctctctagtttatagcttctagtggagttacctgatttacggataacttcactggcttccgccctcgcccaaatattgcaggcctttggcccctgaaaaccccacctagggactg

SEQ ID NO: 174752 - DNA, 370 bp, Homo sapiens
tccaacagttacctcccacccccaacacagaggcagttaaatatgcttgtgaagtagccatagtccacccaccttttggcattaccatgaatggacacgtctttctcaattaaaacatgagaatccatggctcctgaagcccttaaaataaaaacaggatttagaaaaccagtgaacttcatatatatagtttttgtatgatatgaaattattatgcttagaaagaaaaaaaatcaatttcactaacaagataggaactgacttggagtaaacagaaaggttaactgtattggttgttaaggagcccaggcatacgtgtgcagcatattaacagctgcataggccaaggatcaggaatgctggtgttggg

SEQ ID NO: 174753 - DNA, 988 bp, Homo sapiens
gctgcgccccaggtgagcggcgagggggcgggggaggggctgagccggaggcggctcacctggcgggacaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgctgcctgctctggcgaccctgggtgtgggagtggtgccgggctgccttctgcttccgccgctgccgggattgcctccagcgctgtggagcctgtgtgcggggatgcagcccctgcctgtctactgaggactccactgaggggactgctgaagccaactgggccaaggagcacaatggagtgccccccagccctgatcgtgcaccccccagccggcgggatggccagcggctcaagtcaaccatgggcagcagcttcagctaccccgatgttaagctcaaaggcatccctgtgtatccctacccgagggccacctccccagcccctgatgcggactcctgctgcaaggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggc

SEQ ID NO: 174754 - DNA, 970 bp, Homo sapiens
gcggagcagtgtctgtactgggcttgcctccccagagaactccctcagaaaacctagtgtaagacaagaagttttgttgctttaggatggccaagggccacaagctgcctggtgatcagcatgacctggagggattgagtaccatgtggcatcctgaggggctcctgtcaccatcctggctctggcctaggcaagaggtactggccgatgcatacaccttccctgtcctgttgactgtcactgatttctcctccccattgcccaagacacaatgagccctgtagctctggtgcaaggccatgacctcagagggctgtggggtgatttgtgaaagttgaatctctcatggattgggctgctgagaggcgctcgttaattacttggtagtggcaggtgaaaacagggcaggtgttggatatccaaagatagacaccaggatctctggactctttctttttgcttcatgtgggaatcaaaaggagcaaggctgttgttcagcccctgaagctcagaaagctggctgactgacctacactgccctcagcccaagggccatttcaagcctatgcttttgctcagggctttcagcaaaatctgggttccactgctctgctccaagaagtccagtatagtcaccccccatattctgggcaccccatgtattccattagagcctctgaaaattaatggaccaactgggcgcagtggctcacgcctgtagtcccagcactttgggaggctgaggtgggtggatcacttgaggtcaggagttcgagactagcctggcaacatggtaaaaccctatatctaataaaaatacaaaaaattagccgggtgtggtggtgggcacctgtgatcccagtactcgggaggctgaagcaggagaatctcttgaaggcggaggttgcagtgagccaagatcacaccactgcactccagcctgggcaacaagagcgaaactccatcacac

SEQ ID NO: 174755 - DNA, 923 bp, Homo sapiens
  misc_feature (6)..(6): n is a, c, g, or t
agcggnggcggggcggagcttccgcctgggctggggttggcgagttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggaaacttttcagtacacacttttcagatgggctgaagagcttgatgctctcagtcggatacaagacttacttggttgctatgagcaggccttggaactgtttcctgatgatgaagtgatttgcaatagtatgggggagcatctcttcagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgttttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaag

SEQ ID NO: 174756 - DNA, 198 bp, Homo sapiens
ctacctcagcctcatgagtagctgggattacaggtgcaagctgccacacctggcttattttcattgaactttcagtgttgttattgaagagtcctggaattttaatttctgttgtgtattagttatcaattgttgcataataagttataaagcttagtggcttaaaacaacaaatatttatctcatagtttttatggg

SEQ ID NO: 174757 - DNA, 240 bp, Homo sapiens
attgctttgttctagcgattttgctcataaaaacctcatcctaatggagaaaaagatgctgaagctcctcaggcctggcatttgaaattaccacattaagctcccctccttcggctccagcctcactcttgtatggctctcctacatccatgtgtgctctgctccgattaacctcgctttctctctgacaccagggcacatcatgtgctattctattaatattccaacaggcacatcatt

SEQ ID NO: 174758 - DNA, 143 bp, Homo sapiens
aagtatttgtgggtacttgtgaaaggttgcagttttgtaacacaagctgctttattttcccaaaagctttcacaatacatagaaaatatattggacgtgtattaaatgtgccaaattagtcagcaatattacattaaaatatg

SEQ ID NO: 174759 - DNA, 468 bp, Homo sapiens
ctgaatgttttggttgttttccatttttttttttattgtggttgtcctttttttcttttagttagaaatatactgtgcccatcttttctaggaaatagaaaacggtcaagttaagtgtatatttttttcaaactaaacctggctccgagctttgcactgggcattggagaggccttcaatggctcttccccggtctggcacttcctcttcttccctgaccctcgagtcatgggcagcagtggaggggcatgaaccctccttctgcagcatctgccccatctcctcctgggccgagtcatgccttgggagagacagcaaaaccctgaacagcagttcaaggtcttctcagccttggggtgatgcctccagtgccactccctgaacttgatcccactgccagggctgcctgcattcgcccactccctcagcaggggtttttagagcatgagtttgagctaggttttctgc

SEQ ID NO: 174760 - DNA, 583 bp, Homo sapiens
ctcctcttttgacccagtgggccggtgggagccaatgtctggcttctctcacagtaggagtggttggttactgtgagtggccctttctggagagcctctggctatggttgtgagatgcatggcaataatgagctatctgactcctctgacttgggagttggtttgcagaaagctccccaggcccaccttcacttgttgattcaggttgttttgtggtatgtcacgttgtcgttgccttggggatgaggccaggggcttggcagatggtagaaacagcagagatggcatgctccatgctcccatcacagacctcccttcccggcatggctctctggacccaggcaggaagctgctgattggtggaggactccagtgtgggccgggcaaggcagagcagccagggttgtctcttggcccagcttgtctggggcctagggtggggacacccagccgactgagtagtacagagttgctttcaatctctgtgcttgggctgcttggccctgaaaaggttttggcagaaggaaggcggtaaggacagggctatgtttgcagcattaggaaaaggattggcttctgtctg

SEQ ID NO: 174761 - DNA, 289 bp, Homo sapiens
gcagctcttgggagagcctggccaaggtatctagtgatatccaggtgacatcttgtctacagatgatggaagacaggggtgtaggaattttttgttccctggaatatttgatttcttgaggatttggaggtgacagttctaacgtcatgagagcatcacagcaaaccatctgggtggagaccatgggtaatgtacctggcactcattatcatggtcctctcattcacagcacacatacctttaagacaatcctcacacaccaatatatcctgctcgtagccttttgaaa

SEQ ID NO: 174762 - DNA, 515 bp, Homo sapiens
cattcttagggaaatccaaagacaagaaaaggacaaaaacaagaggaataggtgaatttgaaccctctggcacctacagctacagcaaatattaagagcctaataacagccatattaatataaaacctcacaggtaaggcctgtttcctttaattcttattatctgatacactatatttggttttcagcaaaaaattagaaggcatggtaaaaggcaaggaaaaaagtctgaggagacagagcaagcaacagaaccagactgagacacagcagagaatttggaaggactaaatggggtatttaaaaccactgtgatgaatatgctaagggctgcaatgggaaaaatggacaaatatgcaagaacagatgggtggtataagcagagatggaacgtctgagaaaaaatcaaagaaaatgctagaaatcaaaaacactgtaacagaaatgaaaattgcctttgatgggctcataagtagaccagacacagctgaggaaagaaacagtgagcttgaaga

SEQ ID NO: 174763 - DNA, 500 bp, Homo sapiens
atgtgattgttcatgaatgtgggcaatggggcctagaaaaagccatcagcattaatgagggttgagaaagaaggtcttctcttccttttagccagtccttcctttttgcccctcttcatgctctagcctctttccccttttcatttgttcattaagcctgtaattacctaaaaagaaataagaaaaaaaaggaaggacaagatgtgtacgtatatgctcatagttggatagaacaaccatttcattatttctattggctagagtattattttctcaccttattaagtgatcaatccttctgtagacatttatgagaacaccatggtttctgataaatacatgttttgagtgaattccctctaagtaaatatggaaaaggcagggattctttatgtgtttccagtcatggcttgaaaactcagccttttggctttaaacaccagaataatggctcagagccataagtgcccttcccaaagtccagcaacaatcacatcatg

SEQ ID NO: 174764 - DNA, 460 bp, Homo sapiens
atgagaaaggatagataacttgactaagtataatggagaggaatgggtgcctggtgcctgttttacattcagactcttaattttttgagtctctatatttacttaaagatgcccattcatatctgtgtgcacatgtacgctcccacatgtgtgtaaaaaacagaacattcatgtgacaatggcattcttgtgtaatgaaacgtgtatatgtatattaatttatatgttaaacatatttgtagatatacatatataaacacacaaatgaaatgaaggtgaacattttggccagtaaaataatgaaatgctatgaaatttcactatgttgtttacagcattttcatacattcgtgttctgtactgagacttggagccgagctgatttgcttgtacacctgaaatgtttggaggcccttcagcagattgcagatttttataaataatggcctttcgttggcca

SEQ ID NO: 174765 - DNA, 169 bp, Homo sapiens
tgttcaactgctctgtactcaataagtgatcaccaacagtgaacccaacaccgtaccagcataggaagcaacatgtaaccaacatggtacccaccctcagtgagattaccatttagggtggagacaaggagcatgttaacaggacaccatggagctattaagataaagg

SEQ ID NO: 174766 - DNA, 243 bp, Homo sapiens
tgaaataaacagtgtttctgatggttcagagaaccatcagaagcaaaggtgtcacgtgtggaattttccatttgaggtgtcatgttggcactcaaaaagtttcagattttggagggttttgaattttcagattagggatggtcaacctgtaatatatttgtgtttattttaacaaaagtatatctgattttactataatccttgattaaattgatactccaaaaaagttgctcctgcatatat

SEQ ID NO: 174767 - DNA, 258 bp, Homo sapiens
gcgctgtagtcaactcgtccccacatcccaattacctggcaaccactgatttattttatgtcttacagatttttctttcccagaatgtcatacaaatgcaatcatatagtatgtagccttttgaatatgtcttctttcacttaatacaatgcatttgagattcacccatgttgttatgtgtatcagtagttactttttactgctggttattagtctatcagatgaatatgtacattttgttaatctttttgcaatttg

SEQ ID NO: 174768 - DNA, 310 bp, Homo sapiens
ttgccacatctatatcaagaactgcttaaacaaaaaataaaatcaacgacaaaactctcagacgggtgaccaccccggtcccagagcttactaccgcaacaggaccaaacatgcatacactctctttctaaagcagagtgtccactttcctaaggaaaaagtaatttttataccatgtatcccaatgccgcattcttagcaagatgacaggcctttgggtacacgaagaagggacatatcacagatacccttaagacacatcacatgaggccgggcgcggtggctcacacctgtaatcccagtactttgg

SEQ ID NO: 174769 - DNA, 283 bp, Homo sapiens
agaaaagtaaaataaaaccaaagcaaatagaataaaggaaataataaagaacaaattaatgaaattggaaacagaaaaacattaaagaaaatcaataaaacccaaggctgctacttttgaaaagccagcctaaccaaaaaataagacacaaattaccagtgtcaggaatggagcactgtaaggaactcaattgacataaattttgcagtgtaaatgaaatggaccattttttttttgagagccacaaactactaaaaattatttaaaaagaaattaaagaatg

SEQ ID NO: 174770 - DNA, 171 bp, Homo sapiens
tcataatgccaaccccacaggctcattagggggattcgaaagcccctttcccagtgccctgaacatacagaaactcagcaaacaaatggttctccgcttatctcctccctttccccttctcacacccacactcaccctcacaatgcctaccttttcttggttcttgaacag

SEQ ID NO: 174771 - DNA, 153 bp, Homo sapiens
cctccttgttaacataaaccctcataacacactcagagtacaacacagaaacacctctttccccctccaagttgtcagagatgttcttagccaagtctgttagtgactcagaggggtcatttggaaatttaaaagccattaatgaacatgctt

SEQ ID NO: 174772 - DNA, 320 bp, Homo sapiens
ccatctctggaaggcttagtttgcagtctcaacagcggggtagactcccaggaagagagagacagatttgagcctagttgatgatatataaaatacaatgaattagtctctgtgtccatcacgttctggctccggagaaataagagaattgctaatgagttggtgccattctgtgtactttctatatcttgaactcttaagagatcttgtccctgggtcttctgctaaggatttaccacctgactctagtatagtatcacattacagataaaggaaatcaaaatatcttaccccccctaagttcagagccagggggtacc

SEQ ID NO: 174773 - DNA, 505 bp, Homo sapiens
ccatctctggaaggcttagtttgcagtctcaacagcggggtagactcccaggaagagagagacagatttgagcctagttgatgatatataaaatacaatgaattagtctctgtgtccatcacgttctggctccggagaaataagagaattgctaatgagttggtgccattctgtgtactttctatatcttgaactcttaagagatcttgtccctgggtcttctgctaaggatttaccacctgactctagtatagtatcacattacagataaaggaaatcaaaatatcttacccccaaataacattctttttgccataaatagccctgcaaagcgcactttgtgaagagaaaacttgcatctgtaaaacatttctatttacataagtagattttttccccttccaggttctcccaatcctgaagagattaactcagagtctagcaacttttaaaggtctaaataagaaacacttgccaccaggcagtggctcactcttgtaatccc

SEQ ID NO: 174774 - DNA, 362 bp, Homo sapiens
aggcaaggacggaggcatacaaggcactacttgagatcctgtctgatttagaattttgtaggacggattcctgttgttgaacacactgagtgatgagaaacttggcaaatcttgttggcaaatctctcaccttgattccctttggcatcctttgtgtctgtctgatccttccagcctggcctttggatagcaggtacccacttcttaggatgtgccagacaccacgataaggaagtaccgaggcttacagaggtgaagttgcttgtgtcagggcacccagctgttgagtgacaaagccagatcctctgaggtggggcactgagcagaggcccgaatggcaagatggtgccagtacatgaaga

SEQ ID NO: 174775 - DNA, 356 bp, Homo sapiens
tacaaaaacataaaaaattagctgggtatgatggtatgcacctgtagtcccagctacttgggaggctgaggtggtgggaggatcacctgagcctggggaagtcaaggctgtagtgagctgtaatcatgccactgtactccagccaggcaacagagtgagactctgtctcaaaaaaaaaaaaaatcataaaatcataaaaaagtcataattaggaaacccacaagattttaaaagaattataccaacttgtatggtaagagacagaaatagcacaaaatgatatatgtactttatactccaaattttgaggggcaggaaaaggctaagaaatctactcagctgcaatcacaggcttt

SEQ ID NO: 174776 - DNA, 801 bp, Homo sapiens
  misc_feature (1)..(1): n is a, c, g, or t
naagatacaggaactataggcaatgccacaccaactctgtgccacttatctccagaattcctgtacagaaaagaaaagtacacttttatcttgtttaagccactatgatttctgggctctgttactacctcccaaatcattgggatgagaagcatgaaccactgtgcctggttaattacatagatatttacatatctactatcttaaaacggtgtccttttaagaatttcaaatgatgctttatagtttctaatatggtgcactgggtatactgttgatatttaaagttttgtgaatgataaatttccctacttcagtagtgccatagaattaattgattcttgtatctgaaatttaatgagtgcttatgaagtatgctggactgtgctaggttctgacagcatttgaaaagaagtttgacatctgcctgtctgtccccttttggctgcctatgaggtgtgtaagatggctgcaatttgaggaggcatcctttgttcctgaggatagaaggtgcattgtggagtagaaagatacaggaactataggcgatgccacaccaactctgtgccacttatctccagaattcctgtacagaaaagaaaagtacacttttatcttgtttaagccactatgatttctgggctctgttactagctgccaaatgcaaatcttaacagatacagaagtccttgaggatttttgagcaaggaactgactgtaaaactggtggctctgcaagggacagatttggggaggggggtgttctggagaatcctaagagataaagttggcttggtaggt

SEQ ID NO: 174777 - DNA, 152 bp, Homo sapiens
gcaaatttgggcaatgaacatatttctcatgagctcctagtaataaatcttaaattaaactaatcacataagtaaagggagaacctagtagctgaagtacagaaacatacaaaatttctccccacagactacaaagttttcaatagaggtaa

SEQ ID NO: 174778 - DNA, 816 bp, Homo sapiens
ctatgggcacccaccactacacccagctaattttttgtatttttagtagagatggggtttcactgtgttagccaggatggtcttgatctcctgaccttgtgatctgcctgctccacctcccaaagtgttttatttattttaaaggcatgtatcactctctgaaaattagcttctttcttctttttccttgttatcatccatttccccgaaccagaatagaagttcctgaggccagaacttctgtctctctgcccctcactatgtgtctctggcacataccccagtgcctgcctgctctaaagtaaaatcttagtaaatattactgttgactaaataaatgaataaatcccttttaatgccctttggaagttgcaagtaaagaataggatccctttttaagattacacttttggctattgatctgtgtgtctggaacaagatacagtttgaagatactaccatgggacatgacatcagttgagctgattaaggttttagtaataattacaggcgtgagcacggacgcagcagcaagtggttttaaatgttcatatagaaaacagtgaaggattagggtgaaaatatatgagcaggtgactttgaggtttactgaaatagccaattgtgatggtgttagactatggtgcagtaaaactaaaaaggtagtggcagaatggttcctgctagcaggaaagcttcatcttcattgagtaccaagacaggttcaggggtcctttgagggtcgcaggttggaatttcagttctcagagaagagctcttgtggcgggtgttggcaataaatgattttatgccaag

SEQ ID NO: 174779 - DNA, 543 bp, Homo sapiens
tatcagttatattcaggggctatatgaatattatttttcatataatgtggagaaagtgtactgctatgacaagagggtaacatgggctcctttctgacatacagataatgaggccatatctgttgatttgcctggaatattccttagctcagtattttaaaagccttattatctctgttattaaagtagagggaacccacgcctaagagcaattctttctgctgttggccatactaaagtaaatagaaatataatgagaccattatggtcattaatttgctgccaatctaagtagtggttatttttggatagagagagggttaaaatcatatttggtggacacaaatgatttaattttaatattacccactttataaggttcataatttccatcccagatagagaaaattgtatttatttttttatccacagtttctagtacattcctgggtatagcagttgttcagtatatatttggtataagaaaaactaaagattaaaaacatgtaagtagtacagtgccaaacaacccctgatactcta

SEQ ID NO: 174780 - DNA, 332 bp, Homo sapiens
aaaaggctgcatgacccataggctctcctcctccctcctgtggggcatgtgggacgtgtgggctgggacgtgtggtttaaaggtctggaagttaaaggtctccctccctggcgagccagctctttgttccacatcctcaaggaccctgacttcagcctattgttccccctgctgacacagaggctccaagttcctctctggatttgctctaggggggtggggggtcctggtgttggccgtggaggctggggatttgtgcatacctgcttattaaaagtcactcactcattcagagaaaaatgctgttttgagacaccctcttgcatgtggga

SEQ ID NO: 174781 - DNA, 262 bp, Homo sapiens
aaagaaaaggcaaatatttaacgatgtgatggatatcccaatacactgatttctttacaaattatgaacatgttaaattatcacatgcacccccaaaatatatatgtctgttacgtatcaataaaaaattttaaaaatctaagaatttactttgaagatataactattaaaatatatttgaaaatacatatgcacaagataacctgctgcaacatttttataattgcaaaatactggaaatagtctgacttagaaacctaca

SEQ ID NO: 174782 - DNA, 407 bp, Homo sapiens
tacgagaatcagtgtcttgtaggacgtaagagcaaaaattcaataagacctcaaagaagactggaacaggctactaaaaagctatcagaaaccaagctgtgccttctctctacctcttgcctctgcttttctctgcatgtctgcatcattccctcccattagtctggcagaataatatatgtggcagaaacacataggtttggggttgacatattacaagttcagtcagtcagagagaatgaatctctccttctcttggggagacataatctctgatgtagccagacaacattttgtggatatttacctatggtcatgggagcagaatcacatagcagaaatgtgatgactgaaaatcccatcctgtgctaggttgagcagatgcccaatagcaaccgttaatagta

SEQ ID NO: 174783 - DNA, 350 bp, Homo sapiens
gtgtgataatagctcactgcagcctcagtaattgtagcttcaatctcttgggctcaaacgatcctcctgcctcagcctctggagtggctgggactacagatatgcacttccacacctggctaatttttttcctttttagtagagacaaggtcttgccatgttgcccaggctggtcttgaactcctgagctcaggagctccttggcctccccagttcctgggattaaggcatggggcactgtgcctggccaattttccgtatgttagtttaactgtaaagaatagtcttttaaatcaatgtgaatagaaaagtgtcaaataaactgatagtgtacagttgtaattagaaag

SEQ ID NO: 174784 - DNA, 198 bp, Homo sapiens
cagagtgagactccgtctcacaaaaaaaagaaaaatggtgttcacatttaccagtgtaacaaccctgcacatcctgaacatgtatccctgaactaaaaataaaagaaaaattgtgctcaaaaaaggggtggaggggggttgtgtgtggaagagtaacccaagaatcagaggtcatttacaacattatttcatcctagg

SEQ ID NO: 174785 - DNA, 388 bp, Homo sapiens
aattaagggacaagatgaatcattttggtagagaactggaaactataaaaacaatcaaatggaagttatagaactgaagcatgtgatcatcgaaattaaaagctcaatggacagatttaagaacatatagatcagaaaagagaatggctaaattttaatacagggttaaaaaagtccagacttaaatatatagagaaaaagatggaagatactgaaaagagcataaggcatacatggaaatacagagacaaggctcactgagacaagacacacacacacacacacacacacacacacaaagacacatgcaaaggcacacacatatatgtagtcccagaaggagagagaagatggaatggcatagaaacagtatttaaagggattatgg

SEQ ID NO: 174786 - DNA, 328 bp, Homo sapiens
agggcttggctgcctgcccatgggctagtatgtccatcactcagtcctagtaggtgcacagagatagagttttatcaaaatcactagcctcagaatcacaactccgttgaatcctgctcagggctgcacagagagtagtgtggcgtctggaggcccatgggcttcagttagctggtacagaagctcggcaggcctggtgggggttccgccatgcttgttccaggaccacagatggacctgcctcccagactcgctttctgacctccactggctctagacacgggccgtcttgacccagcattctgcttttgaccattcaaacttaaca

SEQ ID NO: 174787 - DNA, 380 bp, Homo sapiens
cggagatgcgggactgggacagaagaagtgaggctccggtggggcaatcttcaaggatcctcaggtcacacatgctcttgagcttccaaagtaaacctccctggtagtttaccagataggtcttttgtttgagttaaagatagccaaactcaaatagcagcaccatgtaaaataagccatgttcttggatttgttataaaagtatgttgaaaggaggaactcctggatgagaagaaaatatgctggatgtcaagagcctaaaagaggtgctggaaaggaagtatccagtgtggtccaatggagagagtgacctgagaatgagagcacagttcctgtttggtgggcagacaacagtgatcccataggcctcctaagcccga

SEQ ID NO: 174788 - DNA, 511 bp, Homo sapiens
tcattccccatgtgtactgctactgtttagccctgctcctaagccatattattcttaactaaaatacactttaaaataacgtggtcagcagggtttaacatttttacttccagcctcaactgttgtagcccatgtccagaatagtatttgttagatctcagatccatagggcaaaattgcagaaatattactaaaagtgagtatttgatataaaatattgtttctgaaaacgcatgttttaaaatattgatgagatgtcagtattgcaataggatagggaatgcattgttaaaaggatgcagtgtgacagtgtacaagaagctcagaatgtgaagtgaaatggtctagattagtcgttctctcccactaagttcctggaccagaagtatcagcaccacttggaaacttgtgaaaaattcagtcttgcgccttaccccaaactaactgaatcagagagtctaggggtgggatccagcaatctgtctgttaccaagtctctggccgactccta

SEQ ID NO: 174789 - DNA, 297 bp, Homo sapiens
tcagatagattttatgtaaaggataagttaacctaaggtaaagactatcagaattactaattattaaattcctaaggatataaaccaaatgacaacctgctattagataaaaacaaacataatgattttggtaaagagttactgaagatgcttctagtaggaaatatatacaatttctaactgaatgtcctattaccaacaattcctcctctgggcttggatagatttctgggcactggctttctcagtcataaaagtaaggagctaggtaaaatggcctcaagagtgcctagagct

SEQ ID NO: 174790 - DNA, 418 bp, Homo sapiens
ctgcttggtttattatactaactctaaaacctttagatatttacaccattattattaaattacctctgtacacataccacgtatcaataaaaacaattcttcacatttcttgaaagattgaaagtatcacactgcacatcttaatagatatgaacattcaagtgaaattgagattttcagaaagattgcgaaaaacagtacacacccacaatgttattctcaagatactgaaaatggtgctcactgacgttacaaaacctattactttttaaaaactcaccatgtctgatttttgtatcacagtatgtaaaacgtacagataaaaatatgacttgtgactctgccaataaacatgatctcttttaacattcatactgtgtctataatttttgttatttgacctagcaaacctaacctc

SEQ ID NO: 174791 - DNA, 575 bp, Homo sapiens
aatagagggaccttgtaggaggaagggaactgcattggtcaaagatgacagtggcctgagcagcttattgggtccctgagaccccagcctccccactctgataaaaggcttagttaatgtcatcaacaggacagagatagttgtatatgagggagctggtcagaaaggagaaagtgatgtaggggctaatggagaggggaagaaaatcatttccatccacttaaaagcttctttgctaatattccttcctgtttctccagtccataggttacccaacttccttttaaacccacactattgagccacctacctctccttccaggcttacagaacgttctagagttttcagcctcagatccacaccataggaagtgcttctgtagcatctgttccagtatcccaggtactgaaaggtcatccaggccaacctgatggtcctattaaagagaaaactaggactcagaaaaggaatgtgacttaaccaaggtcacacagtgagtcattaacacagctagggtagaaacctagatctgactcccagcttagtgctcttttcaggtcacccctcacaacca

SEQ ID NO: 174792 - DNA, 304 bp, Homo sapiens
ttcttgtgctgataatgatggtaatggtggaaatggtgatgatgatggtgttgatgatggtgatgataatgatggtattggtggaaatggtggttcttgtgctggatgcccctcccccggaagttcgataggcttaagcagattctagccgaagaatctgcgcattctggggttgggacgctaggccccggtggcatgggtttgcgagtgggatcttccgatcattgggttgcacagttccgtgggaaaagcacagttttcccagctgggtagcgcgctcactcactgcctcccttggctggcg

SEQ ID NO: 174793 - DNA, 408 bp, Homo sapiens
atacatagtagaacccacatacattttatgacttatgttaaacactactatttattactataaaacaattcaccacaacatagcaatgcaaaccaagcttactgaaaatactaaatgtggttattctaaattacagctcttttgcaaaatttaacttaattttgcaaaaatcaggcattcatgctgtttactcatatataaatcaccatatttcctctccagtaatgtggatactaactttgtcacttgtgttttctgcaaagagaaaagtattttaaaatattactaccacatcatttttttttaatcttccaaggccaggttcttcaaagtatcacacaggagctgttagaagaaatttcagtccaacaaaattaaaattattataagatactaaaagacttacct

SEQ ID NO: 174794 - DNA, 659 bp, Homo sapiens
ggccagctttctcatttctcccacaatgcagtttttataattggcaagccttgtttttacgttccaagcctggagtctttttccacaacattatagaagaccttgggcattctgagaactaagtagcttgctcttggcattgtctttgattgggccaggctttcaatgaaggaaaacacatcaggaagaaagttgctcccagggttgctgactgatcgcagagatttttttttttctttaccacttttctttgtgtttggccaggtatagagtgagggtggggggtggggaggcctctcctagcagactgagcttttctgcaccttaggctaaggctgagtggggccagtcctctcctggccatctctgagacttgactccccactacagaggagtacaggggcactgggcatttcttccttgtgagaaattttcagctcccgtcagaatgaccttccaccaaaccctttgcttcttcccgtcataaagttggaagaagaaaaaagaaaagcggttcgtggtatgtgggcaggtaaaatgttaacaactttgctataatccatgttcagttcagtagacttggaacagcatgaatttcgcaaagtgaaaaactctggcttcctctgtagacgcattgctctgcaatctgaaaactagca

SEQ ID NO: 174795 - DNA, 683 bp, Homo sapiens
tattttttagtggagacagggtttcaccatgttggccaggctagtgtcgagctcctggcctaagatgatctgcccacctcggcctcccaaaatgctgggattacaagtgtgagccaccaagcgcccagctatagtggtttttgtattcatttctgccaatataacttagtttcttacctcttaggtatattattgtcatagcctgatagccagttttcctgtctctagcctttagctcttatagtctgtcagcttagagtattcatcctacatttatcacttacattttgtcatgctaaattcagacttgaaaccctttggttttccccactatctacaaggaaaagctcagactctcttgtctcatttaaaggccctctgtgatctgactgctctccatctttccaattcattttctggtttcctgcatgagcccttatgttcaagctatgccccttgaacaattgcttcttatgttctaccctgttttatccattttgaatggcttcttcatctctgtccttgaggggcccaagttagtgcccaagttagtgactgttgtgacactcactgttgaccgctacatgcagaagcttttctctcctattttcctctcttacctatatatgggcattctacttagtattctccatgatgccagttgcctttccatcatgatttcc

SEQ ID NO: 174796 - DNA, 219 bp, Homo sapiens
ggcctcactgggtaagcctaatgtcattcctgcatttatttaatgactcaggaagtcagtcttttttttctttttttaaattgaggtaacacaggacacaaaagtcaccatttaaactattttaaagtgtccaatttggtggcttttcgtaggttcacagtgtagtacagccatcaccactgcactccagtctgggtgacaagagagagaccccatctc

SEQ ID NO: 174797 - DNA, 440 bp, Homo sapiens
gcaattgagaacaagtgttcaataattccaaagtttgtacttccaaatttgtaaatctatacatctgtattattctgtatgtttactctagcctgtgacatagagccagagtgaagattgctaaggtgccagtcctgctcaaatttcaattagcagcaagtcctaaggtactcagggtcttagaacccgttggtttgttttggagagagaccacgtacaaacttagaagagcggctttcacttctctgtttcctatcagcaatccctcagctattcactcaagagatctctaaggtcagtttctggcaggaacatcccttcacactcctccaacaatcagtcattcacaagtggccattattttaatatgagcacatatacctatgcgccaagatgattacagtctgcaagcatagccatgttttcctatttcctttgta

SEQ ID NO: 174798 - DNA, 190 bp, Homo sapiens
ctcatctttactcatctttagccttagccgagatgtctcaccccactctctatgatgcaacaagaagcccctggggaacgtttcagtcccagtctgtactattgtcatgtgctcatcacagtctggatgtctttttgtcacttccagctggatctaccatgaaagacgtcagagtccaggaagagagact

SEQ ID NO: 174799 - DNA, 1398 bp, Homo sapiens
cgggtaggactcttgggccctgccccacctgccccttccagtctccgcccaggtcaggacggcaggtggccccagcagggctggcctgagatggaggaacgcggccccgacccgggctatggggagactctggatgtggcggtggatccgctgacggggctttgggatgtgattatttcctgggggctgacggtagcccaggagcaccaagacccagctctgccttccgcctcccacggggcctctcctctgcaggaggccatacaaggactgcacggaaggggagcggccccgcagggagggggcgcctggcagcccgcccgccgcagcagcctgcaaccccgcccccaggcgcagtgcgcgccacagcagccctgccagagcccgtgtgacacagctgccggcatgcccgggcacgctgcccagctgggctgggggaggggcgccgggccaggagccgctgaatcagctgcacccggacggccccgcctgggcaaggatgctggtgcggcggggcgctctctcttttgggaaccgtcaggaggcgcgccaggcggtggggtggggggtgtttctggactgcggcctctgcagcctgctgcatgggaagtgcggctcaccggggctgggtgcagggcagcccccgcctccgagggcatgagcggaggcctgcagggagggcctgggcagagaggggccctttccaaaggagacccataaggaagaagagaaacgcactggcctctgcagatcgaagcacgtttgtctcccccagaaaacgctgaatcagcactcacagcactgccagggcccgcgccctcctccgatcgcacgctggaggggacaggcccttccaagatcacggagcatcaatatcaccatcgacgcagcggcaccgggggagtcatgctctggtctggagtgggggccgcgcctggccctgccgtccttcctgctgggggctgtgtttggagccgggcaccttccccctcagcccctgctgtcctgtcctgccccctgcggaggggcgggaggtggaggacattcctgtgtgtgtgcgtttggggtggttttgcctgtggaggctgcacatgggggctctgacggggcagccttccgaggccaccctgtgctggggatgggacagcacgtggcccatcttgaccgagcatcttagatcttgaaatccccagcaccacccccttccagccactgcctgcctctgctggctcctcagcttggattccacttttcagcaacagagacccccggtctggtgcccaagctggtgtccccgtgtggtggacgacggggaaaggggggctctgggagccactcggcacaatccccctgggccaggcacagactgaaaatcagaccccactaagtcaacagccc

SEQ ID NO: 174800 - DNA, 457 bp, Homo sapiens
gttacccaggtggacatctttggggccacgtgttctgcccgctgccaatcgacggaatagaatcgagagtcaatgaagtaaactcaggcatggatggctcacacctgtaatcccaacactttgggaggctgaggcgggtggatcacttgaggtcaggaattccagaccagcctggccaacagggcgaaaccccgtctctactaaaaaataaaaataaataaaaaataaaattagctgggcgtggtggcacatgtctgtagtcccagctactctggagactgattattatggtatttagtcatctcctctatcattcgcaacaaggacccatcagctctttcatacaaaagccatgctggagaccctgagatgactcagacacaagtgccagcctaagggtggtgagggaaacacacacacacacacacacacacacacacacacacacacacgagcg

SEQ ID NO: 174801 - DNA, 135 bp, Homo sapiens
atagtacatgtttatcctccagtgtgccataccccatatagtgagatgagtcaataataaattatttcagcaaatgtttgagtacttactgtgtgccagacactgtttagtggtgagcaaaggtggaaataaata

SEQ ID NO: 174802 - DNA, 509 bp, Homo sapiens
gtaagtgtttgctcactttgcacttctctttatgcctttggtgatgtggctcagttgctgctttgaggtttcagatcacactttgttatgagtacaagtttaattccagctagtgttatgacagtgcagtctttggacacagtgggaactcagtgtgagaaccatattagtaacaaaggattgggcagatataaaaagtagttttgacagttaaatttagtggctgtattggaatttagtagtctctgaaaatactaccctcttttctctgaaacagaaaaatctgcttatttgattcgaggagatacacacttaaaacttagttttgaaaacgtgacacaaaatacattaatagaatgttacatacttaatttacttatagtaacaagtagataatgccttttaaaaatcataaagatttgtgttttaaaaaaaatttttaatctgataatatggaatatgtctattttctgatttgtgtaattcaaaatggaaaactgttgtttttt

SEQ ID NO: 174803 - DNA, 507 bp, Homo sapiens
tcttccccattggtaactatttttatcagttttcagtttatccttcagttttttaaaaataagaaaatatgtacaaatattcaaaatttccacataacaatatattctacaggtaattccatagtagtacctagagcttttttgtggaggtttttaaattttttattttatttattttgagacagggtctcactgtcacccaggctagagtgcagtggcacaatcatggcttactgcagcctccacctcctggggcttaagccaccctcttgcctcagcttcctgagtagctgggactacaggtatgtgccaccacacccggctaatttttgtagtttttggtaaagacaggttttcgccatgttgcccaggctactctcgaattcctgagctcaagggatctgcccacctcagctggccaaagtgctgggattacaagcatgaagaactgcgcccggcttttgtttcttagagagacatttgtatatactagcagaggtggacact

SEQ ID NO: 174804 - DNA, 563 bp, Homo sapiens
atcaaggcaaggcctaccagtatatgtcagtgcctggggcagtggcactcctagtgccgtattactcttagtatatgaggtatagatgcttgtaacatagcaggggagtcaagaatgggagcactggtgtgcagagagtcagagaagctttagggttgtggcagggtttagatcgctaaggcagctgagccagtgcccagagcctgggaatatgcaacacaagcgtggctctgggtctgtagtgtgaactaaatggctatggcaaaatctgtagcatcttggacatgggtggaccagttgcagccacagaacccagtctgaagcgtgggttctcatagattgtccatgcctctggggtcagagcatgaacagggttgggagagggcagctcctttcctaatgtggctcaagagtggccaattcttttggagtagcagaacaacatgtgtttgacacttttccttctctgtaatgaggtacatgatttaacacactgagtatctttaacatatatacacatttgtatatcaaccacagatctttgactttagtgtaacatggca

SEQ ID NO: 174805 - DNA, 422 bp, Homo sapiens
tcagtcccacagcgacccctggtggtcgcttcaagaagggcatcaaaatgctcccccaaagcacggaacaaacaaagccaagaaggggaagaagcccacagccccgaaagggtgggcaggagggaggctccctccagccagggaaggtggcccttcctcaggtactagagaaaatactacctgggacacctacagagacccagctaagagggtgactagctctgctgggcctggattcaagcctgagccccccgctcaccagctctgcagcctcagccagggcccttcacctccctgacctcagtgtctacttcagcagaacctgtgggtatatgcctacctcataaggttgtttggaagatcaaggagataatgctgaaaaaactgctgcacagcagtgacacgctataaagggctctcta

SEQ ID NO: 174806 - DNA, 105 bp, Homo sapiens
taaaggctgcggactgtgctactgccccttctgatgccccctcctctacacagcaatcattcagcgtcccttagtcactccggacagcgacaggccccgcggccg

SEQ ID NO: 174807 - DNA, 452 bp, Homo sapiens
gcagcatgatttcctatccttttctcctctttgcagctagcatatgtctaactatgaagtccaaggcaaaaatgaagaggtcagtagtggatattggatgggactgattcctaaataagagtatctttgatttctctttaagattatatggaaactgagcatgtgtgaggctgtgaggtctgaagctcaaaactaacactaattgtttaggggtaattctaacctactattttgtgcaaggtctctggagtctggctgcctgggttccaatctcagctccaccacttggtacctgtgggatcttgggcatgtcatgtaagcattctcttcctcagtgtcttcctttttaaaatagggtattggtaatatcgtcacagggattaaattagttgatactaaagttcttagaacagtgcttgacacagcataggcaccaagtgtttgttatggtt

SEQ ID NO: 174808 - DNA, 683 bp, Homo sapiens
ccatcctggctgaactttggataagatctacgtttgggattcttcttggtgatggatgatgcctagaccagccccagacaccctcccaagcctaagctcccctctcctgttctgacatccccatcccaccaggaacccaagcttgtggccatcgtgccaggaggacttcttccaggttttagtatagcctgagtgacctctaggagtccttggacctgagctaactcctgtacaattttggccggttgtctggttaataaattaacaattggtaatgataacagctagccaacattgttggttatatgccagccactaagtcctgcagccacatccaaacatcttcaccccacaggactagaggagtcactgaccctgactgctgggctcctccgatggtcatgggcaacaaccaaatgcaaagcttggtccctgatggacaccagtctgaagaaccttttctataagaatctcctcctgctctagactgtgcgcatcctaacggcagcagcctgcctgtcctgtgcgccactgtgttcccagagtcctcagcaggccctggcccacctaggtgctcactgaatgaacacacaagagaatgaatgtaaggccagctggtgggacagtgagcgtctgcctgcacaatgaggctgcccaggggaggaaggtaccccctacatgtg

SEQ ID NO: 174809 - DNA, 208 bp, Homo sapiens
ttttaagcaaacacacatcctctctgtggcaccatcactatccaagaaatagcagagtcaggcggggctagttggacgccctctgatctatttatttttcagcgtctgcttcataaacccttggacatccacctgaattttccttattgctgttaacctcatcttccaattacgcaaaatgtttcaaccaattagccccttgttgcag

SEQ ID NO: 174810 - DNA, 720 bp, Homo sapiens
aactcctgacctcaggtactccgcccacctcagcctcccaaagtgctgggattacaggtgtgagccaccacgcctggcctgtttgacctttataagatcaatttttttgttcacaagcatttctttactcatagataccatttttataacttatatgagacgcatttaatgtaatcatattactttcttatattagaagataggatttcttctgatgtatcgaagttactttatacttcatatgaagtcattaggaggtgaattattgccaattcaatgaattatttatgagtattaggggaatgtttttgttatgctgcttttaatttggaaagcagcatatcactcaaactatagtaattcacatttttccatttaactaaaaatgtctcgtaactactatgccacaagaacaagcatggatacttatttaaccagccaagactatgcatttctaaatatttatttttttcggttatccgtagacttttccttttgaaatccaacgatctgtatcaaccacgtcttcattttccttttcctgtttgtcttactctccccccaaaaagagtcagtttcctgttttctcaatttctcagtttaaaattagagccctatggcaggtgccatgtacagctgcaaaggtggcaagaagccctgagaaagctcaagaagcaggtcaagggggtgggtaaggaagatgggacgttcaagcagaaa

SEQ ID NO: 174811 - DNA, 461 bp, Homo sapiens
ttttaaatcactatttaaaattgtcatcattctcagataacataagcgtattgagattctatcagaaatatcaaatggcctcatggttaaggacccgaaaggtttttctctgagacaactttgtgcggtattttctgtgaatcccacagctggggaaaggaagggagtaagccgaagggttttcagatgtatgctagagtgtctttcatgaaataaaatgctgctctagttgtcagctgtttttttgcataccattgcttctttaagttatctttagattcccagtcttgaatttgaagagttttggggagaaggtagcagaaaacctaacgttttgtttacatttcatttgttgtatttagtagtagagctggtctaaagtaaatattaccttctcatttttgtgaaccttcattatttttacttggtaagttaaatgcaactgcgaaatcagtactcct

SEQ ID NO: 174812 - DNA, 981 bp, Homo sapiens
tgcctggctaattttgtaatttttttgtagagacagggtctcgctatgttgcccaggctggtctcaaactcctggactcaagcggccctcccgccttggcttcccaaagtgctggcccgtgagcctgtgagccactgcgcctggctaccttcttttgaattcccattcagactgtgtgttgctggtacatagaaaaacaatggatttctatgtatcaagtaaccttgtaaactctcatattaagtctaataattatgtttgggttctctttgtggattctttttgattttctgcgtacacaatcctatcatctgcaagtaatgaccattttgtttcttctattccagtctttttagctttgatttctttttttgagaggagactcgcttgaacccgggaggccgaggttgcggtgagccaagatcgagccattgcactccagcctgggcaacaaaagcgaaactctgtctcaaaaaaaaaaaaaaaaaaaaaaaaaaagacgccttgggggggcttccccggggttcccattttaaggttttggttgtttggccgggggagccttccggaaaaattggttttcttcggattttgagaaggccccccccctttcccaaggggtgcccttttgtggtggactttttttttaaaagggtctttttccgtgaagtgtgcaaacaaacaaagagccgacagactacacatactaacgactttaaccagacacataactagacgcagtatgaaaagattactacacataaaaaaaagagggggcgcggcgccatacaattatcatggcggggcagcatacacacacccattgttataagaagccccctagagtgattaaaacaagccggacgggtaaaccagggagggaaacacctgtttctggaaaccccctgtggtggagtgcccccagaatggccggataaatgtgttttaccgcctctcgaggttagtactcctgcatctcta

SEQ ID NO: 174813 - DNA, 1061 bp, Homo sapiens
tgcctggctaattttgtaatttttttgtagagacagggtctcgctatgttgcccaggctggtctcaaactcctggactcaagcggccctcccgccttggcttcccaaagtgctggcccgtgagcctgtgagccactgcgcctggctaccttcttttgaattcccattcagactgtgtgttgctggtacatagaaaaacaatggatttctatgtatcaagtaaccttgtaaactctcatattaagtctaataattatgtttgggttctctttgtggattctttttgattttctgcgtacacaatcctatcatctgcaagtaatgaccattttgtttcttctattccagtctttttagctttgatttctttttttgaggcagagtctggctctgtcacccaggctggagtatagtggcacaatcttggctcactgcaacctccgcctccctggttcaaaggagactcgcttgaacccgggaggccgaggttgcggtgagccaagatcgagccattgcactccagcctgggcaacaaaagcgaaactctgtctcaaaaaaaaaaaaaaaaaaaaaaaaaaagacgccttgggggggcttccccggggttcccattttaaggttttggttgtttggccgggggagccttccggaaaaattggttttcttcggattttgagaaggccccccccctttcccaaggggtgcccttttgtggtggactttttttttaaaagggtctttttccgtgaagtgtgcaaacaaacaaagagccgacagactacacatactaacgactttaaccagacacataactagacgcagtatgaaaagattactacacataaaaaaaagagggggcgcggcgccatacaattatcatggcggggcagcatacacacacccattgttataagaagccccctagagtgattaaaacaagccggacgggtaaaccagggagggaaacacctgtttctggaaaccccctgtggtggagtgcccccagaatggccggataaatgtgttttaccgcctctcgaggttagtactcctgcatctcta

SEQ ID NO: 174814 - DNA, 448 bp, Homo sapiens
cagactctgtggtcctgagcggcttgtgggacccgctgagggcgtcagagccaggaaggggagcagccctgggtgactcaggcaggcagcaagaggcacaacctgaacaaagaaacgcaactgatgcgtggctgacactgccagcttatggccatggtcccccaggatagcaccaaagccactttcctccaacacatccgtgaggaggatgccctgggcgctgtgggcctggccggctccctcatgccctgagcaaaggctgttctggaagaaaagcttccgcttgctgccctgctaggaaagtctctgtctccacaaagctcctgcagactcggagcaaagcatcaccaacactgtctgggttgacagcgacataggccggaagccctgcagagcaaaaacaagagaatttagcattctcaccatttccattttgtttataaaggca

SEQ ID NO: 174815 - DNA, 414 bp, Homo sapiens
agtgtagatacctcttttgagaagggtagaggtgaacaaagaaggtggtggtggctgaagaaggatgtggggtgacaggaggaattgtttttggacaggagatgtacaaatgtgttctcatgctggtggaaacagtgcagtagaaagggggaatcgggggttcaggacagcgatgcagaggccacgaagacaggaggggcgtggttcaggcaggggccccgtagaaaacagaggacatcttcaaacaggggaaatggaagacggttcaataaagggactctttaccaagccacaggcaggatgcagggacatcccaaggcagagaggagtaccccaggcctgaagtcttgagatcacagggtcatgagagcagattcaggaacctggacagaggtggtcactgccagccgtgat

SEQ ID NO: 174816 - DNA, 366 bp, Homo sapiens
gaagcagacatttccgcgagggtttgtaaatatcttcattgcttttgtctaattgcaaaaataatctgtcaccatgctcttttcaaaaatttccccaaataccgaaacatgtaatataagaagtgaagccttttctgccatcccagcccccgtagacacttcagaggctctttttctgtatgtgtttccatacctacggcactttggttagcagcgtgcatgcctacagaggtgaggattccgagctgtttagaagtgtggccacagagctgtggccacagctgggcttgagtcccatagggctgtttacctgctcagcctccccttctgtaaagtgtgggtgatagtagggcttgatcctgtggg

SEQ ID NO: 174817 - DNA, 487 bp, Homo sapiens
ggtcaagtaaagattacaaggctggaattccagcgaagctattttggcaaatactgacctacatgattgaaggggtccagaatatgccaccccaaaatatgccactttgacatacggcttattttgggctgcaagcgattgaaaatgagcagatgcaggatgaatcctctgctctctttttctacctgaaaccagggcgtaacattccctttgtggaaggtgttcctcgactcccatagcaggaagtgtagagcaactcttaccatcaaagatggacagtcagcattgagatgagtctgcataaacaaactttttttttttaaagtttgttccattaatctcccccatgtatttgctagtcactttcccacaatttatcatccctttcctttgttaaaatgatatatacgtccctgagcctaatcactttgcatttcactacttttctgtgaactcctatgcacgtaaaaatataaatacatttgta

SEQ ID NO: 174818 - DNA, 250 bp, Homo sapiens
ttcacttacagttttatctttgaggagctccaaagacctttttagttcttacaacaggaaaatcagggtttcgtgactagagtctaccaactaggataacaggacactgtggccgcagcgatggagccgggcgtcctaatccagctggaaacataggctctaggatggaggagaggctgtccacatggccctgcccctcctcatcccctacagccatggggatgtggccacagattgtcctggaggccat

SEQ ID NO: 174819 - DNA, 676 bp, Homo sapiens
ggcccgtcttagcctgccaaagtgctgggattacaggcatgagccaccgcacccggccgatagtgttagattttaacccatacggtaaaataaatatccatgagtccatactgacataaataattgaattaacaagccaggagaacggatagctcttttttgtagaagaactccagttacttaatgtataagaaaggaggtaactagaatatcaccaggaggcaaacagcacagtaattgttatagacaagatccactgatggatgtcagaattaatgggtaaaagtttgaggaaaaacacgatatttacgtagtcaacaggatatttgcgtagtctcaaagtatcttccccaatatatctattaattacaaaacaaaatgaaaagagtgtctttaccgtggaagccatgagaagcacattgtgtacagtatgaaaacgggaagaaggcagagcaccaccttcagcctcagctgggaaaatgcaggttgattgtcacaaaaaatactacaaaaagccttcgctgctctgcctgtgtctgtgaatgaccacgaaggtgctacgtgtgtttgattttggggttacaaataaattttagcaagtaggcacgtttacaaaaatggaataaataaatagtaatgatggactgaacttattatctcgccctttatagaaaag

SEQ ID NO: 174820 - DNA, 226 bp, Homo sapiens
acattatgtaaattatgtatgtacttttatgagaatcagtttttaaagatcacagtattcacacttccaattaaacagagtgactcactactgaatttatgaagaaacttgggtagtggtgagttgctttgtttacttgggataaatgtgaatgtactaataaccagaggtaaatcacaagaaattttccatatggtatggatatcaccattattaggtgaattaa

SEQ ID NO: 174821 - DNA, 371 bp, Homo sapiens
caaaatatttgccacttcttcaaagaaaaggtgataacataagtgcttaacaagtcactggtcaaaaataacactggccacccatcatggtccaaaagccagtgtccctgaagtgtgggaaaacacagtttcattatgagaaatagccctcatcactacttcatttattaagttattaaaccatttattcaactcaattgctacagggtatctacagccaaaggtaataaaacaaatatattaagcacacatttctcacagtattgaataaagatgtaacaattttaaatgtctatgaaaacctgtaggctggacgtggtggctcatgcctgtaattccagcactttgggaggtgggtggatcacccgcgg

SEQ ID NO: 174822 - DNA, 482 bp, Homo sapiens
gtgcaccttgggacaagtgtgtgcccttgacattacaagagcagtggtggggaaagctagctccctggcccccaggctgagaggaaaagaatcccggattaagccagaggctgagttctctgaaggtctggggcactgacaggggctactgggcagagggccagcttagaggagggtgtggtctgaaggtgtgggtagggcaaggcctgactccactcagtgatgggtccccagtgattttaagtgatttaagatgggtccccacttattcccaggaagccacccaagctcagaactgatctgggaactagggagtttctctttgtaaatttccttcacaattcccagctgcagcagctgaacctttgaagctaggcttgatatttgatttttgggaaacatcaaagatcactcccattcaagtgcaacaaaccagatagatggtcagtagtcacagaaagccttagctcatgttaaccaca

SEQ ID NO: 174823 - DNA, 391 bp, Homo sapiens
tgcattttctcccctcagcacagtctcatttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcccttcctggtaccttcttggccatgctgaccttcctcccgccctacccccggcaacccctagtccactctccctttgtataattgtgtcatttcaagaatgtcacgtaaatggaacgatacagtgtgca

SEQ ID NO: 174824 - DNA, 543 bp, Homo sapiens
agaggaatctagggggatgcgtggactgcagggaacaggttgcacctgagcggcatcctgagttgcgatgggttttggagggagggactgtgagttgagaagacacaggcgagcatcctcggctgcaagtgcagcacacccagggcagccctgggcttcagagagcgcacactgcctctgaggcgctgcccgtgctgtggtcctccggaagcacagatggagctagaaaaaagagctctaggtagccaggcgcagtggctcatgcctgtcttcccagcactttgggaggccgaggtgggagaatcgcttgaggccaggagttttgagaccagtttgggcaacatagcgtgaccccatctctataaaaaagccaggtgcagccaggcgcactgacccactcctgtaatcccagcactttgggaagctgaggctcgtttctcctcactgctttcctgtcttgagcacaggagttcgagaccagcctgggcaacacagtgagatcctgtctctatttaaaaatatacatatatatatttttaaaaa

SEQ ID NO: 174825 - DNA, 476 bp, Homo sapiens
atcactagacatcgtactacacgacacgttctacgttgtagcccacttccactatgttctatcaatagggctgaatttctggctcatagatggctccttctcactgtgtccttatatggtggaaagggtgaggatgtcccccgaccaatgttttaggagggcacttattccattcatgagcactccaccctcaagtcctcctcaccttccaaaggccccacctcctaatacgatcaccttgggggttaggatttcaacataagaattttgaaggggacgtagacactcagaccatagctcaaagcaatagtgactagcatgggttagcatcataaacataaaaaaacaagagagtgcagcaaacatctttccttaacttaggttcttccagatgccagtgggaaaagggtacagataacatccagcttcttgggattccttttaaaggaaatgtggaaatatggaagaaaaaaagc

SEQ ID NO: 174826 - DNA, 298 bp, Homo sapiens
agggaccacatagttctcacctgattctcttggaatcctgggctgtgtacctggaggtcacagtgtgaagaatcccaggctcatggagaggacattgctgtgctgtggctgcagcctcagctgaagtgtccctgacaaggaacattaactgctagacctgtgagcgcctcccagtgattctagccctcagaggccaagtcgcctccagccaccaaatcttcctgaggcctcagacgtcacagagcagtcaggtcatccctgccatgcccctcttcaatctcaacccatatagttcaca

SEQ ID NO: 174827 - DNA, 128 bp, Homo sapiens
ctgctttaagcatagagaacattaaggtttaagtgaggactgcatttgctctgaagaattgaatggcagaggagttggggtgtttttatgttagtccctttaaaaatgataagtgattgttccccgct

SEQ ID NO: 174828 - DNA, 387 bp, Homo sapiens
attattctagaacacagatatgattatattactttgttacttttatcctccatagcatcttcatagcaattctttatattaagtggtagtatttctgttttatagaggaggtaattgtcttcctgtggcagatagcctcaaggtgaaatgaacactttccttactcgttttaggctcagtaattacccttctaaagccctagacctgggaaagggacagtccagtgccttgggtccctatggacactgtaggtcttggttgttgacagttgcatgtgatgaggatgttcctctaggcaaaataatgataaaaaccacaatttatcgtgtttacatgtgctcaggcagaacatatattatttcatttaatttttccaacattcttgga

SEQ ID NO: 174829 - DNA, 256 bp, Homo sapiens
gcagctcggtaccggcactctagtccacaggtgggcttcacagaggggcttgcaaaagggtcagcttctggggtatgattctctggcccaggcagctgtatgcaggcaaggtgggaattttagtttctctgtctagaaggctgtggacaggttatagataggtcaaggctccaaagtcacagggagatcactttctgggcttatgactgaggtaggctctaccagatgttctcatacccaaggctgactagagtgg

SEQ ID NO: 174830 - DNA, 615 bp, Homo sapiens
gagttgataaaggtgaagatactatttgcagcagagagtagcaacactggatatcactatgaatgtagactgttcttcccaaaattcatttaaacgtgagattatgctattgattaataaactgcatgaatctgtgctgtccaatatacttgcgattagccacatgcagctactgagcacttgaaatgtggttagtccaaattgagagttgcatataggatacataccagattttgaaggcttagtgtagaaaaaagaatgaaatatatctcattaataattttatatttattatttttattattttttttgaggtggagtctcgctgttgcccaggctggagtgcagtggcacaatcttggctcactgcaacctctacctcctgggttcaggcaattttaatgcctcagcctcccagactgaggagtagctgggacaacaggcacgcaaaaccatgactggctaatattttttttgcatttttagcagagacagggttttaccgtgttggtcagactggtctcgaactcctgacctcaagtgatccacctgccttggcctcccaaagtgttgggattacaggcatgagctacctagtctggcctagtaatttta

SEQ ID NO: 174831 - DNA, 503 bp, Homo sapiens
aacgaatggattatctcatgtcctttgcttttatatgtgagcgaagatgaatgttctcttctgttttccatggcattgctgtgatggactatcatgtaacagaacatgctcgcttataaacagtgcttgtctccagtagagtgtggacgtttgctgccacatggattacctacttgtcgacgatcaagacttctgccacgaggataacaagcatttttttgtttcctcttagctctgacttctggcttaagaataacgcacattgtttgcctgtgtttgtggactttgtataaatccacttgctgctgtgataatgtcttgctgaatgccagcattataattttaaaggataaattaatctgtgggttttaaacgttttagttcagacctgttttgttttcacttaaggctctgtgagaaagagaatcaacctagctcctatgttatttcaactggaaaatcgtctctaaatcacaataaattatctttgttttaaaaatgtg

SEQ ID NO: 174832 - DNA, 452 bp, Homo sapiens
  misc_feature (266)..(266): n is a, c, g, or t
agttctgccacagtgggttcttctaaagccagctcccaggacaggggccattctttccttatgaatgaccaagaccatactggctatttcaaccgactagcgttttcttcctatttataatcaatagcatcattttcagcatcctggttcttcttttttatgtaaaataaaataaatagcgtccctcaaatcacactttttttaaaatcacaccttctttaaatctcatacaccatctatatgcaggactcagagatcatcccccnttagccccaggcagcttgactgtcatttggataaagctaggaaagaatgaaggatgtaattgggtgttagtaggtatgagagctctgaaggagaggtgcctgcaaagttccaggcaaagtcagcctccaggtaggcagccagagtccagggaacacatatttgctgaaggtttgtagaagtccatg

SEQ ID NO: 174833 - DNA, 176 bp, Homo sapiens
aagcatcatattaacttcggggatagagagagagacgagcaatcaaacactgtcatccttcagccattttggatgaatctctgagtcttggcaaaaatcttggagtgccgagcgtgcaacagagaaattagtcataaacagatgcaaacctcccgagcagagacatatttaactag

SEQ ID NO: 174834 - DNA, 823 bp, Homo sapiens
caggcacctgccaccaaacccggctaatttttttgtattttttagtagagatggggtttcactgtgttagccaggatggtctcgatctcctgacctcgtgatccgcccgccttggcctcccaaagtgctgggattacaggcttgagctaccgcactctatggttcttttacacaaaatatttggcacaaagtcagttataagacataagaaggagcaagcaaatgtcgctcttggccaagagaggaaatagtcaatagaagtagacacagagatggcccaattttggaattattaggcagggtttaaaattattatgctaagtacattccaggacttattggaaaaaatagataacatgcaggaatagatgggaaatttgagcaaagagatgggaactgtttttttttttaaataggggaaaggaaatatgtctcgggagtctggaaagtcaaagagatcagtaggcaaagaaaaacactgttgaatagagctgtgatttctgaacccagagcagtatctgcttactctctgccatgcttttttttatgccttattgtgtatgtgtggttcatagttgttaattataggcaaacaaataaaaagcaaagccaaaaaaaaacaaggaaaaatacaaggcctgcagtcactggctggagcaatcagtgacccaagaagctaggctcatagctaaatcctggatttacttccttttccttttctctagaaacaagtcttgtgatataggtacatttgtgatttggtacaatccatgcatcaggggatgttctctttgtcttttgtccttagctttgtttggagagg

SEQ ID NO: 174835 - DNA, 581 bp, Homo sapiens
tttttctgaatgaataattgattataaggtagtgaagagggaggttatatctgaggtccagttgacatgagggaaaggtcttaagacctttaagacatttaagaggaaaaatgagcccaaaatgcatgtgtttggaaggcccacagctgggcacagccatgcatgttcctcacgtccaccataggtttatgctgcctgaccccttgggtctttgctcatttcccttagtttccctagtccattccccatggggagctgggacccttctggatgacctcttctctgaggcgcccatctcgtgctcccagggagcactcccatctcctccctcccaggggaagtacacattgccttatctccatgtgtcttaggatccttcttgtccttacactggtgtcttcaaacgacatgtcctaaaagtaaatgtgggtaagttgaatgacctgagcatccattcctcagctattcaaaaagtaggggtagtgccacctatcttggcagtgtgttgagggtgcccagcacgtaccttgccatccctcgttctgtaggctctcacttccagttcctcagatgaggtacag

SEQ ID NO: 174836 - DNA, 332 bp, Homo sapiens
ctctccagtgtgggtagtcctcactcaatctattgaaggcctgaatagaacaaaaggctgaataagggagaagttcctccttctgcctttgagcaaggacattggtcttctattttcggactcagacttggactcagcaaatggtggactgagccaccattggctctcctagttctttaagcctttggacttggactggaactataccattagttctcctgggtttccagcctacagatcttgggacttctcagcctcaataatgtaaaccatttacttagaatcaatttctttcttttctttctttctttctctctcttttttctttcttt

SEQ ID NO: 174837 - DNA, 287 bp, Homo sapiens
tttgtattaataatgaaaatgaatactttcagtggttaaagtagttgcaagtgaataatactaatcaacagtctgttatatgacatcaaaatgatgaaaatataggcaatatataggtgtttgggaattgaacctgtgtatggatttccaaatggtaaattccaacaatttaataaaaattctctttgttaatttctactttttgtcttaaaattgtctacctaaatataaagttattatctaaatacagatacctaatgtagccaagatgatcaatctaaaatgat

SEQ ID NO: 174838 - DNA, 443 bp, Homo sapiens
cccaacctcgacacagatacacctgcattccccgctgccaccagcagctgtcatctcaggtcctggcattcctgggccaactaagactgccagcttcccagatcacctcatctcacccacatctgcacaacactgtacaacattcctttctccagctcccactcctcaagtgttccactgggacacaaatcatacattacaaagaacaacatgtgtgcagctacaggagcactaaaagtgtggcaaagtccccattaagctactcctcttcctagctcacacttccatttctcagttttgagacccaattccatgggaactgcagatgtaccaggtaacccaagtgtgtcctcgcaggccccccacaccacctcctcagagcagctctctccaccccaacccagccccaaccaggtgccgatgaatagcgagggtaccgagct

SEQ ID NO: 174839 - DNA, 200 bp, Homo sapiens
tatgacggtttaaagaatagaagaaaatgtgttgtagtttttgggaggaaagagatccaaaggaatgttctcatagcactgaagagactttgtaggcatcagaggaaaagctcttcctttaaggtggaagaaaagaaagagggttgataaaaacgtagtagaaatgtgaaatggtaaaatggttgattggacaagtggag

SEQ ID NO: 174840 - DNA, 300 bp, Homo sapiens
gtggtggcacgtgccagtaatcccagctacttgggaagctgaggcaggagaatcgcttgaactcgggaggtggaggttgcagtgagccgagatcacgccattgcactccagcctgggtgacagagtgagactccccgtctcaaaaaaaaaaaacaaaaaaaaacaaaaacttaaaatcaatctgtttctaattcctccagacttaacacagtattagccatttgtgccatggtttgatttctcaaagaatcagattttagagccaaaggactctagaagctcacacggctaaagttataa

SEQ ID NO: 174841 - DNA, 480 bp, Homo sapiens
tcagtaacagtgtgcagctgagggatccaggctggtgggaagctctgctccatgtcttctcccagacacccatattcagtggctcttactcccatacatgctcaacatatggcctctatacctggttccatgggaactacaaagatgttattttccaagcaactttaaggaggcgaggaagtgccggcaagtctgatctttaaaatggtgactaaatagtagtgtggctatagaatttattgtctaaacccgagcaactttgaggggaaaaggggagtgctaaacatacttatatactttttgaaatatttattattagctaataatttatttttattgtatcggtagctctaaattgttctaaagcaaattataaaatagttttaaaaatagcttatatttgtatgcctacttccacagaaaggaaactgttggctgtgttgtgtgcatccagagaggattaagaataagattggttat

SEQ ID NO: 174842 - DNA, 360 bp, Homo sapiens
ctgatgacctccaaatccacttgtaactatggagcatccgcatctcttgaaattctgtttttctttggcttttggggacacctctcttccttggttcttgttctgtatttctggctgattatcttttaatcttcacctcctttggctgccctttgaaatgggtattcctggaagtccttagtttcctcctttactcactctattcacagttttggggcattgataaccaaaatcatgacttcagtttccatgtagacatggatttgaaaacggtgggattagctctccaaagtgcatatgaggtccttatctgtcatctgattttcagacacacgtattaaactgcctgctagactttca

SEQ ID NO: 174843 - DNA, 596 bp, Homo sapiens
cgggctggaccaggcttagggctgggctctggtccgcaccccacactggccccgtgtgtcctgtgaccgttctgcctacggggcaggcctgagccaccacaggatggcagggtctccagggtgcagggcccgcaatgcttcaaccctcccacgaccccagcaccttcagagaaaacggaccctcgtgccgagtgaagtggttcaggcgaacgttatcaccacacgggggactcggcggcttctgccccaggcctcaaaggagaggggatccagaattctctgtctcaccccctcagcccctgcccttgaagcttctgtccccaaggctgtggggaggaaccagggaagggctggcgcgtctgctgtgcgatcccaggtgctcgtgcctcgctgagctcagcccctgtggcctcagagctgcaggcccctcccgggtgtcagagcactgactggaaaggccccccacatccctgccctctgctgctccccatcgtcgcgggggagaagctggaactgcacccgggcgaccgggatagggggggagcaggccgagggtgccagaaagggggggaacacaggggggagagaggggcgga

SEQ ID NO: 174844 - DNA, 196 bp, Homo sapiens
tcatgagttctaaggtagggtgagaaaaataaccgagagttgagcagtgacggaggaagctgcaaagaaaacgactgctcagggagaggctggccaggggcctgtggctcaggggactgagaagaggagctctctaggcatctgaattgaggttgcccacaattggttgcaagatcgtggctggccttgatggaag

SEQ ID NO: 174845 - DNA, 504 bp, Homo sapiens
tctagattagcaggatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctgttttgttcttggtgatttgaagaaacctgtttacaaggtaagggactgaaacaaataggtgacaggaaaaagagcagcaggggtacgagctggaggagtaagtggcttggcttgctctctttcagaatggagggctgtatggaaaggaggggtagtgttcttgaagagtgttggggtttaaatctagggggaccgtgtcttggcattgattgaaactcctggcttaacatcaccccgaaactgttagttggactgaacatgacatttggcagtgcagttaaaaacacttcctgcttatctct

SEQ ID NO: 174846 - DNA, 243 bp, Homo sapiens
gctggtaggcatgtgagaagtgaaccacagttcgttgagttaacgttcttaccggcaatcactaattgctttatgtgtctcatgttggcataatcttgctctagttcaccacctgagtccttctggactttttactggctagttcaaattatgcaacagttgataccaacgacatgattgaaaaataggaattgattacaacacagatacttagaactaaaccctagcaactttcaaactcat

SEQ ID NO: 174847 - DNA, 877 bp, Homo sapiens
gtcgtcgtcccccgatccccgacccggaccccatccccagggcctcgaccaccgacctgggaccccttttcccgagcctcgtcccccgatacccgacccggaaccccttccccagggcctagaccaccaacccgggaccccttttcccgggcctcgaccctcgatccccgacccggaaccccttccccagggcctctaccaccgacccgggaccccttctcccgggcctcgacccccgaccaccgaccgggacccttcccaggcccccgacccccaacccgagatcctttaccccgggcctcgaccctcgacccgggacccctccccccaggcctcgatccccgacccccgattcgggaccccttccccggggcctccatccccaaatctcaacccggtatgccttccccggggcctcgacctctgacccccaaccatggacccgggacctagactcccgacccaggaccccttgcccagggcctggacccccgaccaccgacccaggaccctttcccccgcccctggcactcctcagcgtcaggcgccctttcccgccagctcggtaggggggactgtgcgatgcctgttcggcctttcgggacttggaatgtcgggtcagagggcaccagaaaaagtgacagttgcaccccctgccccaaacagcatcactgcaaatcagaaggactcagacagaaagcgctccctgagtgccaggccctggtcacagcagctctttgcgtccattctccatgtggggaagcagagataccctgttccagttgaaggtatgtaccgaatggccgttcaccccagccctgttctggtgaggacagatagtataagccacgctcactcagagccacagaaacagtcg

SEQ ID NO: 174848 - DNA, 695 bp, Homo sapiens
tttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagct

SEQ ID NO: 174849 - DNA, 322 bp, Homo sapiens
ggctaatttttgtatttttagtagatacctggtttcatcatgttggccagactggtctcaaactcctgacctcaagtgatccacctgcctccgcctcccaaagtgctgggattataggcataagccattgcgcctggccttgttctactgtttaatgccttctcactactccacttgactagtctaaaaaataaaaaaatagggccaggcgcgttggctcatccctgtaatcccagcactttggaggcctaggcgggaggattgcttgagcccaggaattcgagaccagttggggtaacatagcaaaaccttgtagctacat

SEQ ID NO: 174850 - DNA, 148 bp, Homo sapiens
atccccaaagaatagattcttgtcaaacttagccacattatcattattccacctaaaaattaataataccccctaaacattaccaagattcaactggtgttcagatttcccaaaacactttcaaattctttgcttttccacttactga

SEQ ID NO: 174851 - DNA, 486 bp, Homo sapiens
ggttgcactgagccgagatcatgccactgaactccagcctgggcaacagagtgagactcttaaaaaagaaaaaagaaataatgttctaacattctaaccttgtgccactttcttgatgctccccaccgcaccaaatattggtatttatcttacaggattcacctgtgatagcactcttcttggagcaggctgagagtagctatcattctctctacttacaaaatttgaaaagtataggggttattttacttgacctcaagggatccagaaagagatgcccactctccttccagagagagaaatagggatcaattcgaacaatgctggccaggcatggtggctcatgcatgtaatcccagaactttgggaggccaaggtgggaggattgcttgaggccaggagtttgagaccagcctggcaaaaacctatctctattaaaaaatacaaaaattagctgggcatagtggtgcatgcctgtactcccag

SEQ ID NO: 174852 - DNA, 449 bp, Homo sapiens
cgcctggatagctcatttacgaagactgaaaagagcccccgattatgcctcatatgactgcgatttcactttatgatctccatttcattggtcgttttttatttgcttttcagtacttggcaactcctatgtcgcactcttcttggagcaggctgagagtagctatcattctctctacttacaaaatttgaaaagtataggggttattttacttgacctcaagggatccagaaagagatgcccactctccttccagagagagaaatagggatcaattcgaacaatgctggccaggcatggtggctcatgcatgtaatcccagaactttgggaggccaaggtgggaggattgcttgaggccaggagtttgagaccagcctggcaaaaacctatctctattaaaaaatacaaaaattagctgggcatagtggtgcatgcctgtactcccag

SEQ ID NO: 174853 - DNA, 224 bp, Homo sapiens
ctgtgggcctatgatgcctgaatgaagtagaacaaagaaggtgagccctagggagtgtcctggttttctggctgaagcaatttccagactctggtaggggaagccaagtagtgcttagaggtctccgtgagttaaggagacaaaacttggaatttggggaggttaatttttacataacttaaatttgtggggcagagtaatggaagaaagacgtggatagacaa

SEQ ID NO: 174854 - DNA, 240 bp, Homo sapiens
cagcacttccacccctaggaatctacccaagggaaatgaaagcatgagtggaaacaacccaatatgtccatcagctagtagtggaatactactcagcaaggaaaaacaacttggatgaatctcagaaacagtatactgaaggaaagaaggtagacaaagcactatacatgtatgatttcatattatgaatgtacagaaaaggcaaatctataccagcaaatagcaggtcagtggttgtgg

SEQ ID NO: 174855 - DNA, 402 bp, Homo sapiens
attttttttggagacaatattagaggaaaaaacagaaactagaactgctgaccagtattattaattgaagagatactccttttaacttaaaacaattatagaaacctttattaatagggacttttttaaatgttttgatttcaggctggggtaatcctagtacttcaggggaccaaggcaggaggattgcttgagtccaggagttcaagaccaacctgggcactgcagtgagaccttgtctctacaaaaaattagccgggcatagtgaggtgcacctgcagtcccagcaactcaggaagttgtggtgggaggattgtttgagcctgggaagcagaggttgcagtgagccgaggtggtgccactgcgttccatcctgggtgacagagtgagaccctgtctcgg

SEQ ID NO: 174856 - DNA, 345 bp, Homo sapiens
gcccattccatgtgcatgtgaactctttatgatcctctttttgatcagaatagaaagaacatattcaccaaattaggagctgcatacgatgtatctgaggccatgttaatctgccgtagcaaagaggccagaacaggcacaggagctgcaattagggatagtagtgggttggctttggggtagtctactgttatcctcccagaatctgggttcttccggcacaagactggtgacttcaatgaagaagtgatgggcatctccccgctacccactcactcattctctagattagggctggcaagctatgagctgacctgttttataaataaaagttttttggaacac

SEQ ID NO: 174857 - DNA, 650 bp, Homo sapiens
aggaaggaaggaaggaaggaaggaaaatagtgaaaacatggaacagacacccagaagggaaagggtttggaggaggtcgaggtgccagaggcaagcattcatttgtgtaagattcattcattcattcattcattcattcatcgtcattcaaacattgtgttgaatgtccactgtatgctgtgccctgcgtggaatgctaatgatggatctaccctctagcaaaaggtaagtcctaccctagttcattcgtacaaatagaggtgcacacaatgtatcatgggagcacttattcctcaacaggcagatggatcagaaaaggattcctagaagaggcgacagctgagctgaggcttaaaggataacacagttaaccaggccacaggtggtgagtgtcaggccaggaaacagcacgagcaagggcatgggatacggcgcatgggagcaggagcacttttgagctgttggaggtaaaatgcaagttaggaagcactgagagatgagcctggcttagaggtggcagcgagggccttggtggtcattgtcagagttggagttttgtcttgtgagtgatgcggagccactgaagggtcttcaggggactgtgagagaccatacatcaccaggtcttcctctttcttctgccaaactct

SEQ ID NO: 174858 - DNA, 291 bp, Homo sapiens
ggatgagtgaagcgctctgatcagaggaaagagcaattaattcttttatttttttttaaacttttcatttagccctgcctaagcaaggccttaaaaagtttggttatgaactcacaactgtccctctccatgggaatctttagtaaaaggtgaaagatgtagtcgttctgacaagaaaccagagcttgagagcaattaattctgagagctggatttggggaaggttgtgcagagaaaagcggaaagcagtcgttttcagaccagagccatgattgtcttggagttgactgg

SEQ ID NO: 174859 - DNA, 393 bp, Homo sapiens
tccctcattcaatcatcacacccttcaattctactttccaaatacaatagtctcccccatctgtggttttgatttatgtggtttatatacaataagatattttgagagagaaagagactacattcatataactttttactataatacagtactataattgttctattttattattgttaaaataaaaattaaactttatcacaggtacatacatataggaaaaaacatagcacatataggaaaaaacagtgtatatagggttcagtactatctgcagttactgggggggggggggtcttgtaatgtatcccccccaaccactgatacaatgggattactgtatctaatttgtcagtgcctctctattcctcctgctttgactctaatttaggc

SEQ ID NO: 174860 - DNA, 723 bp, Homo sapiens
gaggggttgcgtgtggaggctgggaaggtgggaagcggttgacctggggtcggatccgggagccccgtggaatagaggattctctctggagccgcatggaattactgaagggctgctgattctagggccagggcagaaacagtgtggggagtgtaggtgaggagggagagatgtcttttcgctgtatccctccggaattctggcttttaaatctccaaggagttgagtgttctgatgctttcttgctgttctttcctgctacaagtggaaggagcctgggtaactatgaaacacttcttccttccctaaccaggtgcacggtaggaccaataacctgaagtgtgggcatcatctttgggaggctcctcagtgggtttctcagtaagcaagaggattaaaaaagatctaaaagaaattttactactggtaatttggaatcttcatctcagatgctttggacctgggaaatttctgcagtgggtggggagtttgttctctaatatttcacttggcagtgttttaatgcccaaagcatatttatacactaaatggatgcttccacagcatcattgaggttattaaaggctggcagctgctggatcacaaaatcctaccagccagcccacacaatgaccaacatctgctagcggatggcccaagactgactgacaggagagctcatttggatgaatggccgttttaggggccctcccgattaaatgg

SEQ ID NO: 174861 - DNA, 147 bp, Homo sapiens
atcgaacctatcacccttcatcgtaaaccctatttgtgatttcaacatttttgtgggattaccttaagagccatgacactgtaacactttgtaattttgtaaaagtcctgattgtcaatatatgcccagtgagggttggtaaagaat

SEQ ID NO: 174862 - DNA, 120 bp, Homo sapiens
caagactatgcaatatactttacacttacaaggttccttacagcttacaaagcatgaagccagatctccccttagaatgtcctgggcacagcagttctctgttctgtcacaaagctcatg

SEQ ID NO: 174863 - DNA, 116 bp, Homo sapiens
ctataaaatttcaagacaccaacaaactaataaccaacaaagcgatggcgagtgaaggtagaattctgcatcatattattaaacagtttatgaagacctaggaacagagacgatta

SEQ ID NO: 174864 - DNA, 386 bp, Homo sapiens
gacagccttcggagatcacctagcaaccagctcggaggaaaggagcctgcgtaggttttggctccaggaagagggatcccagaggatgccgggaactcggggtgggccgcagggcggtcagagaggctctcagagaggctttggggtctgtcgggagaatttaggagtggggaagaccgggcagctatttattcccagtggtctgcacttcggctgttgcctcagaggaggcagtagagcatgctggttaggactgtgctttggagcccacctgacttttaacagtgtgacattgaacaaattaattacctggacttcatgggtacaatacttgtaactactacttggagatgttagaatattaaaaagtacgttggtcttgattt

SEQ ID NO: 174865 - DNA, 381 bp, Homo sapiens
ttaagcttatcatttccttcaaactctgccacatagtttgaagcagccaagtcaacactggttcttatattcctcatgtacttccaaatggtctgtggtagcagccacgaagccccaaagcactgcctaaaaggcacttcattccttgtgaccacagggtattgtctaaataacctgcgccactgcataccatgaacaatgagaaccacatcctctaaagctgagcagaatctcgctgttttcaaacccaagcaggccagataactccatcccagagtctcattttcttaagggtgtgttacctggaactactggcatcaattaataggacagccagagaggatgtggttagaatatgttcccagtgctgagcacaaactt

SEQ ID NO: 174866 - DNA, 358 bp, Homo sapiens
tatggagatcattgagggcaatcagtctgaaaaagtgatcaagaatgcagtctgatttacaatagctaccaaaacatacctaggaacaaattgaaccaatgaggtaaaagatctataagaggaaaactataacacattgataaaagaaattgaagtgaacacacacagaaaattgaaggacattcccatgggttggaaaaattacatggttaaaatgtctatactacccgaagctatccatagattcaatgtaatccctgtcaaaataccaatgacattcttcacataaatagaaaaaaagtcctaaaattcacatgaaaccatgaaaaccctgaaatgactaaagcatccctgagca

SEQ ID NO: 174867 - DNA, 458 bp, Homo sapiens
ccttccttccttaattcctgtccagctttctcttggcaaactacagcccacaggccaaatccagcccaccaaccaagaatgtttgtacacttttaaatggttgaaaaaaatcagaagaatgtttcacgatgtgaaatttatacaaaattcaaactgcagtgtccataaataaaatgttactggatcacagccttgcccatgtatttatgagcagttgggacagagaccattgaaaatatttacttcctggccctttgcagaaaaagcctgtcttacatgacaaaatatggcaactagcagactgtgtcgggtagtatcatcagtgaaaagaagtacctcgtacgctcgagccaaacatcagcctcttgaagagttacaatgggctttttatgtcgtcaacctgcagaacacaggaagagttagggagaagcctagacccaggtcagaatgcagttgga

SEQ ID NO: 174868 - DNA, 766 bp, Homo sapiens
tagagatgaagaagtcattaccgacccggctggccccaagcctacaccagctacccgttgccccgggagccagaggctgctgctgtggccagcatggacagcactaaaccaaagccgcctctgttctccactgctggcaggaccaagctgagaccaggaccaaaactgtgggatgtgttggccacatacttccagccccacagcacacagcaggcatggagggcgggtacagggcccagcaggacagaaaatctgctggagcagattcctgggaacagcgtgtccctcctcttcagaggtctcctcttcttttctgaagctttacagatagattatagaaaatgaccagcatgcatgatgaggaaactgagactccaagaggccaactcacttgcctcagatgccctggccaggaggggacagcctcagcaggacagtccatgctagatgacccctggtctggcatgatttccattacgccagtgcattgcatagcagacaagctcaatcggaaatgctctcctagacccaggcttagggtctgaaaggtggttacagaccattacagaccacttttccacttttcaagttgaaaagagccattgctttgaaaatacttgtggattagattgaaatgccaacggcagagtatgaagaccaggccacaaaaggaaaggttcattcaccttgcgccctcttgtggagaagaaggcaaagaatactataatactacctcagaaaacgggaatttagttcatcctcttcc

SEQ ID NO: 174869 - DNA, 243 bp, Homo sapiens
tgtagcgcgagcacatacccacacacagccctcatttcctctaaacactctgactcaaatgaactgtccctatttggcaaaactctctaacctggaggctgtcttctgtcacctgacattctgtccccaaagtcagccaaactttattatacatctttagcaattgatcagaagaatgccctgccagctgtttccctctctctgagggcaactcccctggccctccctccttcggcctggttg

SEQ ID NO: 174870 - DNA, 353 bp, Homo sapiens
taatttttgtatttttagtagagatggggtttcactatattggccaggctggtcttgaactcctgacctcgtgatccacctgcctctgccccctaaagtgctgggattacaaggcatgagccaccgtgcgtggcctgttctaggtgttttgtaatttctatcaggttttctctttgatctgtcaattactgagaaacaagtttttatttttccaaataaataggagtttgctttactcgctgttttattatatttggttttctttctgttactggcttttaacttgctgcctcgaagtcaagaggctgtagtctgggctttgttgaactttttctttgacctagtcagtgtta

SEQ ID NO: 174871 - DNA, 393 bp, Homo sapiens
cagcccatgaatggtcttataagcatttttcatcatagccaaaaaagtggaaacaacctaaatgtccatcaattgaatgaataatcaaaatttggcccatctctacaatgaaatgtcatttggccacaaaaaggaataaaatactgatacatgctaccacatggatgaatcttgaaagcattaggccacattttaaaaactaggcccccaaagatcatatgttatatgatttcatttatatgaaatctccagaatttgcaaatccagaggcagaaagtagatttgtggttgccagaggctagggggaggagcaatggctaataggtatgggcttttttggaggagtgatgaaaatgttttggtggttgcacaactctgtgaaaatagtaaaaa

SEQ ID NO: 174872 - DNA, 209 bp, Homo sapiens
agatggaaggtgatgaactagctttgaaaagcacaaatcagaaactgaaattacttctgaagaattaggtagaggagaaactaaattggatttaggctgtatcttagtggctaatgtggttttattcaggaaatctcagtgtagttggtactcttcacttgttctctttacctagaaagaataggaagcttacagtgtatctttttaaa

SEQ ID NO: 174873 - DNA, 239 bp, Homo sapiens
aggtgagaggattgcttgaggccaggagttcaaggctgccgtgagctatgatcacaccactgtatgccagcctgggcgacagagtaagatctcatctcttaaacaagtaaacagatcaacttagaggaaaggaaacaagcccatcaggaaaagaataagctcatataacatccatatacttgtgagatgcaagtgagattggaagagctagagctagatggtcacaaacatactaggcc

SEQ ID NO: 174874 - DNA, 367 bp, Homo sapiens
tggaatttccaatatttgaccattacatggtaatttgctatggttcaacctaatgaaaataccagtacatagcttactaatcaataaacattaacttgtaaagggaaagcctttttaagcctgttgcaaaacacagaaatcctacaaatcaataaaaaacaatagaaaactgtacaaaggacctgtacatggctaataaacataggaaagatgtttaatcttacgaatactgtcatttggactggtaaataacaataagccagttctgacatgggtgtggtattcagtttcagccgctccagtcccaaccacacaggctcctaaattcacatttcttttttcaaaatgggtggagagggaggaggga

SEQ ID NO: 174875 - DNA, 490 bp, Homo sapiens
gctcaccgtgcggcagggaccccagggctctggtccctgcttgccactctccttgctgcatttccctccctcctctgcctgaggagtttttgctcagagcgtgttcattaaactggtgactaggctctgttggggagttccatgaggatgaccacctggccttccaggtgagaggcaagggccagagaggtcccctctggggcagggtcgcgcctgcctcactcctgccaacatgtctcagggcttctgtgtcagaatcacaggcagattcccagagcggcactcacccagtaaacccggtgggaagggcccaaggcacctgggcccatcagccttgctgccaccgggaagatcttgccaggacagtggcggaggatttgccggaccacactcggagtggcgggttagaccctcatggcctcctgcccatggtttactaaaacaaagctcagagccctactttggcaaataaagctgctgtaatgtctca

SEQ ID NO: 174876 - DNA, 648 bp, Homo sapiens
ttgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggacggagaaaccaatttaaaatttaagatgtcacttgaaatcacagaccagtacctccaaagagaagatacattggctacatttgatggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggc

SEQ ID NO: 174877 - DNA, 158 bp, Homo sapiens
tgtctgaattttatcactttcgctataattttatctttctcagaatgtcataatacagtagtccccgttatctgtggtgatatgttctaagacccccagtggatgcctgaaaccagctatagtactgaaccatatatgtgtgtgtgtgtgtgtgtgtg

SEQ ID NO: 174878 - DNA, 589 bp, Homo sapiens
tcaccgctttggccaggctgctctggaactcttgacctcaggtgatccacacaactcagcctcccaaagtgctgggattacaggcgtgagccaccatgcccgactagatctgcctttttaacagattttcttgcatggttgggggattggtactcacatatctaccaatgctcatctgctttctacttttatcagaaacacacatttccatcacatttagtttggaattagggagtgagtctgggaaacaagaatagcaaagtgtaatactgcagtgctcaactctcatgtcaacatactcttgtgtcagacttagtcattagttacaagtcacagtcattagttacaagtcacaagccattagtcacaagtcacataaattcacaagtcattagttaaagtattagcttgagaaagatttactttttataaattgcagcggctcaagattatccctgtaatactcacgtgcactctgacattttcttcattgcaagggaaaaggagggaagtggatttagagttctgggaagtgagggtaagtcacacactatgtcacaggattcttgtgaggattaaatgagatgct

SEQ ID NO: 174879 - DNA, 203 bp, Homo sapiens
gcatcatgggcagggccatgctccggctatgggtccccgggcaggtaatcacctttctaagccttggttcctccttcaggaaaatggggccataccccaggctttctggggctgttggggaagacgacagactgttacactcaaagggtgaagcagataaagctttgcaaagccctgcgccctgctctgggttgagggctgag

SEQ ID NO: 174880 - DNA, 274 bp, Homo sapiens
atttgagatagcaaaaaatggaccattctgtcatttattcatttcagaaacacacacattgtctccattgtgcctcccacatgccaggcagcaaacgaaacggacagagatctgtcattccgggagactaaaatgtagggagtagatgctattgaaaaaaataacacaagtttataaagacaaaatgaagtttctcacaatggctttgtaaacacagcttggggaaaacagccggctatgtttttatgtttttttgccaaggaaggttttttgg

SEQ ID NO: 174881 - DNA, 271 bp, Homo sapiens
gaatcactatcaagaaagggctgatgtagctcctggcacttaattaagcttcccttgctaataagaatgagaagatactgagagccaaagatctactatcttttcttttcagtctatctgaaagtatgcctccccttcactctgaaatatactgaggtttggaaaataggttatatagttaccataaatttcaaaagacaatctgtcttttttctatttagatacggctaagaccgcaggcatggtggcatgcagccggtagtctcagcta

SEQ ID NO: 174882 - DNA, 326 bp, Homo sapiens
ccagcctgggtgacagaaggagatcagtctcaaaaaataataaatattagcaaagttctttatctgggaaatttcagtgtggaaggagttggagtctggagtcagagtctaggacaacaatcctttcaacaatgacaatacttttctcagcattttctccatgtggtctgaagttcagcctttattttgaatgtgaagccatcaaagcaagtattcggtgcaaatagatttaacttttcttgttttttttttttttggaaatggactctcgctctgtcagccccttcaggggggttcccgacctcgatttcgtatctcttggtcat

SEQ ID NO: 174883 - DNA, 269 bp, Homo sapiens
tatacgtatgtaacaaacctgcatgttctgcatatgtaccccagaacttaaagtataataaaaaaaaaattaaaaaaaaaagaaattgtcgtgagaccacttaaaactggacgatgacctttctttttttatattagagaatataatagaactaagaaatctcaatcaggtgtggcagctcacacctgtaatctcagcactttgggaggccaaggcaggaggatcacttgagccaggggttctagaccagccagggcaacatggtgaga

SEQ ID NO: 174884 - DNA, 203 bp, Homo sapiens
agaagttccagaggcatttgatttagctgcagaaattctccaccgtaggtttttgaggagggtacaagaaatggtcaaaacagtacttgaggatgagatcccagcagcaatatatgcaagggacaaaagtggggtaaggattggagtgaggaagaccagctggcggctgcagccagaggccctccctggtttcctttacagga

SEQ ID NO: 174885 - DNA, 534 bp, Homo sapiens
gtgaaattaaaactccatgccttttaatgcagttaaaaaacatcagagaggaaaatgttgccatttatcgattccaccctggtgactgagggaagatttcagacagaggaatataattaataaataataataatacattaataaaaactcaagctttttactgctatcttgttgcttagaagttatttcattttaggattctatagagtaacttttcctctttagttcttacgagacatataccaaactctgtgtaattttcaatgattattcatacgcagtgacgctaggaaagggtcttgcatgcaggtgttcagtaaacatctgattaattaataagcacatcaataagagggaagaacctcaaaaaggaaagagtgtcccagcataaacatgcgtggtcaatatgaaggcaagcccagtccgtcctgggagacgtttgcgatggtgacaaagggagggtggacagaaaaatggggaataagggcctggcacagtgactgtaatcccagcactttgggaggccgaggtggg

SEQ ID NO: 174886 - DNA, 551 bp, Homo sapiens
agctaattttttgtatttttagtagagacggagtttcgtcatgttgtccaggctggtctcgaactcctgacctcaggtgatccactcgtctcggcctcccaaaatgctgggattataggcgtgagccattgcatccaacccatccagtctttgcagtcagcttctgcctttgccaaaccttcctggagtggagaggggactataccccatgactgcccattgggcagatcctcctcctcctcgtccattaggcccctcatgagtagaggccacagtgaagtgcatccgtagtctatccatagcctgtgagttgttgtccctggaaagttccactcacttgaagaaaaaaaatagaaccttcttcaggctccacctctggaagtgggaagtccttaaccaaactaaacaccttcacaagtccttctgtaagcccaagggggaaaacaaaccaaaacacaaacactccgcagtggcctggactgcagtggcattcggctgaatgtctctgagggcactgtgaggacagggccctggttagacacgggggaccc

SEQ ID NO: 174887 - DNA, 744 bp, Homo sapiens
gcctgggagaatactattgctcactgcacaggttaatgcactgtgattgcctcccttttaatatacaggtggtgtcttcctggagtgaccagtttaccttctccccatacacctctcctgcctagttgttgcctagacctggtgcacactgcagtcctcgggactttctgttgccaccctcctgtattggacgtcttgtttctggatttcctatcctcttccttcttggtttatccctcattttttctgtagcacagcagttttctaattcaatacttttaggaggttgagtatggataattttggaaagtgtccccgggatgattccaatttatttaagcctgttttccagagagctgcgggtctcctaaggcctttctcatttctaacaagtctccctctctagaacactggttcccagtcgttgttttcatactagcaacattttaaaagcaggataggggtggctagtatgcaattgccaactttggatttttccaagcaggagtatatcaaaaagctacaatttattaccagtatttcgtaaaatctagagagttattagagaagtcaagatggtggttatctctggggagagagagaagatcccaggatcagcacagagggggcttctaggatattgttcctattttatttcttagttgggtaattgtttttagcctcagaatgttagagggtattatcctttaaactgtgtgtctgacatgcacacccacgtttata

SEQ ID NO: 174888 - DNA, 707 bp, Homo sapiens
gcctgggagaatactattgctcactgcacaggttaatgcactgtgattgcctcccttttaatatacaggtggtgtcttcctggagtgaccagtttaccttctccccatacacctctcctgcctagttgttgcctagacctggtgcacactgcagtcctcgggactttctgttgccaccctcctgtattggacgtcttgtttctggatttcctatcctcttccttcttggtttatccctcattttttctgtagcacagcagttttctaattcaatacttttaggaggttgagtatggataattttggaaagtgtccccgggatgattccaatttatttaagcctgttttccagagagctgcgggtctcctaaggcctttctcatttctaacaagtctccctctctagaacactggttcccagtcgttgttttcatactagcaacattttaaaagcaggataggggtggctagtatgcaattgccaactttggatttttccaagcaggagtatatcaaaaagctacaatttattaccagtatttcgtaaaagacagtttgacaccagaagagtgaaaaagaacatgggaatagtggacaaaaatagccatcagtttgaataagcgtatgaaaagtgttaattttatgaaaaattcactattttgttcatatttttcttattttggaggctaattgttaaaagcttttat

SEQ ID NO: 174889 - DNA, 274 bp, Homo sapiens
aggatgggccggaccgcgtttcaggtaatcaactcaggagcaactgaaggcttccgagggtaatggaccacgtaatgagtcaatttgtggttgccaggtgcatccctgctcagacctgggcggggcaggtgggtgtgggggcacggctttcggggctcatcctcccgcaccacctgtgggaagctacgttgcttctctacgtctcaattttctcctctttactataaaaatagcagctacctcatagaattgtcttgaatatcaaataaggaaa

SEQ ID NO: 174890 - DNA, 302 bp, Homo sapiens
gggaaggctgtaagggagataattgaattcctgaggcaggattataatagcgattattttttggatgactagaggaacaaaagcttgtgggttttagataaacagatgacaaaaagagcccatctgagagtccagacttgtcaatagagccctgagggcttagagtttactgaaaggacaaacatcttggagtgtttagagctcaggcttctgattcttaggtatgccttggggtctggtaccctcattctttaataattagggcacagcctacactcacagtacaggaagaacctccagag

SEQ ID NO: 174891 - DNA, 119 bp, Homo sapiens
tcatcgcacaagcagaccaggagaccgcaggtccctccagggccctgcagagaagctactacagtctcgggcagttcagagggcacagctccagctctcaggggcaagaagctggcaaa

SEQ ID NO: 174892 - DNA, 622 bp, Homo sapiens
aatgtgtgcatacagcagagaagggaagatagaaattcttataaatgatgatcattaatcaacaagcatacatgaggggggcttgcccaaatttgtgacagaaatctgccatgagctgaggagtgtaatcaagtcacccttttacactggagatccaaaaatgactgcgtaaataactacacaaatgattgagtaagtggcttggtcttagaatcagattacttggacttgaattctgccgctgccacttactagcttaatttaaccatttggaggagcctgttctcacaaaaataaaatatggataataatattaccaacatcacaggctcattgtggaggttaaattacattcatgtaaagtacttggtgtggtgcattgctcatgataagagcacagtgaatgttagagatcattattaataatctaaagtgatgctccacacaatttatcaggttgatggagaaatggtttttttggggggaaggagagatgagcagagggctttattgagcctcctttgcttctctaacaccaacaaaggggacattgagaagtatttatttccatttgtcaaataatagctgaaattagaacattctaaaatggctattggagaat

SEQ ID NO: 174893 - DNA, 515 bp, Homo sapiens
  misc_feature (12)..(12): n is a, c, g, or t
  misc_feature (20)..(20): n is a, c, g, or t
ctgtcgatctanaggatccnggctcccacttggttgcacaaccaacttgtgctaccaagtgaacagactatgagtaaaggcctcttcttccacttggcagctgctcatatcattgacaaacgagcatattagagcatgcatgctgggctgatcattctgataaaggcaacaagcttcacaactcactcaatgaggtcgtccgtgagaacttcactgattttacgaggacaggagctacttctttgctgaaatgcatcacggtttcaactgctgaggttttccgcaaccttttgcattgtttggaatgtgagcagcacggccgagacaaactttggggttcccactgcattgttaaacctcccccttcacttcaaggccaggtgagcaagggaaaggagcgcggcctgggcgtcccgcagggccccgctaaggaccgctcccgccttgagcgcagcacaggccctctctggccacaaggatggggtcgcccgcagacactggtgaccagcggaacg

SEQ ID NO: 174894 - DNA, 468 bp, Homo sapiens
aacttcaagaggtaggagttgattggcttcaacagcaaactctatggcactccctcagagaagcatttcctgtctaaacttacttagtaccacagtagctacttgtactactttattttcaaattgaattaggacacatgtccttatttagaaagaggattaatgagcaataaaaggctagaaattaagggaaaaattaactgcctaggcttaggtaattcaaagtaaatatatatcacagaaacaaagaagggacatggaaaatttaatccaactgcttcaattcgcagattaacaaaaacatgcattttagtcagtgaacaacttatatgccaggtatggaactgtgaatacatagtcctgacactgaaatatctcagaccagtagagaaggaacagacaaaatgaaagcataactacaattgtaataagtatgtcaaaggacaagtaaagccagataaatttttt

SEQ ID NO: 174895 - DNA, 465 bp, Homo sapiens
ctgataaccaggaaatgtctcttaaggttggctttggatcagggattttcagaccagacacataaacccgctttgtgggccttacgtggtagaggaggctggctgtggaacacgcgtatgtgctggcgataaccatgaaagtgttgtttgaaattgtgtgcacctctggcctctgaacagaaatgtttggagaaatccagtcccgtgggctggactgaagcaaacttctcccgaaagacaaaactgtggttgtcctaatgacctttctaagctatttttggagttagactcacacacgtaaatctggctaaattcagaactgttctttgacctggagaatgaaaaatgaaattgaaagatgtggtgttagatttgatttgtatgatgtggtatgacagaaaattcacattttaattttatgcaaactttagctgatctacatggttttcagtaataaaacctact

SEQ ID NO: 174896 - DNA, 6280 bp, Homo sapiens
gaattatctgggtccagagcaaaggtggcactctcagccctccctggagtccacgccggcaggtgaaggatcagagccccatgccccatccttggggccaggggctgggacccaggtcaccaggagcctccagttgaagtggggaggtgactggggtggtgcagtagtgagccatcccctcacacactgccagccttgcccactgtgtcctccctggccgcccggagctgtgtccgcctcctgcctggctgcctgtgctcggcccctccacaagcccaaaacagccctagggtactcagtgttttcagagccgcctagatgcaggactgtttgtgttttggttttaaatttttttaattaatttattttttatagagaccaggtctcaccatgttgcccaggctggtttcaaacccctgggctcaagtgacctgcccgccgcagcctcccaaagtgctgggattacaggtttgagctactgcacgccactggttttaaatttttaaacagaaaacaatatttacatttcctctgtctttttttttttttttttttttgagacggagtctcgctctgtcacccaggctggagtacagtggcgcgatctctgctcactgcaagctccgcctcctgggttcatgccattctcctgcctcagccttctcgtcttttaaaactgaacactgaggtgggttttgtggtggttggtgaacggacaggtttgggcctggatcccccacccgaccctagcacccacaggtggggtcgccaactctgctgatgtgcctcctccctcagcactgtggacctgctggactggagcagcctcatcgacagcaggaccaagctgtccaagcacctggtagtccccaatggacaggtaacacctccgctcctcagtgaggcccagctcagcagggcgctgcgctaagaagggaattcagcctgccacatgtttctcttgttgcctaccctgggaacttaacatgaccaagatcactgcacactatggccccacagaccccctatggtccagggggaaaagaagacaaacccactagtgtccacagagtgcttggtgggacagagacccacgcggagccttaaaacaccacaaggagagggggtctgggggccttccccaagtcatctgtcttgtgcatcaggtcaccccaaacttcagaggcctaaaacggcagcagccactctgcttctgcctcatggttctggggttgacagggctcagctgggcagtcctcgcttggggtctcctgggtagctgtactcacagagtggtggcgctgggacctgggggaggcgcccactcacatgtctgggagttggtgctggctgtggcttgggctttttcccaacatggcagctgggctctaagggccagtgtcccctgagacgtgagagccaggcagaagctgggtgaccttttcctgcctcacctcagaagtcacacggtgtcttttctggcaagttctgtttgttagaagcatgtcaccaggccagcctgtatactgcggggagaggaatgagactcatctgcctgtgggaggggggcccaggacctggctgactgcttgaaaccacaacctaaactggaattcgaagaaagaacagaagcaccttcagaaaacatcctgcagaggcagctttccatgacacatctagccccagtccactaagggcccagcctcaaactcagagcccccgacccagagcctcggggcgcagtgcgtacagtgtggctgtgcaccaaggccaccagctgttggagactttagcatggtgtagcaagggatagagtggtactgcttgtgcccagtgaggcaaggctgctggggccagcaaaggggtgagcgggaggccctgcgggatgggtccccacggcctctgagcaccagctccttgaaggcctcatcctggcggttgccctggtccctggctacgtgtcagcacgtgctgcacaactgccctgtctgcctgtagccaggggtcttcctcctgggccctcttcctgctctgggtggagcccttctgtttgacgattgggtggtcagtgttcacttcctcagtgtcacatgggagctgcagggggccctcccacaatggtggggcctctgtgagaactggggaggctgttagagtacacacttcggagtgcaggcctggactgagcctggggcccactgacatgggcactgagctccctcctggtacccccagggcccgcgtagggcagtgcactggctgcgttggaggttccggggctctgtgctgcttgtccaggtggccctccctcccggccctgcatgagagggttcccgtgggctgggaacactaagagaggtttagcctgggcctcagggtggcacttcctggcccttgctgtggcctgaccatgtgctgtacccccagacaggacagctggagcccctgctgtcccggtttgctgaggaggaggagctacagatgacgaggatgctacagcggatggatgtcctgcccaaggcgagctgtcccgctcgggcagagggctggggccttggggacccgggactcatgcagaagagggcacctgcctcacttgagcaatagttgctcccactctcccaccccctgcgcctctcagaaagccacagagatgggcgtgcggctgatggtggatgccgagcagacctacttccagccggccatcagtcgcctgacgctggagatgcagcggaagttcaatgtggagaagctgctcatcttcaacacataccagtgctacctcaaggatgcctatgacaatgtgaccctggacatggagctggctcaccgtgagggctggtgttttggggccaagccggtgcggggcgcatacctggcccaggagcgagcctgtgcagcagagatcggatatgaggaccccatcaaccccatgtacgaggccaccaacaccatgtaccacaggtgcctggactacgtgctggaggagctgaagcacaacgccaaggccaaggtgatggtggcctcccacaatgaggacacagtgcgcttcgcactgcgcaggtaggtgtgccccaccctgcaccgaaaccccaacctgagccgttgtctcctccagctggggagaggtggcagcagtgcagagctcagggtgggcagagtgacctgctgggtggtcgggcatttgtggggaaaggctggtgaaatgagctggagggtggcttcagtgggcaggcccaggcccgctggcattctggacatcggactgtgagagcacaatggctctttgcagttacgttggtttttaaaattaacttttttttttagatagaatctcgctgtcacctatgctggagtgcagtggcgtggtctcagctcactgcaacctccgcttcccaagttcaagcaattcttcatgcctcagcctcccaagtagctgggattacaggcatgtgccaccacgcctggctaatgttttgtatttttagcagagacagggtttcaccatgttggccaggctggtctcaaactcctggcctcaagtgatcctcccttcttggcctcccaaagtgctgggattacaagcatcagccactgtacccagccttttaaaaattaacatttgacttattaaacttcacaattaaaaaactaaatttcatcagggtattcggatggctcctgaaaggtacaaatgtagtgttggagcccagtccctcaggaggcctccacagcgctgcctcatttataagcagttcccttaacattttaactacatctggaatgtaacggtttgttttctctttaaacatttgtcccatggagcacaacttcggtagaattctaacaagtcaaatgcagaagttaggtgaagtcagttcttggatactcctgtactgtcaccctggtcttatctcatgccttagcccaagctatgcacacaatggggtcctaggtccccctcccctcccagattccgccttcccagggatgggaccccctagaaccctcggaggcctgggcagtggcctcgctggctctcgccttcctaggagctgagcaggagctccactctcagcagggcagggtgccccagatccatgacttgtggcacgaaggggctccccaagaagctgtgaagccacagggccaggcttggggccagggctgcagccaacaggacacatcctggtgctgctcgggagctgactcacggctctgaaatcattcagtgatgtccacattcagcctttgtttacgatgctgctactttttcatggcctgaaattgcagcacacccatttttgtgccctgatcctctgctaattgtcatagatgtgtcggtgatgggacagactcactttctccacacgcacaggcctggtggccagcactgcccagcactcgggagctggtgggggttcctctcagcttgtaatcaggactcccagcctctgggtggactctcaatgctggtggactcacagcctgactagacacatcaccatccaactccgaaaggacagcccgccctcagcagggcttcctctctccagcttagccccggcacctgtctgtccctactatcttgctgtggcagtggcttccccagtggacacagcttccccctcccgagtggcagccgggctctctcctcttggccccaagggccctgtgccgggctcccccagtaccatgctcacatccctgcctgagaggctggacccctgcaggcttcagctctgcccctgctgtgggtggctggggagctctggggagctggggtcccctcccatgggtaagtggttctagactatggcagctgctctgtcctgtgctgggcccagactgccacaccacccaccctcaaacaacccgagttggctttggccaaggaacaaaccagccccaaacttagaggctggaacagtggcatgttctgtaggccaggggtgggctggctcagctgatgcttctgctgctggctgtgcctgtgtccctcctgcgtctgtgatctggggccggtggggcctaatgagctcattcatggctggtgtagtaaaggagactacatcctgggtccagcgtcccacaggccagcccaggcttgggcacgtggtgggctcaggcttccagaaggcctggagagggcaagcctctgcttgtgtcacctttggtacctccctgttggccaaagtgcctcacgaggccaagcccagatgccaggtggagtgagccactgtcctgtgctgggaggagccgcagtcacatggcagaggctgtgcacaccagcaggggagggggcagccagcagtggcacccggctctcgggttcatgtcctggggttgaggaagacacaagatggaagccagggcgatgtggcagagatgggtgcctgctttagactgggtggtcccgacactggagcccagcccagggatggagggaaagggcctctggccgatgggtactctgggagccagggctggggcagatggagaacaggggaggtgaggccctcggggagggagtgggaagcacagcacaggcactgccagtcacccgggtgatgcgtgagcagcaggcggaactcgccccaggctgggggacccagtgctgtgcagaccagcgaagtcgggatacctggatatagtaagctggagatgaaacttgagaactgtcactgcgtggatatttcaaaccctgagaatctttgtaagaccctatacggggtggtgtgaagacaggacagagtggaggccccaccccagtatctgagcagtgctaatagatgtataatgcaagccacatctgtaatttaaagttttttggtagctacgttaaaagataaaatgaatttcaagaatacattttaattaacccaaaatatacaaaatattacttcaaattgtattcaagttgattttagaaaagcaatgcggcatcgtgcatttttctagaaagtctcctaaatcccgtgtgtatttgacatttgcaacacatctcgattcagagcagccgccttccgaggactcgggggctggtggcagctgtgtgggacacagcagctgtggggatggggcagagcagcagcccacagagggcgagggcaggggccggagaccagtcataccacagaaccctggaggggcttgaggaagggatggcaggagagctgaggagcttctctgccctgtggggcaggctgctgggtgggtcaaagccccagaagggctgcacctccaagaagggaggtagaggagaggtgggagagaggag

SEQ ID NO: 174897 - DNA, 551 bp, Homo sapiens
gagtgctaattctgctatcactgatgataaaacaataataatcttttctctcatgtctttaagtgtcttcattgattagtaatgctctgtttattaaaactgaccaaaggctgacttcctttgttaaaatcttttaggtgtgttggttttatctgtcaacttagatgcatattttttcttccttccttaagcagttcacaatcttcatacacatttcttgataatgctcactttatatacatttttgtcttgaaaactcttatctgctaacagtttataagtaaactgtggtcatgttcaaagagaagaggcatcagtttcctgcttttgatacctattcttacacgtgaaactaacactaatttaaaaaatccagaatagctgtaattcgcttccatgcatcttcttgttttatttgtataatgaactaattattctcttatgtatgtatatgtgtatatatattacataatgtgccgtatattggcacgtttctttctttcaaaagcctacacgagttgcaatttcacagagaaccctaagaacagagt

SEQ ID NO: 174898 - DNA, 281 bp, Homo sapiens
taagcatagaagtatttcttgattttaggaaaatatcccaaatagttaaacaaattattctagcatcattaaataatcctttgatttctcctatccaattgtgttttttttttttttagacggagtcttgctctgtcgcccaggctggagtgcagtggcgcgatcttggctcactgcaagctctgcctcccaggttcacgccattcttctgcctcagcctcccgagtagctgggactacaggtgcctgccaccatgcctggctaattttttgtctttttag

SEQ ID NO: 174899 - DNA, 896 bp, Homo sapiens
acacagaaaaccagccaaagcatatgtctaggtacgtggccggtattctggatcactgcgtgtcttggggagcttgggattccgcagcttggcggccgagagcctttgtttgcctttttgagacagggtttccctctctcgcccaggctggagcgcagtcatgcggttacgcctcactgcagcctcagcttcccaggatcaagcggccctcccacctcagcctcccgggtagctgggaccgcaggcgctcgccgctgcctgtggctaatttttaaacagttttttgaaatggggtctcgctttgttgctcaggttggtctcgaactcctggcatcaagcgttcctcacgtctcagcctcccatagtgttggaattacgtgcatgagccactgcaggcagtcggactaagggagtttaaacaaagaagccggagcctggccctcttcgggcttcggtggggcccagtaggcagccaaaactcacactgagacggcggctgctctccaggcgggtttgctcaggctgcccccgtgctccctgccctgggcttcagtcctggagaggacccggtttctcaacccgtgcatcgttggcactttgagcgacgggactgtcctgtgcgttgcacgatgttcagcagcagctttggcctctgctatccactaggggccagttccaccccctagcacctcagattaacaaccgaaaatgtcttctagactttgccgaaggactcctgggggcaaatacgcccccattgagactcactggcttagaacaaggcaagctccagcctgtttcaggctttcccagagactgccctacaccatctatggttgcatggctggcttctcatccttcaaccttccaccgaagtgttgacttcagagaaacat

SEQ ID NO: 174900 - DNA, 233 bp, Homo sapiens
acacctcaccatcccactgcacacatcccaggcactgacgtgccatctcagttattccttctttgcattacctgccttcttcactttctaaggttcctgacactcttttcctaatcttagtgtgaccacatgtcctggttttcccagtatggtcccagctggtttatacctttagtcctagagtgagtcctaggtagtcctttttaccatcagacatgtcttgggttggttga

SEQ ID NO: 174901 - DNA, 711 bp, Homo sapiens
tgctgggattaaaggtgtgagccacggtgcccagcccctatattctttcttttgatatcaatgtgtactaccaagtatatttgtttaagtacatacttgttcactgaaaattgctgaaacattgtagagataaatacatgatgagatttgtattgttatgctcaatatttaattattgctttttaaaagacaaatttataaataatgacaggcaaatcttttttgtttactaaactgtatcttttcaccagttcatgtatgttgattttaagcattactatgtgtcaagcactttcctaagtactttaaatattgattttttaatcctctcagcattctttgtactagatactctttactactgattccattttatagagcagactgagctattgagtgattaatttgcataggttggcctggctagtaaacttcagaacctggccttaatcccaggcattgcagttgcagagcctgcagccctaagcatgatatgatcctgttttttgtagggtaaagggatgctgttattatactctacatattaaaaacacttacacttgatgagtggccttggcaagtgacaacagcataagaggaaagagtgcaggctttacattcaaatagaactggaagtttaaacattttctatttgtaactatatgtcctgacaagtacattgccccttctgagcctcagattctttatctg

SEQ ID NO: 174902 - DNA, 447 bp, Homo sapiens
cacgatgtcagctcactgcaacctctgactcccgggttcaagtgattcttctgcatcagcctccggagtagctgggactacaggcgtgcgcaaccatggctggctaatttttgtatttttagtagagacggggtttcaccatattggtcaggtttgtctcaaactcctgaccttgtgatccgcctgccttggcctcccaaagtgctaggattacaggcgtgaaccactgcacctggccatggtcctttcttagaagcatttttgaacactaggaaggacattgagatgccctgtaacctttcagacaactacacataaaacatgctagatagttgataactcagtttgttaagcactgagtgttctctctgctccacacccagttctctagactctagggatacacagataaataagtatagctcttgttcttgtatgttatcagtg

SEQ ID NO: 174903 - DNA, 374 bp, Homo sapiens
gtgttctcatctttgaaatgaggatgacaccatctaccttgaagacttgtgaggattccatgaccatacatctaaagtgcttagcatggtacctagtgcatacatcaaggaactggtacatgttaactgtaccatcatcacccaccaccagcatccccttccctccttcataccttttaaacactaggaaccatgatcagctaggacttgtttgttacagacatttgtaggcagaaaatctggaagccacctgctaccctctcccacatgaggaacaaaggctgcagagaagccacctgtctctccccatctgcaaccttctgctccctgtgacctcccccgggcccttactcctgctcactgctttactctct

SEQ ID NO: 174904 - DNA, 277 bp, Homo sapiens
acagcttatctgatgggggaaaaaaaaaacccatgcaagatatattcctatatttgggcctttagtgataagttcatgataaaggaaaatacaaatactctctcctcctccatgcccacgaacagcccaagacttggaatcattcttcacagggttcactcactatccagtccaactctcaacctccctaggcctttagcagatccaagaaagatgcaatcctctcaagtttccagaacaatgagaataaaaagaaggctgactagagttgaaaaca

SEQ ID NO: 174905 - DNA, 201 bp, Homo sapiens
cttttgatgtatggtaaatttgtagcttactggtctgtacttttataatatgttgtatatgtttttcttgtagcatatttcaccttatattgaaaatgttcatctttcttagaagactgcttattgagagcagagaccatatgtgctatttaatcatttgtattttttagcacaatgataagcatggtatctattgggtaa

SEQ ID NO: 174906 - DNA, 385 bp, Homo sapiens
aatctaagatttctgtcatgagctagcagaggttctcaaactttgccttgctctcttccatcttcttcttctcctcctcgtgggcagcgctgcccacgaagtgtacctccaaatctacccacccagtagcatttcgggtgatatcaagaagaaacttcagggcaggccccttcccctttttatttaccactaactgaactcctctctctacacgaaagagatcatatggagttctgctcttatcagtttcctagagcttaaggaggcggttttgatgaagtctacctggatagaaaagtgttcatgaggtgagaatttgtttaagtatagtatggtcagtggccaggtgcagtggctcttgcctgtaatctcagcacttcgtgag

SEQ ID NO: 174907 - DNA, 386 bp, Homo sapiens
agaggatccccatgatgtgattgtcattagtgattgttcatgatgtgattgttcatgggcacaattcagtcccccattatctactgattagcaggatatctttagggctcagaaagcaggttttctgtctctaccgatggcttgttttctggctgaagaatgaaggtgttttgatacaaagttattattgttcaattgagaaagtctttgccctcctggcctgaagttccccactggagagaggaagctgataacaatctctggttctttcctagtacctataaagggctcatcctcacttacaatagagcactgtattttcaggacaatgtataattatttgggaagaagccaaaatgatgactagtgcgtaacaatagcatgca

SEQ ID NO: 174908 - DNA, 171 bp, Homo sapiens
ggagtgcagcggtgcaatctcagctcactgcaacctctgcctcctgggttcaagcaattcttgtgtctcagcctcccaagcagttgggatttacaagtcaattcttttttttttttaactaaaactacagaatctatttttcttggtctcatactcaggtttttatgtagg

SEQ ID NO: 174909 - DNA, 317 bp, Homo sapiens
aataaaactggtatacttaaaaaaaaatcagagattgttattttatcattgtacttgtttggcatggctaagatgtgttactggtcactaagggtgaggtttcacttccctaacctgttcttgaaggccttcaacagatcccacttcttgttccactctagtagccacacttctaaaaatgatctgtgcaacatatataatatgcaagctgtagaatgctggctgttaaaaatggggtccattttcaaatacaacatttttctaaaccatgcacaaaagaacagccctacagggacactcttccatactgtatacat

SEQ ID NO: 174910 - DNA, 127 bp, Homo sapiens
ggtctgttgggactgggtggaaagacttagttattaatgtgccacaggaaatgaaacaggattgtaagggtctgaaggcgctgggaacacataaacataaatgtggcctatttgattttgcctgggg

SEQ ID NO: 174911 - DNA, 535 bp, Homo sapiens
ttccctctgtctaaagcatcactctgaattgtcacaggcatggatcacagtccccataggctactgggctatgtatgttaaaataaattcaattagagaagtttagttctttagggtttcgtgggtttttttttttttttttttttgaaatggagtttcgctctgttgcccaggctggagtgcaatggcttgatcacagctccctgcttctgcaacctcctgtgctcaggtgatctgccctccctggtctccccaagtgctgagattacaaacttgagcaacaagattgaaactccatctcaaaagaaaaaatttattgattttgatatttatatacagctttaaaatttatttagctattgtttatttcccatattagtgttttaattaaacactgaatttcccagatagttagaaaatgatcctttggatggcaggtaaaaataagggggtacaaccaaggggaaataggtcgggggttaaactctaaataaacttttgcttataatagctttattgttggtcatgcctcttt

SEQ ID NO: 174912 - DNA, 161 bp, Homo sapiens
tatttatacgttttaaaaactatgtgctatatgaagacaaaatagtaagctgataagaattcatccagctttatccacccaaggatatcaccagtaattcaatcaatcagcacgaagtacaactaaatgaactctgaagaagtactgcaatgcataactat

SEQ ID NO: 174913 - DNA, 535 bp, Homo sapiens
cccagcagtttctggatagaagtgctctggaagaagtgcagtggtgccatctacattcccttgtcttagtgaatttcaggaaaggagtttttcactcacctaggaactatagtcagacaagaggggtgtgtgtgtgtgtgtgtgtgtgttatggtaggacacaagtctccacaaagcccgcaaagttggagtacaaattcttaaaatagtaatactcctgccttaattattacaagtttaaaatgtggtctattagcatgagctctaaagtactgatttttattcctaacaaatggaaatgcctcagtaagttcctttgtcaaataaccttaaaaatacaaactgaaaatattgttttgggaaaataaacccttgttaggctttgacttatcacacagaaagatgcctcttagtgtttaaaatgtcttagttcaccatgagtatgtttttaaaaatattcagtagtttaaaaataaaatgcaattattattctataaactatttagaaactccctgcccagagtgtttcttaaga

SEQ ID NO: 174914 - DNA, 790 bp, Homo sapiens
attcaccaagaattctgagcatagtgggagaggggttcagtgttggtgggcctaggtgatgagagatggtttcctcaggatcaatgaggaagccccagacctgggataagtacctcagatcagaaaccgtacaggatacaggaactcttatgctctgggttgaataccagctaaagatgacatcaaaagcagtccctgaactgtgcccaccatggggtcattcaggcggggtgtgtgccatccatccgaacccaggacagtaggcaggttctgcatctggacacagcttccatctcctctgctgtcaccagaaagcactgactacaagttgtgagcagagagtatgaaagagtcattttgaactataaggtgggttttcaggttctcgcttggtgctgcaattctgggtgcactcggaagacccttgtgcctcacttcctgcctctgtgactatagcgagcctgctggttactgccagctctgagtcccccttgccacacaccccctgggctctatggtgtgtgcctttgatgacagtcgggaagaagaaagtactcattcatcacagcaccccctgaaagactgccaggaacttctgaaataacaatggatagccccaggaatcacagctgcagctggtctctcgatctcactgcctggagttggggccttcagggccgctgtgggcagaccctcctggtcaggtgttgaagaaggacaagcagtggtgagaactcagtttgcagtcagtctgggctccttgtcctggacagaggtaacactaggagtg

SEQ ID NO: 174915 - DNA, 191 bp, Homo sapiens
gccaggagagctgagtctgtgtggactcagcacacccctaggccgtctggctcaaatcccccacacagatcaacgcccacttttctctgccccatcgtccacacagccacggccggtattactttgcacaaacttctgccgtgtttccagataaccattactcaaagctcaaaactaggaagtaaccctga

SEQ ID NO: 174916 - DNA, 189 bp, Homo sapiens
gtccccgagatctccttctgacctactttttcccttttgaaactatctttctttagttcctggtagagtcagcttgttcttcgaaggcaggcattgacttctctatagctatgaaagtcctagatgccatcttcttccagtacaatgctgtttcatctacatggaaaatctatagtttattgtagccac

SEQ ID NO: 174917 - DNA, 601 bp, Homo sapiens
ccacttcggcttcacaaagtgctgggattacaggcatgagccactgtgcctggccaattttttaaatgtttgtatccatcaatcattttttgatattgtagaatgataccgtgtactgctaaataaccatttaacattattagtttgaagccacttaaattatggatttgatgtacttgaagaaaaaaactacattggcatatggataatgattgagtccacaacagaatgaattaactgaaaaaaattttctttactattctaatatggtttagttattcagtaaaaaaaatttctagggtgcagaagattaacttgcattttcccagtaaaagtttgtcttatagttcagaatttaaaataataacaggtgatcctaatttctgtcttgcaagtggtcagactttgtttggtagtttatgtatttttcacttctagaaatgttattgataccaatgtaagcatactctgtttctgaaggaaaaattataggcgctcataaactatattcaaacaaattatgttttcatctttaaaataactctgaaaatttgagttccttcgtagacattagagcctgagtcactgttaatttgtatca

SEQ ID NO: 174918 - DNA, 275 bp, Homo sapiens
gttttgttttttagtatgataaaattatttttaacagcaggaaagcagtctatcaagaaacagccggccgggcacagtggctcatgcctgtaatcccagcactttgggaggccgaggcggtggatcacctgaggtcaggaattcgagaccagcctgaccaacatggagaaacccgtctctactaaaaatacaaagttagccaggtgtggtggcgcatgcctgtaatcccagctactcaggaggctgagacaggagaatcacttgaacctgggagg

SEQ ID NO: 174919 - DNA, 407 bp, Homo sapiens
ggagagggctgaagtacctggaagtggaatgctgctatgacaacaacaacaacaaaaatctaaagtgtgggagtagctttgggaccaagcagagctataggctggaagtcccctcagaagattatgaaggtctaatgggcctcaaagaggctgttaggaggagcctggtgggcctttgagcagatggtcaccggaaggagaactttttattagtggaaagtttaccaatactgctgcatgcaataatatggaaaacagaaaatgtacctagtgaattggatgatctagctaaggagatttccaggcagtgcggatggtgccacctgatttctagctggctgtagtaaaatgtgagaagagagagaaattaaagaactgctaaatatgaaagatgagatttcctggat

SEQ ID NO: 174920 - DNA, 276 bp, Homo sapiens
tcccgctgtgcggcccggttcctaacagggcacgaactggtaccatgggggttttgccattaattcaggggttgagaacccctgagttaaaagacagtgttcaggcagcaaaggagagtaagaaggtgcaggctgagaattaggaaaactggatggaatctgacagagaataagagaattttgaaggagaaattgattaactgtgactaatacagaaaagattgaacaatgactcaaagctctgtgaaggtatctagagttcattagaagatattt

SEQ ID NO: 174921 - DNA, 262 bp, Homo sapiens
tataggttggtgggagctttataatcaagggcctgggtagatgccatctgaatgaatgcacaaaataatcttagcatcactaaaggtgaggaaatccaacattatgtgctccgtaatgtaaaagtagtatgcatcatcatttataaaggatttcacctaaaaaaaaaacacctactgaaccagaatctaattttgccactagcaataaatacagagatggaggaacacatcagcaaaatccataatatgggacattttattg

SEQ ID NO: 174922 - DNA, 640 bp, Homo sapiens
cttgccagtgtaatgccactactataaacataggaggcattaaaaacactgtacattggctcacgcctgtaatcctagcactctgggagacttaacatatgcactaacaactatgaaacaaatagaaaaaaatgttaaggtgacataagaaagttgctgatagagaggcatgagatttcaaagaggggagtaatatatcagctggaaggatcagataaggatatgatggagtactggcttctctattcactggccgtgtgactagacaagtcatttagcttcactgaaactaagttttctatctctaagcgtgtagtaatcatccttctattcctgaatagttgtcgggaggctcaaactgagataatgtatgtgactatcctttgcaaattctaactttctacacacagtatcatagtaaatattgagtatttgaatgagtaagcatttactttagtgaacaccttttcctgagcagttctcttgcttaatgaggtcttttgattttgtaaatatgctacttttttatctgatatttttgtattgttccattttgcagatgatatctaattttattaaattattctgttcctgagaattggcatcctcttcatccacctggggatgaccaggaattttc

SEQ ID NO: 174923 - DNA, 646 bp, Homo sapiens
gcaggagaatcccttgaacccaacagggtggagcttgcagtgagctgagatcctgccactgcactccagcctgggtgacattgtaagactttgtctgaaaaaaaaaaaattattgagggaagagtaaacatcctattcatcttggtttgggatatttcacatgcaggcagcaggatgttgtaggaaaaaaacacactgaacttagaaccagaaggatcagataaggatatgatggagtactggcttctctattcactggccgtgtgactagacaagtcatttagcttcactgaaactaagttttctatctctaagcgtgtagtaatcatccttctattcctgaatagttgtcgggaggctcaaactgagataatgtatgtgactatcctttgcaaattctaactttctacacacagtatcatagtaaatattgagtatttgaatgagtaagcatttactttagtgaacaccttttcctgagcagttctcttgcttaatgaggtcttttgattttgtaaatatgctacttttttatctgatatttttgtattgttccattttgcagatgatatctaattttattaaattattctgttcctgagaattggcatcctcttcatccacctggggatgaccaggaattttc

SEQ ID NO: 174924 - DNA, 659 bp, Homo sapiens
agaccccaatataataaaagctggagacttctacactcactttcagctttggacaggtcatccagacaaaaaaatcaactgataaacatcacacttaatctgcactataggaacaatggacctaatacatcgttacagaacattttctccagtggctgcagaatacacccttttcttctcagcacatacattattctcagtgataacagcacatgttaggactcaaaataatttttaaaaaaattcaaaaagttgaagtaatatctatcgtttctgaccaaaatggaataaaactagaaaacaataacaagaggaactttgaaaactatacaaatgcatgcaaattaaacaatatcttcctgaatgaccagtgggcaaataaagaaattaagaagtaaactgaaaagtttcttgaaacaaatgaaaatgcaacataccaaaatctatggaatatagcaaaagcagtactaagaggaaaatttagagcaataagctacctcaaaaaaatttagaaaaactttaaataagcaacctgattatgtgtcctaaagaaccccaaagcaagagcaaaccacaaaattagtagaagaaaagaaataataaagataacaacagaaataaacttaagacaaaaatacaaaagatccatgaatcagagt

SEQ ID NO: 174925 - DNA, 503 bp, Homo sapiens
accgctgagtggaggaggctgacctttgaggaagcacgtgggatttttccccgcggaacagacgtgagccatgaacacgggagcaaaagtgtgctagagtaactcccgtcaaagagagacccttactagggcaagaagaccttgatcaaagcatacccagatgccgaggttctgaggaaggaaataagtgaccaccaggcatggtgctctgattattaagctagtttctcagctccaaactcaaccttcactgcttagccttgtcacggtgggaaggctgggagaggccaaaccacctttcccctttgccagggctccctgatcagttctgcctatgtgctactaagggaaacagtaaggctggaggagggaaaggggacaccacccttctctttgcgcactgcttatgccagcagcatccgagcaataccgcttgccctgtagtgcttcttgagtcggatttcagttcagtgtctgggttttttaacatttctataaccatt

SEQ ID NO: 174926 - DNA, 1036 bp, Homo sapiens
agtgagaaagaatccctggataagcaaagaaggataggtacggagatgtaatttgatacaggaggcaatggaaaacacgaaagaaggaagtgacatgttgaaagattattttggagagtatttagcagaggagtagtgagtaggaaggcagaggtgtgagcaaaactagggcagactttaaagctgtgaaacccatccatacacttgcataatttaaataattaatgaaccagtaaggtttactgattcctattatatgctcatatacgaaaggagtataaaacatggaccttgtccatatgaaaaggggaggaaaggatatcacagggaaggaagcataatgagtaatgtcccaaaggacagagtgagattagttttgtgagtaaaataaattatactgtctaataaatatctaatacttcctataatctgtgttcttacagaaataataatagagtttaagacaatctttcaggcttatcagttatgaaactaacaatgatgggtttactctcactaaatataaaatacctgaatcctacatcctttcataacaacagttatcaagttaaagtcaggtaaagtgtggttacatgtggaaactggttccagagctggtctccaggcgtcggtggtcaccctccaactttctgctgtgggacccaggattctcagtgaaattctgcctggagtaccagcagggcaccatgctggtgtcgaagctgtcatgggaattccttacattgacaaactcaccaagtagcagatatcctgtctccctagagctcttcctgtattaactcctttaatccttacagtcacctagtaccctctccaatatcatcgtcttttaaaggttaagtggtttaagcagaggagataagtaactggcttgaggtcacacacctcctgggagaatagagacagaatactgggccttggaatctaaaaacactactcctttactccttttctctcccattcctccaccccagcctgggtgcacctttggcagccagatgtcctgctggttgct

SEQ ID NO: 174927 - DNA, 368 bp, Homo sapiens
gtctaatacaaggcacgtcctatatgcccctgtccctggccatgggcctctgctacaccagagaaacaggagcctatgaatgtaggggccgagctggcatcctcctggccatctaatgccaaggcaggctcatacctgggatatcagcctggtgagcccagcctgtcttagagctaggcaattgtctggacattgcaatgttgtgggttgggggcagcaggatgcttggtatctccagctacagaatgttggaaggaggtctgatggggagcaaaataagctcataaaggctcaccgagggcccatcgttgtagcataagcagtgattcctggggataggaacagcagccagtccagctggcatggat

SEQ ID NO: 174928 - DNA, 431 bp, Homo sapiens
ggggtcatgctacaacccaacagaaaggagaagttagagaagtaacaaaaagaaggttttgagaggggacttgcagtgtttgaggtcagggaacaggagatgactcaggaatgcatctggaccaggtaaagtgaccagcccttacttttagttcaaaattggcatgtgacgtgtggagacggccccagccaccaacctacattcaccccctcatcacagaggggcaggctgaaacagaggacacaggttggccctggtcaaatgacaatggtttcctttagctccgtccagaaggggaaacaagatttctttgccaaagtagaaaccatgggattgccagttttattatctgggaaggatgaaatatgctttctgagcactgtagcactatcatgaacatccagctttcttctcactaaccttaaccgggc

SEQ ID NO: 174929 - DNA, 581 bp, Homo sapiens
cttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaa

SEQ ID NO: 174930 - DNA, 1535 bp, Homo sapiens
cttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcgtaacttcaaatgagcatttttcaactgcagaagaaagtgagtcctgctttgcccaaccaaagccacatgcactgggaagagaatctactgttgatggcaatgtacaaagggaaagccgtcctcccttacaaaagctcaaggtttcagcagagcctacagctaatggtgttaaacccctccaagaacagcccctggccaaggacgtagcccctggaagggatgccacagaccaatcagggtccacagaaaagactcagcctggagagggactggaggaatctgggccgcctcaaccaggtggcaaagaggatgccccagcagcagaaggaaagaagaaagatgcaggagcagggacagaggccgagtctctaaaaggaaatgctgaagctcagcctttaggaccagaagccaagggtcagcctttgcaggcagcagtagagaaggactctctcagagcagtggaggtcactgagaatccacaaactgctgcagagatgaagcctctaggaacaactgagaacgttctgactctgcaaatagctggagagctacaacctcagggcacagtgggaaaggatgagcaggccccgcttctagaaacaatttccaaagagaatgaatctccagaaatattggaaggaagtcagtttgtggaaacagctgaagagcagcaacttcaggcaacattgggaaaagaggagcagccccagcttctagaaagaattcccaaagagaatgtaacaccagaagtattggacagaagtcagcttgtggaaaagcctgttatgaatgatccattccataaaactcctgaaggtccaggaaacatggagcagattcaacctgaaggaatagttggaagcatggagcatccagcacgaaatgtagaggcaggagcatatgtggaaatgatcaggaacatccatactaatgaagaggaccaacgcattgaaggtgagacaggggaaaaggtggaaacagacatggagaatgagaaagtgagtgaaggggctgaaaccaaagaagaagaaacaggagaagtggtggacctttcagcagccacatagatagaagagtgaaccgacacagtgtgttatcatagaggagacaaaaatggtagtgaagcttgtggttatgtatcttatctttctacatttacatgttttctgtaaggagtgtggttatagagagactgttggaaccatgagaaggatgtttctgtgttcttgattatattgttctgcaaaactgctaagccatgaacagttttcttagctacttagaatggttatacatttaaaagtataaaaaccaaagccaataaaaatgatgtgattatttaa

SEQ ID NO: 174931 - DNA, 494 bp, Homo sapiens
gcttcatattttctatttgattcctctttgtcttcattgatattctctttgttgagacattgttctcatttcctttagttctttatccatggtttcctttagctctttgagcacatttaaaacagttgatttaaagcttttgcctagtaagtctactgtgtgttcttcctaagggacaatttctatttatttctctcctctaacccatgaatgggccatactttcttgtttcttttcatgcctcataatgttatgttaaaattttgacattttgaatattatgatgtgataactctggacatcagattttcctccccttctctagggtttgtagttactgcttgttgtaagttaaagttgttggtttatttagtgacttttctaaattatgtttgtaacgactgtactctttgttgttgtgtgatatttctgttcctttagcttagtagctggctacttgtttgatagagattttcttaaatgcctggggccga

SEQ ID NO: 174932 - DNA, 929 bp, Homo sapiens
ttaacttgatcagggctaagattgttcctcaatcagatgttttcaaaacaaaggtgtctagggggtgttatttctcttcacaaaattaatagctctgggaacaaaaaatttgtgtagaactgtagcacttacgaggataggaaactcataacactctggccatactaagagagatttgatgctcttatatgagcaaacagatttaataaacagcgattctaatagttttctaatgtggcagtgtttttatcaactaaaacattgattctcttcactttagtttgggaaggaaaaaagcattaagcttctgtacctaaaatatgttattaaatatgttgtttacttaacagaaaccagtgaggtatcttagtccagctttgttgtgtaaataaagaagttgaatattaatgaggataaatgacttgtcttggctcacacaacttatagatcctgattttggacccagatattcctgcaaaagtctctttggttttgttgttgttgttgttgtgtttttgacacagtcttgctctgtcgccaggctggagcaagtggcatgatcttggctcactgtaacctccgactccctgattctagtgattctcctgcctcagcctcctgagtagctgggattacaggcacgagccaccatgcccagttaatttttgtatttttagtagagacagggtttcaccatgttggccaggatggtcttgatctcctgacctcatgatccacccgccttggcctcccaaagtgctgggattacaggcgtgagccaccgtgcctggccaaggctctttgtttttgatcagaggttgttaatttgggttccctggtctccaacatttccctcacttcccccagtgtatatattcttttcaaataactggatttactggattaaggaatacaataaagttaagaat

SEQ ID NO: 174933 - DNA, 518 bp, Homo sapiens
taacgaaggcaggaattcaggtcaaatggttatctccgatgatgagattgaacagtattattgtgataattccaacttcattttggcctttcacttatgcattatatgataaattgatactgccgacatggggaagtcttgaaagtattgtagtaccatgttctccccacttataacctgaatcacagtactggtgaccacatttataaagtcacatgttatgttgatgcatgaaagttggtaaaacacaaaattgtttttctaaactatgttatagtgttttatcacattttgtttcttaggcctagatgtccacatttaagtaggtttcagtttgcttctcttcataatataataaatctccccccaaaagtgtttggatttccaatataattcatgctggaatgcttgacactttgagtgttaactgtttgagtctttaatcatctgtgtttgatattgtagagtttatgtaatcctcttagaaagaagctcttactatcacggaagtatgtagt

SEQ ID NO: 174934 - DNA, 462 bp, Homo sapiens
gtgtcaggacaggccctgtgaggaaagtgggtgccagatgccacacgtgagagacggggcgccctgctccaggtggtgggtgtgcagtgaggatggcctgccccacgcgcgcagagcgtcagaaagaggaaagaaaacgcagctggcagttacagacagattttctttagttaaaacctgagaggcacccccagccgattgcggtcaggagcactttatcttacagactgaatgttggttttaggatgagagggcttatcagaagctcggaatgtttatgtgtgtggagaagtttatggcagggttggaaggagggaaggttatcttggggcaggcatcttttcagcctggaggtgggttttctcgaagctggcatcttcccggctggagaagggttatcttggggctagcatgtctctggttggggaggagtttggaatgtttctggttggagatgttatt

SEQ ID NO: 174935 - DNA, 593 bp, Homo sapiens
gaaggattcccctttaggcataaggggcagtggatagcttattcaggggtgagcagactgttctgtgccagctggccctaatgagcagtcttcggggtgtcccatctcatccaaatgtatgacacagctggtctatacaacacacaccccactggaatgtatttgaattccttggaattgagctaacatggccctctggcaaactatgagtcttaaaaatgcagatttttgcagcaagtcatctttctgagtagctcagagctaaggtggctaatgaggatataggtctgaatcctctttgattttgttagcttcttacatcttggcagtgcaccagacacaccagagaactcagttgtgaaaatgggcattaaaagcgtaaatctatccccactgttggaaaaataactcaaaacatgtgctttagagttgtcagtatagggactttcaaaagatagtatgttactgtatctcaagccagaagagggacttgggaatgtctgccctggccataaccattgactcactccaagagataactgagctccagagacttatccaaggccacatagacaacagtggaacctagcaca

SEQ ID NO: 174936 - DNA, 321 bp, Homo sapiens
gggaatccttcagaagggaacctgcatttattgagcatcacctgtgtgtcgggtgccaggttaggagctctaggcaggtggttcccccagaatccttaggaagtgaacactgttatccccactgttggaaaaataactcaaaacatgtgctttagagttgtcagtatagggactttcaaaagatagtatgttactgtatctcaagccagaagagggacttgggaatgtctgccctggccataaccattgactcactccaagagataactgagctccagagacttatccaaggccacatagacaacagtggaacctagcaca

SEQ ID NO: 174937 - DNA, 454 bp, Homo sapiens
ggcacaaagcctggactggtggagggcacacccacctccctgctcctgctaggcctcctccctgcccttgtcccacagggggctgggggactgccttcatggggtggagatgcggaggaggctggaggggctcttggagctgcagaggggcgattttgttggaagggagataaacagaaacatcaaaaggagccctagtgtgtgtggagaggagcctgtggattaaattctcctccagctgagagaggcgatgagaaggctgatagcgcccaccgcgggtcccggagccagagcccagccactacaggctgcggagctggcagctgcccgcggggaggccgaggtgacagcttagctttatttatttcttgggaggggaaggacacatgaaatccctcctggctccctgccggtccctccccgtgtagctcctgcactttgctcctagggctgc

SEQ ID NO: 174938 - DNA, 280 bp, Homo sapiens
aaatagccgtgggaggagactctaggtgcagagaatgggagaagtaatggcccagggagtgttctcacaacagtgggcagtggagactggcaggagcatagaggtataaaggaaaccaggaaataactacggctggaaaaccaagtcaaagccccattgcagaatctttggtgccttgctaagtattcccaacaatagagggcattgaaggacttggaggaggagactggtttgactcctgctgtgacttgggaagttccccctaacagcagtgtgcaca

SEQ ID NO: 174939 - DNA, 165 bp, Homo sapiens
ttgtgattagactgaggaaattctgagacatgaaatgagtttagtgaattctgacgtcagcctgggatttagcagtagagctgcttttcaccatccagtgtgcctgtactccatcaaagatcctttataacttttctctaaattctcaaattagctttcctcaga

SEQ ID NO: 174940 - DNA, 123 bp, Homo sapiens
tgcaaagatgctctcaaggcagcccagtgagggaagcagataagtgtccagataatgatggcacctgacagaaaataaactgagtccggccgggcgtggtggatcacacctgtaatcccagca

SEQ ID NO: 174941 - DNA, 812 bp, Homo sapiens
tgtgaagagcacgctggctgagctggcgagaggggtgggggcgtcctggggctgcttctgctctgatgaaggcacccactgtcactgtcccggccctcgctgagtgttcccggacccgtgggcccgcgtctgtgccaggccttggggagctccagcctcggagcctcttcccgttctcagacctcagtgcgaggaggaaatcgggtggctagtggggcactacctgtctggaagtattttacacgaagtttaagccttgagatttcctggagcaggacctctgaagtcaccatcacaaatggcaggcccacacaaggactgatttacttctgactcacccatggccttcaggcttagagttggggccttgtcggattcctctctcttaccaactctgggctttgactctgttgtccctaatgccatgctgataaataattaataactggctcttcataaaaaaaaacagttttgatctgtagcacctgccaattcccatggtgtaaacactcctgccatggctgacttcaagttaccaacacaacatcactgagtgtgggattggaaaaagatgcccatggctggctcttaagagtcctctgagccttgctggttctccctcacctgccattgagggggctgatgggtgcaacagtcattcctgaggctgcaaagttctttaaagcagaagcagctgactcttgcttatgttttgcagtacttgctgggctctcaactcctccaaggttttggcctggtagtgcattctttgctacctgatttgctcttttctgctttaaagaagattggaa

SEQ ID NO: 174942 - DNA, 340 bp, Homo sapiens
ctctttttctaggagcagcactttttatttttgaaattatcctacaatgaattaccggcttttcttctgttctcatctttttccttccccaacatacacacactgtaaatatgtgccatgttcttaggcaatcccactttctcaacctttgttgagtgacccaagcaaggttaaattcgagttctccccaacgagttttcccagctgcaattgaagaagagatacagtccatctctgtggtggaaactccaggttgtgaaactcaagatcaatcagcaatagaacctctggagcagctgctgggtgatgagaagaagcaggcagaagaaatggacagaat

SEQ ID NO: 174943 - DNA, 493 bp, Homo sapiens
tctgttttcttgagttgatggttgtatgctgtcatcagtcctatgaagagtgaatgcctcaatgcaaagaatttaaagaaacatctgttctttcaacctgcgtcattcctgaatagaaccacctctgttaagatgttgtgaaaatagtgactgctacttttttaccactaagatccagtcactttacatacatgacctcattcagtcctcacacctgacctataaagcaggtggttagtacccacattgtatattagtagaaaccaagactcaggaaagtgaaacaaacttatcaaaggttgttcaactaataagcagaagaaagtgggatcagaatccaggtgttcctttacttcaagcctcaggtgcttcctcctctgcgataccacctgtttttcattgttttacagtgtgtcaaaagatatgctttatgctaccttgaatttatgggccaactatagagtctctttcccaaattctctgactcccttcc

SEQ ID NO: 174944 - DNA, 416 bp, Homo sapiens
ggttagacagggaacagcacacacacatccagatgtaattcaagtatcatctggggaaatacactaaagcctaatggggaaaccccattgaatggagcaagactttctctctgttaggggtaagacaatcctgagcaggacagacacacatgcttgggtgtggaattctgatatccctcactgtccctgctggaggattatagaattctggtgacatcctgccctgaggatccaggatatgttttggtaaatgtgggattccggtgagttcattctgggctaacacatgatgactgccctttcaagtgtcattccaggaagacatggttaaaagcaaaacacgactgaggcaggagcactggttgaccacaatgaacaattctctctggcaactgctgctacccaaccaaagatca

SEQ ID NO: 174945 - DNA, 317 bp, Homo sapiens
ggcaggagggagggataaagggagggaggaagggcagaagggaagaaagaaaccaggaggaatggtggcaggagaggagggggtttcaaggaggttgtcggccagtgtcgctcacatgcctggagctcaagccaccgcgccagctctgtagaggcaggagtaacgcctgtggccttggaggctgccccgcagtcctcttggttcaccactagtgtgtgtctctcatgcttcgagtgagtggtgtggaacggagcctagcgttgaatcaggacatggaggagcaagagccgctggggggatcctgtgcccgagaaacc

SEQ ID NO: 174946 - DNA, 673 bp, Homo sapiens
gagtaacagaatctcaaatcagaatggtagtaatgaaatattctttttactttcaaagcaatattctaatagacaagataccatatttttacctcatgtttttcctttagaatatacttatcctcaagttaaaattttatcccctttacataacaagattttagaaaatctaggccagtttgaactcccatgacgtgctttgagccatccatggctgtacattcccagattttagtgcaaagcctttcccaccaatttggaatgaactgatcattgtaaccagctttgtatgaaacacttgtttcggatcccagcgctgtagtgatgtcattttctttatacccaaagtaaatgctatgcagagtagcttattctggaatttggctgtacgattcttctcttggttaaaatcttccatagcagaggagccctgctaagtgaacagtctctcttacacattggtttttgtgcttctaactaacttttctaataatcttatttttccctgagaaagcaatccatcctatttaatgtggagtaggggttgtggttggaaatgaaaacaaatccagtatgttctagtctgatttttttttcttttttagcatcagtgtgttttcagtagaagtgattcaatcttaatgtggtttgggctcaagggtagagaacaata

SEQ ID NO: 174947 - DNA, 428 bp, Homo sapiens
ggagtttgagaccaacgtggccaacatggtgaaaccccatctctactaaaaatacaaaaaaaaaaaaaaaaaatagaaaaaaatcccgggtgtggtcgtgggcatgggcacctgtaatcccagctactcaggaggctgagacagaagaatcacttgagcccaggaggcagaggttgcagtgagcagagattgcgccattgcactccagcctgggcgacaaagcgagactccatctcaaaaaaaactaagtgccctcttggcaatctttcacatcctctcatggcatctgatccagaaggctcaaacctgatctgagtactagtgtgttcctcctactcacttctgtttctattaactaataagtgtagtaatgaaagccagtattagggacaaattttacatgactttcttctcaaacctggaccttt

SEQ ID NO: 174948 - DNA, 486 bp, Homo sapiens
ggagtttgagaccaacgtggccaacatggtgaaaccccatctctactaaaaatacaaaaaaaaaaaaaaaaaatagaaaaaaatcccgggtgtggtcgtgggcatgggcacctgtaatcccagctactcaggaggctgagacagaagaatcacttgagcccaggaggcagaggttgcagtgagcagagattgcgccattgcactccagcctgggcgacaaagcgagactccatctcaaaaaaaacaaaaaaattagcatttacggaattctgaaattttgggctattaaatttctacatcatctaagtgccctcttggcaatctttcacatcctctcatggcatctgatccagaaggctcaaacctgatctgagtactagtgtgttcctcctactcacttctgtttctattaactaataagtgtagtaatgaaagccagtattagggacaaattttacatgactttcttctcaaacctggaccttt

SEQ ID NO: 174949 - DNA, 416 bp, Homo sapiens
ggaaattgtgaaggatggaagactacaggatttgggttactggctttgtatcagttttttaaattgctgtcataagaaattaccacaaatttagcagcttaaaacaatacctatgtattatctcacagcgtgtctcatctagattccctgcttagaatctcagaaggttaaaatcaaggtgtcaatggggctccattcccttctggaagatttgtgaatgcatccgcttctaagtgcacacaggctgtgggttaaagtcaattctttgaggctgcagcactgaggttcccatttccttactagctgtcagccagggcgagtctttactcctagatgctacacacgtttcttctcaagcgttccatctggaccccttccagtgacagcaggttgaattcctctcatgctttgattct

SEQ ID NO: 174950 - DNA, 457 bp, Homo sapiens
acagtcttagacaaaaacatttgcagcctgctctttcaaagggcagaagaattgtattcttgcagacattatttgcttaaaattcttaatttcttatttttcatatggtctttctttctgcattgggagagaagatgctccctttatatatggttctctattcttactacaacttcactttcacaagcttatgagtgtcctcctccgtaaatcttctgctctattctttacactttccactctgctaaggaacagtatttatgatactattactcaatcattacatttaaactccacaaccattcacaaaatagttggaatacataaaccttagaaccacagtcatctatctgtcttttctttttttttttaaagacggggtcccgatctgtcaccaaggctggagtgcagtggcgttcctgcttcagcctgctgggtagctgggaccacaggcatg

SEQ ID NO: 174951 - DNA, 233 bp, Homo sapiens
atctgtgatgttctcaacgtcaccatggggccagggctctgacccactaacacagacctgattctgatctgggaactccaaagccaggcagagacaaatatgaatctgctagaccagcatgaaaaaaacaaaaatcacaaaaagaaagagagagacataagagcaaaaaaacttccatcagaatgtgcctgcaaattacagaacatgatgaaaatatcaacaatcaaaacata

SEQ ID NO: 174952 - DNA, 155 bp, Homo sapiens
tatgattcatgttgaatatttatggaagagaagtgtttctacaaatatgtaaaaatattggtgagtgaaagaaatggctcccagtatgacagaagaaaatatcctaaagagatccacagttatctgcagtttccccaaggttgtgtttacataaa

SEQ ID NO: 174953 - DNA, 225 bp, Homo sapiens
ccaaagtgctgggattactggtgtgagccactgcacctggccaaggacctagctgttttattggaggatctcaaatatcagtgtctgtagaatttctccagagatcttctattctctggctagaggacagggaagtataatgtgtctgtctaccaactttctagaaactgaacaagggaaaagggctaggaattttctctaactataaaaataaaggtatccaga

SEQ ID NO: 174954 - DNA, 351 bp, Homo sapiens
tgacgttgataacctggctgatgtagcatttgccaagttctccactgtaaagttattcttttccccattttcttactgaacattttggaaggaagtactatgtgcagccctcactaaaagaatgaggagttatgctccacctccctgagactagaatatctatgtaatttttttggaacttttctgccaggaagatttctctattttctccaagttatttatttatttaatcatatgtttatattagtgtagacttctgtatttttgttttatagtttgtgttattatccagtactgttttatttattttgttgctcagattctttcagctttggctattggtaattcttt

SEQ ID NO: 174955 - DNA, 133 bp, Homo sapiens
atggagaaaaggagaagagcttaggtcatagtgcatcagaactgatggcaacaggaagcgctctggttctgtggctttcaaacatttacagaagttaatccatttttcaatgtatggtaggcagaataatggg

SEQ ID NO: 174956 - DNA, 131 bp, Homo sapiens
tagatgaatatgtggttactgctcatcggcctaaccactttaatgtggaatacactgggctataccgtactctacatttacagtcctttcactatcctaaagaaacagtatgcctatcttctaaatctact

SEQ ID NO: 174957 - DNA, 431 bp, Homo sapiens
gagacaatatctcactctgtcacccagcctggagtgcagtggcgtgatctcgactcactacaacctgtgcctcccaggttcaagcgattctcttgcctcactcagcctcccgagtagctggattacaggcgtgcaccaccacatccagctaattttgtatttttagtagagacagggttttaccaagttggccaggctggtctcgaactcctgacctctagtgatctgcctgccttggcctcccaaagtcctgggattacaggcgtgagccaccacgccaggcctcctcaccttctctaagcctcagtttcctgctctttgatggaggccatcgtgtctcccccacccccatagtgagctgtgcgagtagaaagccccagcatggtacctgacaccgcagaggtgtgcagtggagctgaagcgggagtctt

SEQ ID NO: 174958 - DNA, 212 bp, Homo sapiens
tacacagcgtagggtacatacggtactcaacacatcttagtctgcttcctatctcatacccgtccttcctttaaaggagattcctttgacataatccaaaaggcatggttccataacgatcacatgaaagttttaagggaaatgtataggtttccatgatgaattaactgctgtgtcactactctgtgctgggtaagaaaaaggaaaacaat

SEQ ID NO: 174959 - DNA, 483 bp, Homo sapiens
ttgctacagaactaccagctcaagtttgagtggggaacaaccatgtatcttcctcagaatgtaaaaactatgccaaaaaaggaacaaaacggagttatgccagaacaactattctatggctgtgctgtcccatatggtagatactactcatgtgtagctattgagcacttgaagtatggcaaggcaaaatcaagatatgctataaatgctgggcacggtggctcacgcctgtaatcccaacactttgggaagccaaggtgggtggatcacctgaggtcaggagttcaagatcagcctggccgacatggtgaaaccccatctctactaaaaattagcagggtgtgtagtggcaggcgcctgtaatcccagctacttgggaggctgaggcaggagaatcccttgaacccgggaggcagaggttgcagtgagccgagatcacgccactgcactccagcctggatgacagagagagacactgtcttt

SEQ ID NO: 174960 - DNA, 478 bp, Homo sapiens
  misc_feature (19)..(19): n is a, c, g, or t
  misc_feature (21)..(21): n is a, c, g, or t
tgggtgactctacaggatntntgtggctacctgctggagggagtcactgtgcccgcccagaaacacccttctgcatggattactttgtgtgttgtgtctcccttacttgaaggatgcacaattaccatcttggccacaggacaacagcagcacctactctggggttgcagtttagatgctgaggtgtcctcggaagactgaggggctggggcaaatgtgaggatgttcccacatttctcctggaaatttcaactctaattgatctaaacttcctgtggcaatttgttttagtcaaaataagaggagaaggcctccctaaggtcagaaaagccctacagaccagaccctgcatcttcagccagtcctgaggcatctccatttttgtcatctgtgtgaactgcctcactccagctcccaggtcttccatgctctgcacatcaccaggacccagtttggccattatgggcagggactttgc

SEQ ID NO: 174961 - DNA, 297 bp, Homo sapiens
tgtaaagatcaattgttattgtcaatacttgagttgtgctttcagctagattctaagctctttgaaaagtagttcttttgtcttaaagctgtatacctactagctgaaaaaacgaggtttcaatagcttttgaataaatgaataattttaaacctagaaagttcttttttaagagatttaataaatttttcatacagttattaaggcccaatattttatttaactgtttaatatatttagaatttatttgggaccatggtgtaagatggagatctaacttccttttttttttttttt

SEQ ID NO: 174962 - DNA, 558 bp, Homo sapiens
ggtgattcaaatgttggctttcacagtggttggctgactgttcaacacaggaactagtgcaaaattggtaactaacaaatgcttggatggttaatcacagggtcagttggttgaagagagtccttacttttctttctttcttttttttttttttgagacagtctcgctctcgctctgtccccaggctggagtgcagtggcaccatctcagctcactgcaacctccactcactgcaacctctgcctcctgggttcaagtgattctcctgccacagcctcccgagtagctgggactagaggtgcatactaccacgcccagctaatttttgtatttttagtagagacaagtttggccaggatggtcttgaactcttgacctccagtgatctgtcggcctcaccctcccaaagtgctgagattacaagtgtgagccaccgtgctcagccgggtccttactttttgagctgagtccatctgccccatgcaatgtattcagagccaaaattccaacgcaccaccattccctggcaggatgtgagatcaacattctgcagctacc

SEQ ID NO: 174963 - DNA, 287 bp, Homo sapiens
tgaatcacaaggaggtgatgaactaatgaacatccagaactccaacaggagacaatgtcagaaggattaacaaatctgaccttgaccctgggcaacatagtgagaccctgtctttacaaacagttttttaaaacttagctggatgtggtggtgtgcgcttgtggttccagctattccggaggctaaagtgggaggttcgcttgagcccaggagttagaggatgcagtgagccatgatcacaccactgcactccagccctggcaacagagcgagaccctgtctcttta

SEQ ID NO: 174964 - DNA, 353 bp, Homo sapiens
ctgtttcctatagaatcgagcggagtacccatcgtcgattcactgcaacacagactgaatctgcagccaagctccgctctctcactactgggaaccctcaggggggatcccttagcctaaatcagcaccagtcactacccgcacacgatgttattactactgttttcttatgagtcagcccgtgtcactgattcctgacgagctggtgtggagagcagaaatgaatgattttttttttaactgcaatttccttctcaccaaccagtcagcaatcggagctctaacagtaaaccgattgctcagttactccacgtgggtgccacgcaagaggctgggagtattgctcagcgggg

SEQ ID NO: 174965 - DNA, 465 bp, Homo sapiens
tctccacctctattcctctgctgatgctggtccctccacctcacatgacctcttgacccacaggtatgctgtccaaccttcttagctcaccaaacacagcaactcttccatggactgtccctatctgcaacacccatgcccctcctatcagctcccatggcaccgctggtcctccttgaggtctttaaggcattcatccacttattgaaaccataaatactgggctattagtgatatttaaggtagtgttctaggtgccaaggacacaactaagtacagactacacattaacctctatcttcacggagctttcactttagtggaaggagaacaaaaacagacaaaatgagtgaatgaagatgggatcttagtaatggctaaggacagataaaatgctgggagggccagggctgccatcttccatggacactcagaggaggcatcactgagggggcactgtgcaag

SEQ ID NO: 174966 - DNA, 154 bp, Homo sapiens
atttttaccagatttttaatgttttcttttaatttgagttttaattctgaatattagtcttagccatttgaacttgaactgtaggatgctgctgtaaacatttctgcagtggagagatctcaaagtgtatttctgctatattctgagtagcaga

SEQ ID NO: 174967 - DNA, 190 bp, Homo sapiens
ccagccagtcaactgattatggagggactgggaggggtaccaggggctgtgactcccactgacgtatctgtccatgacccaacactgctgctcaattgacacttcagaaagtctgtgctttcctaagatgaagcaggcggcctcacagtctttgagcccttagatcatcatgcatctgtcttgtgacaca

SEQ ID NO: 174968 - DNA, 1511 bp, Homo sapiens
tgtttttgaatattctttagtcttttcaaaacaattttatttaattagttttaatagttaacatagttttgttcctctagactacccttcagtatttttcaaaccagtaaagtttgatattttaattaattcactcaaaaattagttgagtgcctgctgtgtcatatagtgctctgatagttagggatgtattttgaacaagatgcaggccctgccctcattaagagacgtcaaatagtaaacatgtaaacaaatggtttagataccaataagtactagtcaggtagcggatcatagtaatctggtaatggttaacctaaagaagaatgggcccatggtctggaaaagtctctctggagaagcaatatttgaattgggaactggtgaggaaggatgagggagaggttaccacacctagaatctgaagacaagagtcttgtaggcaaaggaatgtgaaacacctgagatgggaacagcttgacctgatccaggaaaagtacgatagctagacagggccagatacctagggctgcatagattttgttctaattctaatataaggccatgacagcattttaattgggaaataataagattataaagatcaccctaactattatatggagattgaactatagggagacacttggggaaggaggatggtcatttaaacttccataaacctgccttttaagaaatgtttgtagtaatatatgctgaattttatttaatcatatttgcttcaatatatatttcacttgtcccagatcagcaaaagtgagggttctttagaaaaattcaaatctatttaatatatttatcttatttgtgacctacattatgaaataaatattagtatcttttgatagcttaaatttaggcagtgcttagttacttataaataagtgataaattctatggctaatctctggcaggcttaagtgttctggctgttgtcctacatattacaacatttaatatatccaaatttagtaacctaatgaaatcataattaggaagctattgcctcagataatcctatcacatattcaaaagaaaatggtaaaatcccttttgtttggtgtgctttgtcgaatactttctaccattgctcttatcacagcaaacataatcttgtatttagtattttagcaacagcattttatctgaaactctttacttaaactctttactctgtatttaagattaaatccttaaatacagacattctgggttggtcctgtctatcagtttctgaaaataaaaagccatgtattcaagtaattgagcatcttctacaaacaaagagtttgtatttctactttgaatgtcagtttgtcatcatgaagcattggtggcattacattatcaattatttgaaactaagacagttcagtgttcatgcagatattaatagaatattttacatttcaactttattatcaccaacaggcaaatgtttgataaagagaacttgaaaatgcttcttttcctctggtccaacatacgct

SEQ ID NO: 174969 - DNA, 501 bp, Homo sapiens
aatgtcttccctgtgatgacatctcctcagtttcaggatggggcatcagtgccgtttttctctccactgcctggcaaatctttctctccaagtctttttcctcaatgaactgaaggctccttgagggaaggacttggtcacgttcatccaaacccctggatggtgtctgttatagagttgggccttaaatacttgctccattgaatttgaattgaacttaaaatattatggcagtcctggtaaagtggcttgcacctgcaatcccagcattttggaagtctaaggtgggtggatcacctgaggtcaggagttcaagaccagcctggccaacatggcaaaaccctgtctctactaaaaatacaaaaattaactgggcatggtggcagacgcctgtaatccaagttactcaggaagctgaggcaggagaatcacttgaacccaagaggtggaggttgcagtgagccgagatcgtgccattgcactctagcctgggcaacaaga

SEQ ID NO: 174970 - DNA, 342 bp, Homo sapiens
aaaaaagtccaatgaccaattttgtcaaattacatttaacaacagtgatttctaaactccctaataagtggcccttgtttctggagtccaaagacataaagaaaaatataaagcatggttcctaccctcaaggagtgatatggtttgtctgtgtccccacccaaatctcattttgaattgtagttttcataatccccacatgtcatgggagggatctggtgggaggtaattgaatcatagggatggttaccctcatgctattctcgtgatagtgagtgagttctcaagagatctgatggttttataaggggcttttccccttttgcttggcacttctccttg

SEQ ID NO: 174971 - DNA, 273 bp, Homo sapiens
cactctatctagtcacatatgcctaaacctgggaactgtcttaatattcttttatatacacctgttctgacctccccccaaaactagtaaatttctaagacctgtccttctgaatgtctcttacaattttccctgtgatctcagtttcttcctcccatccctcaaatgctttgtgtgtgtgtgtggtgggggaagagagtaaaattgaaatttgtggaaaacgtactagcctgtctgtctgtctttcgaggtgaagtctccctcttgtcccct

SEQ ID NO: 174972 - DNA, 301 bp, Homo sapiens
gaggcacatagcaatggtagcaatcataggaatggcaatgggtatggtactcatttggtggtggaggatgataagtctttctattaccttgcctcttttaaagtcacaaatatcaaatataaagaaaattatggcataagatcttcaagagagtttatagaaaggagtcatcagattgaaagaatgatgtctaggatatttcgacattcttctgtaggcggtcgatttatcaaatctcatgttatcaaattaagtccagatgaacaaggtgtggatattcttatagtgctcatatttcgat

SEQ ID NO: 174973 - DNA, 339 bp, Homo sapiens
acagtacccagtcttcctcaattctatttgttattttaaaacaatactcagttttcctcaattctttccaatatttttttaaattatggaaaaactgaagaagtttcaaagaaaaaccaagaggtaaagaataggatggaaaagaggtaattttgaagaatggtttgaaatcaaatgaagtgtgacatgactattaacactgaaatatccatggggaggcttttgaatggagaccctgaaaagctgatgtatctctcaatgcccacagatgactcaccaagaagagagggctaacaaaaccctcaaagtttgttgttttacagaagagagatttcttta

SEQ ID NO: 174974 - DNA, 604 bp, Homo sapiens
gacacagttgtccaaactactttaaaaaacaatagattcagttttatactcattcacttaaagggtagggtagatacttgtcaaatgtggttttgagggtttacactggaaagaaaaatctcatcaaaaatatgaagcaaggcctcccttctcttttcattctcatttggaagaaaggggagaacatcttattttagtcttttttaaagagcataacttattcaaaggctttgttacactctgcaggacactacccgtatttaagttaaaaaaaaggattcatgagtgagccagcaatcaacaagtatttactgaagcctcatataccagaaagttcaaagtgctagtttaaatggtcttcctaaggtatttaacaaagtcatgtcacaaaatacattgtagaagataaacatttatcagtgagtcatcacagaccacaagtgcccttacaacagagtggacgtatgtgcttcattttctgatatattagtaaatctgagaaatattgtccaggttgtataggatgtacagtattttcattgtctttaagtgccagcggactacagatggctctcagatccccttggatcacttctgtgtggtt

SEQ ID NO: 174975 - DNA, 963 bp, Homo sapiens
ctaaattatgcagtgccaaaagtgacaactcttatacctacaccatcccgtctacagcggcatgattttagctttatagctaaaaaacgctgccagaaaacctaataaaaggaagcaaaaatatttctgtttatatcaagctgccatttgagaaagattttaaaatatgttctttcctatgtgtaaatctgacagcagatgcataattaaaaccccagtggagagtttccatttaatcttttcaaagttaactgataaacatcctttaggatgtgaagtgatgggttaattctgtttggattgtttggaatatctctgagctggaatactgtcttcaagaatattgtttcgtgctaaaagaacacaagacagttatctttatctttaggagttcatacaatcacaggaagtgcagacaacatgccaaaggccacacatgcatctatgatgagtgatgcttgtcttagatgttttttaattggcagaatgaataaatggatacattcacattaaaacaaacttgatttcaacccccagggaatatgtcacatagcataaatgggagaaataataattacccaggatttcagttcagtgtaagcaatcggtatgaataatttagaccacaaagtggatttttatttcgcttgagctattcagattgactttctacacagcctgaacggctgctgaataatcacaggcaaaattttccactggtaccgcactgtgtagacacacgtgtatctacacgattgcaaactgcccagctgtggatacggggccctgttcaaaccaaatatcaggacaaacattctacttcattgtggtgttccatgtaaccttgagtacacacagccatacctgaacctttcattacgtcttccaccaggtgaaagcccattcctgctccttcttcccctcctctatacacatgtgctctcaagagtgtgtgtgtgcacg

SEQ ID NO: 174976 - DNA, 657 bp, Homo sapiens
cagccgaccccagcccaattctaaaacagggctgagagccacctctcagcagctgacccctacccaaggagggtggcatggaggggcttgcagagactcttcctaacatcctccccccccagctgtctccccaagtgcaatctgccctcccatccctgggccagccagcttccacagagcgccaggccaaacagaattcctggcctccttggaaggggctggagaaggccgggagcagtggctcacgcctgtaatcccagcactttgggaggctgaggcgggcagatcacaaagtcaagagattgagaccatcctggccaacatggtgaaaccccgtctctactaaaaatacaaaaattaggccgggtgcggtggctcacgcctgtaatcccagcactttgggaggccgaggcgggcagatcacgaggtcaggagatcaagaccatcctggctaacacggtgaaaccccgtctctactaaaaatacaaaaaattagctgggcgaggtggcgggtgcctgtagtcccagctacgtgggaggctgaggcaagagaatggcgtgaaccccggcggggcagagcctgcagagagctgagatcacaccactgtactccagcctgggcgacagcgagactccgtctcaaaaaaaaaaaaaaaa

SEQ ID NO: 174977 - DNA, 246 bp, Homo sapiens
cccttctctcaaacctgacctaagaaggcctggggaacagctgtgttgcccagaacagttcttccaaaattctgccccccaaacattgccccaaaaaatcctgaacagagccctggatggtggaactctggacagagagaaatggttgaagccgtccctttctcaaattatttcagttcagatgatccaagaacgtatccccacaggaaatccttgtcagataatagagaatgggaggaccacagg

SEQ ID NO: 174978 - DNA, 297 bp, Homo sapiens
cagagtaggtgtttctgctggacctaacagtgactacagctgagaaggtaccacgtgaaaggggcaaggaggacaggagggggggggatgaaggaaaagcaaggtaaacgttgggtggctatctaagtgggaaccaccgcccccatatgttgattgtcttctgagggtaagaacaatatgggagtgtgctgtgaaaaaatagggctgctcaaaaccctccttgagagaagggaccagaccttacttatcccccatcctcaaggcggctgctgaggaataaatgaactcactgggtaa

SEQ ID NO: 174979 - DNA, 263 bp, Homo sapiens
actgcatgatatacagaatggtgggaaggggaaaacatacccagagaggtcagctcagagcatagatgagtaagacttgcacttcccctggagtggttactatacatcagttatgggagcctacattatgggagcagctatttcatgagtgcttactatataccatgcacttggctaatgactttaaatgtactaacacatttaatcccttaaacattttatgaaatatgcattattttcttcattgagaagatgaagaataa

SEQ ID NO: 174980 - DNA, 248 bp, Homo sapiens
ccacctctcgcagatgggaacagggaagcgtggctggctgcctccggtggagttgcaactgtagtcccacacttgcttcttgtgctttaatgacgcagcttctactttttgggtctacgagcctttccagaggacattgaagggcgtttcggtgttgcccctagagcgaagctctgtcctctctcccctctgagttgaagaaatgtgaagacagtctgctgcttctcttttagcccagccagtcaata

SEQ ID NO: 174981 - DNA, 1056 bp, Homo sapiens
tagttaaaacagcattttggtatatttgtactgaggagacatctgggacatgaatcatgaatcttttggaaacagttgtaatcaccattattcatggaggaaggaggtcatagtgatttctgaattgccccacctgctggaccaaagagaccctaacaattttagagtacttaaactttattgggatgaaattagaaacatttaagcagaagccaatttctagcatatgaaaattagattttaatattcttaattcaacattaaagtttccatattttccacttatttaaaaaatctaaacaatgttctacttactcaacgtagagtgagaggtggttaaaatttggggaagaaattttatttccagtaagataatatgcttcagtgttatttttatttctccaacatgattgcttgtgtaatgacaattctacgtagttattatatcactaagcagagacttactaccgataattaaaaaatgttcaaaaccagattaataataatttattttgccaaataattcctaataagattctctggaaagtaaaataccatggaagttttataaatatgacttaacttatataaacccaataaagattgcgtttgcgatttaaaaatgtttagttggagtaccctttgtaaatgttcttatatgccccggggagcttggtgttccaatcttgcccataggataggctggtaactctttgggggaggacaatgtcagcaactccttttgccttgaatgctgaaggtagaactaaacacttgccatgcttacataaagctatattgagcagcaatggcacacagaactagatacaagcttatccctttgttttcattaagcttttagggctctagtataaatctccttaaaaaatacggatctatcttctgtttctttggtattccccacgtgcactgactattggatagaatacatagcaaactttaataaatgacaagctaaaagtatcttttacagatagctttggcacagaagtttatgggtgcaacctttttatgtaccttactttgtaaatttag

SEQ ID NO: 174982 - DNA, 406 bp, Homo sapiens
accgctgcccgaagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacttcgtgggcagcgttttatagtgaacttgtttttgtttttgtaagaaagcattataaaagtttgtgaaagaactgtgtaatcttaaaaaaatgagtttttagtgtttgagctttatattttttaggaaattatgcttcaggttttttctgaaagacttcta

SEQ ID NO: 174983 - DNA, 161 bp, Homo sapiens
atttgtttttttttcctctttccaaatgaatgaatttttacatcatggctgtaattataaaatagccatgttaatttgataccaaatccatctgctcaacattgtacataattctaaacaatgtcaatgttccagttaatcgcttttgctcttcactttaa

SEQ ID NO: 174984 - DNA, 180 bp, Homo sapiens
tcactttgtcacccagtctggagtacaatggcatataacttcgtactcctaggctcaagcgatcctcccccttctcagcctcccaagtagctgggacaaccaacacatgccaccatactgggctaaaatagcctatattgattacagaaagtgaatttatactttaaaagcttaaccaaa

SEQ ID NO: 174985 - DNA, 499 bp, Homo sapiens
agctcatccagagcttggacagaattagaaggatggccaggacacttgtcaccttcatgccacaatcatggctattgcacaactaaaacaaggacttctgtccttggtgctgaaatatcattgctctgccagactaaaggatttcttcttagctgtggaggtgtcctatgtacctgtctaccaaatcccagaagagagaataggacagatagaaattcaccctgataaaggaaaaaaacataaagcatcgtaatggacattatggagcccttactatgtgctaagccctccctgtatacaatctcatttgaatcatcacaccagctctgtgaattagctattatgatcaccatttcccctgtgagaaaccaaagtaccatatgattaaagttgcctaaggttagtagaagacacaagacttgggccaagtaatctgattccaggactcaaaatcttgccactgcatcccaatagaataatatttagctgtgactttgtg

SEQ ID NO: 174986 - DNA, 247 bp, Homo sapiens
tgttaaggagccactttcaggcagtgtgtctgcagacacttcatgcagagacaaggtggcaccctgaaggtggaggattcctgggaaggttcagcctcagcttctgtcactgccttgggacactcattcccatcctgtcctgatttccctgttactggcagactcttctgccttaagagcttgcagaccaacaatgacctcttggagactcaggcactctcctcggggtgataatgaggaaagctct

SEQ ID NO: 174987 - DNA, 610 bp, Homo sapiens
aggggattaagggggagagctatgggaggtggggatggtgcatctgtccgttcatcttatttcctccctgtgacactcttgataacactagatagtgtacaggaattttagaaagacccgtttagactttgagcctcctagacattcatacaatatttactacatgattatatgcatgaatggtaaagctatttttttgcctatcatttaaggcttttctaccagctggtttctgtgtctgtcctggatctgagtaccggttacatgaatttattcagtatttgaaaattcagcaagcagctaggcatggtggctcatgcctgtaatcctagcactttgggaggctgaggcgggcagattgcctgaggccaggagttcgagaccagcctgggcaaacaacgtggtgaaaccccatatctacaaaaagtacaaaaattagctggatgtggtggcacacacctgtattcccagctactcaggaagctgaggtgggaggatcacttgagcttggggaggtcgaggctgcagtaagctgtgatcgtgccactgcaatccagcctgggtgacagaatgagaccctgtctcaaaaaaaagaaaaagcaaatctagt

SEQ ID NO: 174988 - DNA, 450 bp, Homo sapiens
gggattgtaacatccccatgagcagctggacatgaaccccttgacctggaggtgggttcctgggaatggatgagcccaaagactcgtttttaaaatgctgggtctgcaatttggaggctggtttctgtccctgtaccacagttgccccattggaacgagaataagactactgatctccccaaaccatcataggaattccagcctggcacgtagtaagtgctctgtgaatgagggctgttcagggtggattgttactctgcctcctagacatcctgggccacctgactcaatgggtcgcttcatacgtcacagatattaaacctggcaaactggctcagcacaatggcttagccctgtaatcccagtgctttgggaggctgaagcagggggattgcttgagaccaggagttcaagaccagcgcgggcaacatagcaagaccctgtctgtac

SEQ ID NO: 174989 - DNA, 362 bp, Homo sapiens
gggcgaggggtgtcaagcgggagaggagccccacctcgcacctccttcacagtcccctgggcccccttggctgcgcagccccgcagggcccagccctaggggagggagctctcaaggagctgagagggcacagaaaacatgaggggggcaagagcgagagacggtacgagagaaaacacagaggggatggaaaacgtctaacagagtacgagatataaaataagaaagatattgagaataggatgaaagaaagggtatcgaccagaagatacaggcaaagggggacgaagaaaaaaggaagacacaagaggagagaagagagggagaaaaggaggggaaagaacagattaaaagagggaggc

SEQ ID NO: 174990 - DNA, 272 bp, Homo sapiens
ttctaaggaattaaacacaaggatgaacgaacctctcctgcccccggaaccttgtgtgctggtggacggctgcccatcacgtgtcacttgtcacttgtcacgttgtgccagtgctgggcaggtcattgtcaccacttgggaaaagtgttgacaaaattggtcgttagattccaccactgacaatgtgcgatggggagagaagttcctctgtgaagaactccaaaggctgagtgtggtttctgtcgtgggttggccttgagggtgccttgctt

SEQ ID NO: 174991 - DNA, 678 bp, Homo sapiens
gtctgcaaatctacactgcctcatccctccttctcagtgtatgaccttgccttgctaactccagagaaatttcagagataaaggtgaaaagtccttaatttcctaacagcaaacctacagatttagtatctaaacccaccttttcttccttttcctcacgtaaaggacatctttcctctaaagccaatccttcctcctctcccctaggatccatcccttcctgtttttcgaagggctaagtttctctcctattagctcctttcccagaagcatttgaacatgcccatcactccagatttacaaacacaatacctccgaaccccatataacatttctcctttgcttactaccctcttcccctcactttgacgatctcaagcaaaattctttccctagcttccatgtgcccctgctagtttcccacccctcatgactcctttccaacctctattcgtctcttgattgttgtcatcctacccctggggaatcagtgaccacttacatattcatgaatcccaagtctgtcctgaaacctctcctccttgtgtcattatcacagctcttaccaagggaaccagtcactggactacatatcatgattaactactctgaagcgtaccacatagatgaggaaactggattttgactatgtgcctaaactacatagctttcaagagg

SEQ ID NO: 174992 - DNA, 894 bp, Homo sapiens
  misc_feature (593)..(593): n is a, c, g, or t
  misc_feature (763)..(763): n is a, c, g, or t
aaacgcaaggaggtcataaaccctgcagtgtgtgcagggagctaaaagccatcaggcattacctgagtgcaaattccaaggtaagcaaatgaggaactaacgctaggcagaaaggtgaggccagctcacagagagccttccttctgtgccatggtaaggactccagggtttattgcatatgaggtgctctcaggaggaatgtgtgctaagcaggaggatgacacagtccgtttcactttcttaggtggagtacttggacgtgaatgggaaagatggatttcagagggtccagactagaggcaaggaaaagcagggaatgactgccacattagttcggtaagagctaatgaggtcttgatcactggccatgaggaacaggctctgcaagaatttagaagctagcatagtagaacgggatgacttctcctgcagggcaggatgagaggtaggggtgtgtgtgtgtgtgtgtgtgtgtgtgtgtatgattttctaattcctagtcatttttctattgattgttttgcaaaagccatttacatcttaaggatattgataatcttttgttatatttgatgcaaatatttttttccagnttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttntacaattttatttatttcttgctactttaagaaatttgtgtggtgaaatacatataatagaagttgactatctgaatcatttttaagtatacattcagtagtgttcagtatgtcgccattgttgtacaacc

SEQ ID NO: 174993 - DNA, 400 bp, Homo sapiens
ctggagactgttgattcctgggtcccttgaagaactaatgacttccatctctagggtgaggtgcaggctgggtgcttatgttttaaataagctctccagatggtactgctgattcaataggaaaagggcagttattatatattcctttctcctgcaccccaatcaagcccagtgtgatttcagagcacccatttgggtgaaagcagtcacttgatgcccagccgccttacagtccggctgaaatgccaggagtgctgttattggtatttgggactcgaataggggctaggatgactctgtgaaaaagagccataaaaacaagaatttcatagctaatttactgcttacctatacttgggcaggccattcaacataatattcttctgacttgagtttctct

SEQ ID NO: 174994 - DNA, 152 bp, Homo sapiens
tgaaaatactttttaatccaggtgcagataattaacaatgaaaagacatttcatcttctttcttacatccagggactttatcagacttaaattcactaggtgcatggaaagaacagtaactgaaaaggcaatttgaccataaactgtttgca

SEQ ID NO: 174995 - DNA, 714 bp, Homo sapiens
atcccattagccttatgactctgagatgatggaatcttaataaccctgttgaaatagggctttactaatactgatgaattactcttgccagcaagctttggatgcagtcccgttctacagatgggaaaaccacgacttgcaataggctgtaggagtcactctgagcatcctgatgaaactgctgaagcttgtgcccacgcatgatgctgctagagcttccagtttctcattacctagtgatattaagccccaggccagtggattccttagaactccaggcccacaaagttcactgaggaaaaaaaaagcttcactgccatgcaattctgggaaactacatcgttatccccatttgtgtttaggggacaggagtgcactggtacatcaaaggctctgtcattcagtgtcctaactcctgctgttaaaaaggctgtttaatccagtctgtcccaaatgtatttgattgtaaaaccctatcatttcctatatgttatggaccacttgaatatagactttcataaatactgtactaggctcattcttttgtgttgtctcatttctttcttccctgaaaggcactgctcttgactgcagttttgcagttgtttgatgcaaggtgtatttcctggttggtagaatttccacaagcaccccaccattttccatcagcaggaattaagatcttgctctgcaggtggcaagtggtacatattg

SEQ ID NO: 174996 - DNA, 383 bp, Homo sapiens
gattaaggtagaaaagtacagaaaacactaaattttcattgtgctgtttcaatgtggcagattctttaaaatacttcgacatgctacaataattaaaggttttaagaacattaagatacttaaaaaataaaagcccacaattgaataacaaaaatgaactttgttttattttttattggcattaatgtaggttgccgtggtgaaaatagtttgaaatacttcacagtaacagttttgtgcagccctagagatcaaaaacagcaaagtaaataagcaggactctcaacgactcatactcacagacatgtttaatgtaatcctagcacttcgggaggctgaggcgggaggattacttgagcctaggagtttgagaccagcctggg

SEQ ID NO: 174997 - DNA, 1267 bp, Homo sapiens
  misc_feature (1237)..(1237): n is a, c, g, or t
agcagcctggccagagtccatgccctcagcagctacgttgtgttgtccttaaggaggagcatgttttagaaaatcagttataaaatcaggtgattgatgaagtgcagggttaagttaagagaagagtgaactgccttcagaatccagtgctgttaccactcaagtggagatctcagataaatcacttattggagcttctgtacaatcatctgtaaaaccattacttcccacttggagagatttttgaggattaaatgagataatgcatgaaagccctctagcttgggcatcagtacacctgagttcccttcccttgctctgcacagcctgctcatcaccactgatggggaactctgtcctctgtagggcccctgcagacatgggccttgcctggatgctgctgctgtcggagcctaggagagttgtgcctggcatcgcagcacaggtactcacagctctcagaaggagactcctgtctgggaccctgccctcattcccacgtaggaaaaatcctttacatgagcatctcctggccttcattgttaggttgtagactacaatgaatgatattctgtgtttaattacattatgcacaacactctacagagtgggtggttttgaatcccaaccactaatttacgaagtggagcggctctgctggctctgtgaagtatgtgttgtggagccagaggtgatgctgttggatgtgggtggtgatttacgggagagcagcataagcagaggaaggcacagagacctgggttcaaatcccactgccagtgctatctgacgtgagacttcggacaagttatttaaccttaaggcttagtgtccttgcatgtaaaatacaaataatgctgacctcattgattccttgtgaggagcccatgggataatgtggggtaccatgcgtcagtatcatttccctttcccttgataatgattatattggacagctagtgtcataggaagctaatggttaggaattcagactcacacaagaatagattttgttttgcagtggaaacttagtgataactttggactaagacaatgtgaagacattttggcagacaatcatagagtagttatattcttgtgaggtctgcagaagtccctagtggggagagcagacagagccttggatgctcagacctagtttggctgtgaaactgaagctttagtccttttaagtctgtgtttcttctttgaccctttacaaccccggggggggaangtttagtacaattatccctttgaaagtttt

SEQ ID NO: 174998 - DNA, 1248 bp, Homo sapiens
agcagcctggccagagtccatgccctcagcagctacgttgtgttgtccttaaggaggagcatgttttagaaaatcagttataaaatcaggtgattgatgaagtgcagggttaagttaagagaagagtgaactgccttcagaatccagtgctgttaccactcaagtggagatctcagataaatcacttattggagcttctgtacaatcatctgtaaaaccattacttcccacttggagagatttttgaggattaaatgagataatgcatgaaagccctctagcttgggcatcagtacacctgagttcccttcccttgctctgcacagcctgctcatcaccactgatggggaactctgtcctctgtagggcccctgcagacatgggccttgcctggatgctgctgctgtcggagcctaggagagttgtgcctggcatcgcagcacaggtactcacagctctcagaaggagactcctgtctgggaccctgccctcattcccacgtaggaaaaatcctttacatgagcatctcctggccttcattgttaggttgtagactacaatgaatgatattctgtgtttaattacattatgcacaacactctacagagtgggtggttttgaatcccaaccactaatttacgaagtggagcggctctgctggctctgtgaagtatgtgttgtggagccagaggtgatgctgttggatgtgggtggtgatttacgggagagcagcataagcagaggaaggcacagagacctgggttcaaatcccactgccagtgctatctgacgtgagacttcggacaagttatttaaccttaaggcttagtgtccttgcatgtaaaatacaaataatgctgacctcattgattccttgtgaggagcccatgggataatgtggggtaccatgcgtcagtatcatttccctttcccttgataatgattatattggacagctagtgtcataggaagctaatggttaggaattcagactcacacaagaatagattttgttttgcagtggaaacttagtgataactttggactaagacaatgtgaagacattttggcagacaatcatagagtagttatattcttgtgaggtctgcagaagtccctagtggggagagcagacagagccttggatgctcagacctagtttggctgtgaaactgaagctttagtccttttaagtctgtgtttctgaccctggaggaaaaaagttatacataccttgaaagattttct

SEQ ID NO: 174999 - DNA, 283 bp, Homo sapiens
gcggccgcctactactactaaattcgcggccgcgtcgaatagattttgttttgcagtggaaacttagtgataactttggactaagacaatgtgaagacattttggcagacaatcatagagtagttatattcttgtgaggtctgcagaagtccctagtggggagagcagacagagccttggatgctcagacctagtttggctgtgaaactgaagctttagtccttttaagtctgtgtttctgaccctggaggaaaaaagttatacataccttgaaagattttct

SEQ ID NO: 175000 - DNA, 232 bp, Homo sapiens
gcagcaagtgccttctcagtgtaaaaactcgcactgaggagaaatgatgagggagccttttgacctaataaggtgagcattttaggatagattttctgactggagacaccagctcacgtgttccctggaattccgggattgattagtggcttcattggttcactgattgattcaactagtatgttttggatgtcttttccaggtactgtgctgggtgctggggattcactgg

SEQ ID NO: 175001 - DNA, 1150 bp, Homo sapiens
ccatgcgaacggactgatcaaggagtgagctggctggaaagagggattgatgtgccagtgtttgccgggagacgttggagagccccgggggagaggcttcatacttggccctggaggacttcacaggacagagatgggcagggagggggcacacccaggcgtggaggcaagtgcctgcttggtgggctctgaaaccagcgtccgctgtgcgttgtcctacgcacgggaaggaagtgcatccttgggcgggtgtagtagggggcaggctggctccagtgtgtgacaaatggccaaagtctgcagggctatgctaagaaatccacttcattctgcaggcagttgggagccaaggattgcttgtgagcagaggagggacacacactgtctgcaaggactgcagctgtggcagagtctgaacaatggtgtgtgtgagggcaaagctcagaagacagggacaacaggagatcagtccgttcgcatgttacccatgcgacctcatgggtgcccttacttctaccaggcagtcccagctcattccctaaacaattctctttcccagacaactgttcacacctttctcctccaacttctgtcttcactctcaaatgatgaccgtttccccttcttttacaatactataaaaagcaacccaaggagaactttcatgtcttcccacctcctgatcagtcagttcgcatgctgccggtgaccctctgccgtcccacctgccacaaaaggggaactgtctctgatcctgtctaaagccaacccctcttctgaacactgggttccatctgtctgacaccgctaaaggtttttctactctaattttctccactgctcccatatcactatttcctccctttcttcaggatctgtcattagcatacagacatgctctaatatttcccgtcttaaaataaaaatgtcctatcctcctgtcttccacttcctcatgtatctgctttgttgtatggtgagctcatcaagagttatctataccgattgtctctatttcctcattcctatctgagttttgacacactcagtgaaaccgccattgccaagccattgataacctccatgttaccaaatccaatgatcagctctcagttcttatcaactttacagcaacagttgagccagcaac

SEQ ID NO: 175002 - DNA, 238 bp, Homo sapiens
gaataacagagctctgctgactgatccgctgcacccatgcgacctcatgggtgcccttacttctaccaggcagtcccagctcattccctaaacaattctctttcccagacaactgttcacacctttctcctccaacttctgtcttcactctcaaatgatgaccgtttccccttcttttacaatactataaaaagcaacccaaggagaactttcatgtcttcccacctcctgatcagtc

SEQ ID NO: 175003 - DNA, 505 bp, Homo sapiens
  misc_feature (24)..(24): n is a, c, g, or t
  misc_feature (42)..(43): n is a, c, g, or t
  misc_feature (117)..(117): n is a, c, g, or t
cagtgagcacaagcgactactcgngaatgtcgtcaggctcgnngtgtacgcccagaagtcctgcacagttcctttgtggcagtaactgaggaaggcacgaggctgcagctgcactgncataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttaacaaaaaacaactaccagtcattctcttgtgattaactcatctagccattgttcctcctttactctcctgtggcatttattttatacccctcttctgacagtttttacttacttgatttaatataaatatgagtaaatgtcttatcttcaccagatggtagaggcctcaagagcaggcgatgtatcctgcgttgtacctctagtattgtcatattctcaggctctcaatt

SEQ ID NO: 175004 - DNA, 131 bp, Homo sapiens
actattgataattgttgaagtggagtggtggatgtatggtaattcattatattaacctctctccttttgtgtgtgttttaaattttctagaagaaaaagtaaaagaaagacagagtggtgttggtttcatg

SEQ ID NO: 175005 - DNA, 290 bp, Homo sapiens
ctgtctccagtcagagccagggagacaggcttctccctgcaccatccgcactgccatagacacagcagccagcaacagcacttggaccattacggagttccaggcccagtctccaactgacctccctcctgctccagctgcccatgctaacaagagccagggcacaagacctcacttggaacaagtaccaggcagaagagagcattacctgccggtggggaaaatggggaagaggacagatgtccccataatttcaattgaaaatgaaactgtacagggccaaagttgta

SEQ ID NO: 175006 - DNA, 498 bp, Homo sapiens
gccagtctccggcagtcccttcacaaggcactcatctggaatacctccagtaccagagaaatcgcaggccccatggatgtccacatgtggagggcttcggtacggtgtccttccttagggcctggtgggaatctgcctcctgtggctttccagccattgattcgagttgcaccacagctaccttctattatccatctgcccttcagatactgcttctgtatcatacagcttaattctcaattattataattcctttcagacaaatgttttcttacaggaaatgcatattcttctgagccatgttctaccttccccatctctcaggctcagacagttagagaaatcagtctgtcccatttaaccaatgaacgaatgaatcagtcaaccaatcaatctccctctgtctttttcctatccccaacccaaacacgtctaataatataagggtaataataatcttaacagtcacatattttgaaagaaaattggggcaatata

SEQ ID NO: 175007 - DNA, 407 bp, Homo sapiens
tcattcaacatttactgaactctaattttcttttcttgaagagaggaaagtttaataggcaaacaaactattaatagcatctggtgtgccctgagtgcttgctatgtgccagggccaagtaggtctctattttgcggaagttaaaatatgatgtaatcgggtggtatgagcattaaaaaaaatgtaattgaggttacaaccaaggtgtatttgctttcaaatccagatctttttgactatgctaaatacaagcaaattcaaaaaggggaattagccggctgctgtggctcacaccagtaatcccagtgctttgggaggccgagggtggatagcttcgaggccaggaattccggaccagcccgggcaacaaaatgttaaataaaaaaattttaaaaaattaaataaaa

SEQ ID NO: 175008 - DNA, 585 bp, Homo sapiens
gaagagttacttttatatatggggtcctctcagctgtttgacagaagaaataataaagagcttcagatttcgttttagaatgacacgtcagctaatacacgtttaggcttatcttccaatttgcagtttttggcattaagcttttagaaactttaccagatttattttatgtttcttgaattctcttctccacatgaccaaggagtgaaattgcaagtttgtttgcataaaagaagcgcagacagccacgttccatcctgtttaccagtttaggccccggtgaatgcaagcagaggcaggtatttgtgacctttgaaagcagctctcactagcacctcttcaatgtatttctgaacctttggatgttcctggctgggcaaatggttgattaccatggaatcaagcagtaacaagccagtcttacctttgactttagtgataaggattaagtaataatctccctcccttttggttgagctgcgtgttccgagcccgagtctggttcttctgtgtgctgtgtgaagtgttgctgctgcaatcgtgttactcagtcacagtgacttcgggaggagatggtcctaagtc

SEQ ID NO: 175009 - DNA, 387 bp, Homo sapiens
tgagatcaagtgtgaatggaaagaaaatttgagttcatgagtgtagacagttctttaaggacaacatactcaacactcatgactgagaatgatgtaattttcgtccacagtcatggaaaagtgatagacaagaaatagtagtttccaaattttacataacaggtggagttttcaaattttatgtaacaattatatattttaaaggttataaaaattatacacatatggcatttaaaaatgccagaccaaggttttaaaggccccttgaacatttctagattacataagctgattatcattttgttcgtgcttatacataaagaccaagaaatactaaaagtctcaaggagaatatttcttgcttgataaaaatcagctaattctagg

SEQ ID NO: 175010 - DNA, 438 bp, Homo sapiens
ttttgtgtactgccaatgctgaaaacatagtagaaactcaatacatttggcaggcttagttgttaggtgctgaagttaaaaaggtgaaaaagggccaggcactcaccacctgtaatcccagcactttgcgaggctgaggtgggaagatcacttgaggccaggagcttgagaccagcctggccaacatgacaaaaccccatctctacttttatacaaaaattaggcgggcatggtggtgggtgcctgtaatcccagctacttgggaggctgaggcaggagaattcttgagcccaggaggcagaggttgcagtgagccaagatcgcgccactgcattccagcctgcgagacagagcgagactccatctcaaaaataaaacaaaataaataaaaatcagttaatgataaacactgtacagaaaaaatagaggatgtgatag

SEQ ID NO: 175011 - DNA, 661 bp, Homo sapiens
gacttagctatggatgtaagaactgcttttgagtagctgcctccattagccctggggttcctacttcctgagtaccatgacctctgggataactcagctttgtggaactgaggtgcaataggcagcataatgaccccctccccaaagatatctatgtgctaactaaccaaggaatgtggacagccccctgaagctggaaaaggcaaggaaagggattctcttcaagagtttccagaaggaatgcacccctcttcaccaatttggtacttctgatctccagaactcttaaataataaatttggccgcatgtagtggctcacacctgtaattcccagcactttgagaggccaaggaaggtggattgcttgagctcaggatttggagaccagcctgcacaaaatggtgaaaccctgtctctacaaaaaatatgaaaattaaccatgtgtggtagtatgtgcctgtagtctcagctaccagggaggctgaggtgggagtatcacctgggcccaggaggttgaggctgcagtgagttgttagtgtcccactgcattccagccaaggggacagagtgagaccccatctcaataataataataataaatttatgttgtttaagcctctaaatttgtggtaattgatacagcaaattacacagaatagg

SEQ ID NO: 175012 - DNA, 602 bp, Homo sapiens
gacttagctatggatgtaagaactgcttttgagtagctgcctccattagccctggggttcctacttcctgagtaccatgacctctgggataactcagctttgtggaactgaggtgcaataggcagcataatgaccccctccccaaagatatctatgtgctaactaaccaaggaatgtggacagccccctgaagctggaaaaggcaaggaaagggattctcttcaagagtttccagaaggaatgcacccctcttcaccaatttggtacttctgatctccagaactcttaaataataaatttggccgcatgtagtggctcacacctgtaattcccagcactttgagaggccaaggaaggtggattgcttgagctcaggatttggagaccagcctgcacaaaatggtgaaaccctgtctctacaaaatgaggtgggagtatcacctgggcccaggaggttgaggctgcagtgagttgttagtgtcccactgcattccagccaaggggacagagtgagaccccatctcaataataataataataaatttatgttgtttaagcctctaaatttgtggtaattgatacagcaaattacacagaatagg

SEQ ID NO: 175013 - DNA, 110 bp, Homo sapiens
aggaagaaaggaattaccaggcataaaggttgagggtggttgagggagaggagctttcaactaggggtgaatagtaaatatagacactgaagaaaagagtgcttgtgtgt

SEQ ID NO: 175014 - DNA, 677 bp, Homo sapiens
attggctttggatctcagacacttcactgtttctataagagaggagctggatttgaacatgttggccaaataaggagctgctgcccacccacacactggtcaggataaaaatctccacccagggccatgcacagtggctcacacctgtaatcctagcactttgggagggtgaggcaagacgattgcttgaggctaggggttcaaggccagcccaggcaacatagtcagaccccttctctattttacgtatttatttatttttggagatggagtcttgctctgttgcccaggctggaatgcagtggtgcaatctcggctcactgcaacctccgcctcccaggctcaagcaattctcctacctcagcctcctgagtagctaggattacaggcgcacaccaccacgccaggctaatttttgtatttttagtagagacagggtttcaccatgttggccaggctggtcttgaactcctgacctcaggtgatccgcccaccttggcctcccaaagtgctgggattacaggcatgaaccaccgcgcctggccatgaaattctttttatcctaagggccttccaaaatgaccctttgtctttcctttacactaacaagaagccctgccagaggacacctttttctttttttgacaggtgggaaatgaggtcagagcatgaatggt

SEQ ID NO: 175015 - DNA, 373 bp, Homo sapiens
taggatgtgcttagatatgagttgctgttgctgttatcctcacataggatgccctcagatatgagttgctgttgctgttatcctcatcatcaactggggtcaaatatgtgcatgccaacaggatatggcttcaacagcgcctgccacagccaacttcccctaaccacagtcctctgttgcaggaagcaactttgggctgttttcacaagaggatgaccaccaagtaaatcaagagtggcaacatgacagggcagtcgcttcactgaccaggtcaccaccatacccaagacgtggcctaatatgaatggctctccccagcaagcaatgcttactggaaaagtcaatccgactggtctcctccaggccctggacg

SEQ ID NO: 175016 - DNA, 376 bp, Homo sapiens
ggcctcccaaaatgctgggaatacaggcatgagccatggcgcctggcctgctgcacatattctgacaccatgtgtctggtgaacccagaccctgtaaagaatcttcactggtgattgtttgatataggtgaccttccccctccctctttttgcctgattttatttccctttctagattataccactaaatcagaaagcactgaatattttgtaagtttgtttgggtgagagcaagaataatcttttcttgatttttatttttatttttttaaaacctttaactcctgctgaggttgagacaaaccgtatctagcatactgttacctgaaacaaatgtggtaggagggaaggtgatacagtcctgccattgcagacc

SEQ ID NO: 175017 - DNA, 332 bp, Homo sapiens
ttttgatccttctggagagcttcaacaactgaaaccatggtgaaaatggaaagcacttaactttcgtaagaacacttgaatgtttcagtattacccgaaagcaaaattataagccttggaaagaaaacatttccatttggcattttcacttttgtgcttgtcaagagaaatagcctcaggcttcagaaaagcagaaagatctattaccaatatcatgaggcaagcactccggtgctcacttatgttggatcaatcttgttcacttctagaagcctttccaactatgttatgatgttctcctttctgcttctccatccagacggagcagtgtc

SEQ ID NO: 175018 - DNA, 929 bp, Homo sapiens
gcaaaacgaaagcacccggggcgcatcagttgcaatagcttccctgagcgcggccgtgggaggccaagatctgaggtcgcgaggcgacggtgggggcccgagctgcgcagaaactgggtgggggcggtccctggagggcgcccgggagctgctagaagttgtccggagcccctcaacccccttggaaaagcgaacgcggatgttaatataccaactccgcagggaacttttggcccgggtcttgagctgaaattccagactgaatgggaccgtgctgaaagttcgacgaggcaaaggagtatggcgcgggggcaagctttgacccccggcttcgtatcctcgggagaggccgggactccggctcgcccagcgagggtgcgcagaggcctcctgggattctaggcccacagaatttttgctccagtgaagttggataagcactccgcctccccgcaaaaaccagagttctcggcttataaacacttcaataaactctggtgacattctccgcgctcgctccttgccctcgcggcagtcactgcagggacaaaggcggcctgcgcagacttggaagaggcgcggcccgcgtgggcggctttaccggccaaagacgttttcagttaaggggaggcatcttcagagctgagggtaactccccacagccaccccgcaggtagggcagccaaccccaatctggtcagcttaaaagtgtcctcggtttcgccccctttcccagcgaaccaacactggcagattggcctgcgagccgctcgctctgttgctctagcacatttatgtagccaaacggtcgaagagccccatctttaagcccaataaacacttaactttattctatttaataacacattttgttgtggcaatatttgtggattttggcaggtattaaaatctggtgatcctaaatgagt

SEQ ID NO: 175019 - DNA, 519 bp, Homo sapiens
aaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaaga

SEQ ID NO: 175020 - DNA, 627 bp, Homo sapiens
ccacggatagagaaaatattggtcaacagacttggagctaatcattaccagtgtgtttgggcaagtcactttgcctttttaaagtatcttcatttataagagaattttgttgtattttgttttccttccttccttttgctataatattttctctcagaaatgtgactttcaatgaatgaggagcagtgagatgaaattttaaaagacaagactgggacaattctctcttcttaattgtgcttgcaagtttagtttagcaccctccattagagcagcttttgtctcttttattaactaatgcaacccagaagacccttgcacttagtagcagatccgttaatatttgtttagtagctaggtctaccaagctccaaaaaattgaataagccattttgttctaagggatgcgccactgttattaatgctgtactgccatcttctggtcacatgaataattacagttgcatccgtgaaaatgaaatccttcaggaacttgttccttttttgtttttatattgcagtaatagcatttagagaaaaaaaattgtgggaatatcttattgttgttataagcaaattttaaaggtgatctttttagagtaggaaacgtttacattttctgtgcaa

SEQ ID NO: 175021 - DNA, 589 bp, Homo sapiens
ccagggcaggggtgctgccacatgggctgacctgagccatctcctcagctcatctaccaaaagcactccaaggaaagcatcatgaccttcttcatccaggtggggaaaccaaggctctgaacagtagggtgagtttcccaaggtctcttggcccacagttggaggagccaaggtttgaatccaggtctggttggccacaaaccctgctccttcaacctcctggccatggctgggtagactccaggggcccacctgtcagccatgaacctctgttttgtgttcacactgggagctgagttgtgtggtccccactctctgtgatccttaatccagtcctggagggtaggcacacaggccttgccctcagagggggcagatgtcctgctggggactggaaacatctccagaccagaacaggacttagttccaagtggattaccacgagctcaggaagacaagtctgattcatagcccatcaaacctcactgaacaggctcatggtgccgagctccactatgttgctgggctcagccctctagcgccaaacgcttcctttagtaagatcctggtgtcagcaccacccctacca

SEQ ID NO: 175022 - DNA, 395 bp, Homo sapiens
aagaagtacggaattgaatgcaaagggaaaagaggttgagacagttggtggtagctggctacttgctttcagaatcagtttttttcatttcctaatggaacgtcagttattgacattaaaggaaaaagccagttggcatcctgctatgtaggagcagaaaactttttagtgggaagtggagctttactgaggccatttagagaattatgagtcatccccttgatctgatgtaagtgtcacaggccattccccaccctagtccttgcccatttctaattttatgttcataaccacccttttatcactctgttggacgagtttcttgaagcaacttgcttacctcttaccagtcctggaaagatgcaaaacatgattaaactgttcctttatctttt

SEQ ID NO: 175023 - DNA, 715 bp, Homo sapiens
tgcagatcaagagggggctgtgctctgtgtcacctccactctaaggcccagtgacggagcctgcaccgtttctaatgtttccggttactgtggcagaaggaaaaagcatatgacgaatcacacactggctcttcaaatgtctgcccagaagtgacacagtccccttgagctataagttcctggtcaaaacaaacaacatggccacacctaacttcgaagtgggcagagacatgcagtgacccatgtatctaaaaatactaaaaataatggtaaatagcactgataaatattttctgaaaaatataaatcaagagtggaattccttttaatttttcatttagttatagtttgggctgtgagatggttgtgttacacatgaaattcacataattagaaaactataggtgagtatgctttaaccccctgccccaacttcctcctctttctttgttcttgttttcttcccctcctctttcgcttatattttcctctgacctcaccctaaaaacacagtttaacctacaaggtaccagaataccaaaccaaaccaaccaaacaaaaacaacaacaaaaattgggtgccctctggaatgtttggctccaaaaaaaatattgaaatctatagcaccactgaaatgtctaatattaccaatgtggcattaataaatggacagtcgtgctcttttgtagcttttctctctggaaggaagatatt

SEQ ID NO: 175024 - DNA, 545 bp, Homo sapiens
tgtatcttcacctgaataatagttatgtgtgtgtttgcatagttaaaatgtattgagctgtggaaaaaaattgtggaagaaatgaaagaatgaactagtgacagaaattacccaaactaataaacgttggaaatgtggccacacgctcactgttgtttcaggtagcacaatgccagcttcaccatttagtaataatgaaatattcaagttacaatgacaatataagcacagatgcacacacagacacacacaccacagaatgtctttcccatttggctcatcgctccactgtgcctcttctgcacctgccaccagcccagaccatctaagaaggctccagccctgactttgtaagactgtttaacaagccactccactgtcaggatgccaaacctctgggagaatctttttgccattgtgggaatccaccctgcctgagtaagctgaaatccccaattctctgcaacccccaacatgatttaatcaactttctcttcagttccttgtcctctggcacttggttcaattcagagttcaacaaatac

SEQ ID NO: 175025 - DNA, 429 bp, Homo sapiens
aagactgtatctctaaaaaaataaaaaataaattagaaacaggcatataatatgtgcttgaataatatgtgttggctaaatgaatgagtgcctcactgttactggtaaaatcaactaagaatttctgaatgtcccttagattgttcttaaggagtagtatcatcaaattcttagactcccttcatatccacatgcttagatatagtcactgcattcacttgtagattttcccaaatgtattttcacaagagctcttttaatagtggcttagatagaacttctctataattcattctatttgttcaaagtatgaaagtaatacctgtgatgggatgacttgttatctggatatcactgccatactgttataagccagcctgccccccaaatcctttaattttccttgctttgcttagtgcaggtgaagca

SEQ ID NO: 175026 - DNA, 338 bp, Homo sapiens
gtgacttatcaagtcttaattgcttttgtgactttcaaggtcctttagaacatggcttcaccttagctatgtgaccttattctgctctaatagtagcaataataataataattactattgattgagtacccaagtgcctgactctgtgctaggtgctttccttatacaatttgctaacacaaatccttacttcaattagacctgtgtcctatggttcccatatatactttgctctcttctcaaatgcctatgctctattttctgtaccttctatgcctccgaatcctactattttgagagtgaggtcatttctcagctcctccaaaaaatccgcatac

SEQ ID NO: 175027 - DNA, 206 bp, Homo sapiens
ggctgcttcccggggccggcgtcgttttctcggtgtagcgaaacctctaaacccttcttgtttaaacaaagccgcaagagagaactttttagccagaagctgcaaaggaagctgggttttgccgcttttagctggtagtaaaagaggcaataaagaagcgagggtagcagagcaggcgagtgcctgggccgggagaagctgcagct

SEQ ID NO: 175028 - DNA, 426 bp, Homo sapiens
ctcccactgtttgttattggttacaaatgtgtagagaaatgaaaagagcagtaaaactaatgtatttagcacactgtgatttgaaacactagaaacattgggattaaagcattttgtctctttctaaagtcccgtcaatagtagtttaaacagcacttgccgccactgcctcttcctacaacttccgcttctgggcttctggccgagcatcttctccggggcctgttgagttgccacgctcctttctagttggatcggcttccaacactgtatcatttgcacatcccgtgttgcaaaatgcctcccagagttcctttcatttgcggttttttgctggcgtcacacccccgagtctgtcttcatccttctcgtcacaactgtttgctcattgtgaagattaatactgagtgtcaacttgattggatt

SEQ ID NO: 175029 - DNA, 162 bp, Homo sapiens
agacatggtggcatcatcatcatcatcaccatcacaccatcacttctccaccatctcctcaacaaatgacctttgaaacctgctatcttcccctcatttgtggtgattttctaggcgacagcaattcatctgggagaatactataactgatatcaatataag

SEQ ID NO: 175030 - DNA, 277 bp, Homo sapiens
cacttagagggttgttacttaggaaacactgcactcagttgccttcaagggttatatatctggggtaatggcagccagtcactcagttgtgtttaggtgaatgtcttagagctttactcatttgtttctttccttatagaccatttaagataaagagctctttagcagtcatcaggtaattgaaattctaagattatcaaatactagttgggttgtccactttaaggctgattttctttcacatgatataaagtatttttccagtctctcacttact

SEQ ID NO: 175031 - DNA, 224 bp, Homo sapiens
tatcagagacttgagcattcatggattttggtatctgaaggagggggtcctagaaccaatccccagataccaagggatgactacatagtgtggcagagttaaccacaggcacatggctgcgcaacagatctgaactttttcatcttgcaaaactgaaactatatctaagggacaacactcctatttcgcctcgcctcgccccagccctcctgcagccatcattc

SEQ ID NO: 175032 - DNA, 283 bp, Homo sapiens
gaggcaggagatgcgaggcgtcctacccgaatttagtacctccagcaaatctgtggcccagcgtggcccgatcaacaatggtagaccgagccatcaacctgttttcctaaaaatgaaaggtgatctggccctgactgaagacaaacgggaacaagcccaaaatgaacagagtgcctggaagtttacgcctggtaggtaaactctccagtcatattctcagtcaaggcttccctgacagtcccactactagaaagtcactggggggacagccaaggactcgttt

SEQ ID NO: 175033 - DNA, 445 bp, Homo sapiens
  misc_feature (122)..(122): n is a, c, g, or t
ggtgcctctcctgggcttgaaatgaggaactgaggaggcggtggtggcgagagtcagtctttcagagcacaggatggaacaagaactccagccactgactgtctcatgtatctgcaagggcncgaggaaattaatgacccaaggaggctatgatatggtccaaaaacttttcctggattttttccgtaggcggtgagccagaggccaactgcagaggaactgaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcaggcagataagccgtggacccgcctcaccgctgcagacaaa

SEQ ID NO: 175034 - DNA, 247 bp, Homo sapiens
ttaaaggtataaaattgttaccactaaacctagtttcagcaaaaggtggccaaatcttccatggaaaaggcagacagaggttatggggtggagggggggaatcatgataaggggaactgaagtagccaagggctgtggatagctttcatccctcactgtgctgaaggaagccctcctcctaaggccggcatctgactacagcatgcaatcctttacactcctgtagctgaccacaagcctatcatga

SEQ ID NO: 175035 - DNA, 297 bp, Homo sapiens
gcaactctctaggctctgtacttatagtaaactagtaatttaactaaatttcttagtgtagtagcaaataatttgggaaattctatgaattattttaaatgaaaatgacttatctacctaaagtagttgtcggcaaactctatgaagattcatcttggggagtttctttttttgactatcagaaaattgaagatttagctcctttcattaccatagtgagccaagtgaatatctctttgataagaagataaatcatcaataatttattttatcctctttttcaaaagtaactttcta

SEQ ID NO: 175036 - DNA, 178 bp, Homo sapiens
gccacagtctcacaacccctttctgccctcatttccctcctctgttcagcttagatactatggtctatatataatcattcccttgcagagtgccctcacttccccgtatgggcgttcggcgtgtgcatgcacacgccgaggccccacactgagcaagtcctaatggacgaagtggttg

SEQ ID NO: 175037 - DNA, 149 bp, Homo sapiens
gctgtgtctcggggaggagaggcagcttgtccccgcgtgcagattcttgcttgcgtatttcagaaggtggtgtttaagcgctgagtggaattctggggggtgtgcacgcacgtgctttttacctgtgtttccactcggcctattttttc

SEQ ID NO: 175038 - DNA, 211 bp, Homo sapiens
ttctcccattaaaaaaaaaaggtcctctgtcaccctcaccctctgtagtccctcttccgtgtcatgggcacatttctgagtatctccttgcagtctccattagcaccatcagcatctcgtcctgtctattctctgaaacagctctcacttgctaaaatccctaatctctactgtcacaaaatcagatgatcctcatcttacttaatgtctt

SEQ ID NO: 175039 - DNA, 756 bp, Homo sapiens
ccaataaaaagaaagtaatagttattgtaaagactcgatgtctgcaacaacctgcccatctcatactttctcagtttgctttaaatgctgaatatttaattaaagagaaactttcttgggcacacaattgaatcactgaaaagacagtgctgcagtgttttgctgttttactagttataaaattggccacagaccttgaaactaaatatcaaacattcctgtactgaaccaactgccgttagtaagctgttcttatattgaaccattgttcctggaaatttttgcattagaaatccttcctggccggccgcggtggctcatgtctgtaatcccagcactttgggaggctgaagctggcggatcatgaggtaaggagattgagaccatcctggctaacatggtgaaaccccttctctactaaaaatacaaaaaattagctgggtgtggtggcacacaactgtagtcccagctactcaggaggctgaggcaggagaatcacttgaacttaggaggtggaggttgcagtgagctgagatagcaccactgcactccagcctgggtgacagagggagactacttctaaaaaaaaaaaaaaaaaaaacaggaaaagaaaaagaaatcctcctacactagttcaacatgttgcttcagataggataagctgccatagaatacagattggttcaggtcctaaacaatattgggggaaactcatcattacttccatttcccatcatagagaacatagagtctatg

SEQ ID NO: 175040 - DNA, 476 bp, Homo sapiens
tcgttcagctgaaggcgtgggcaagtgactctgccctcagtttccctctgtgtaaaatgggggagtaacaggtttgcagtggagatttaatgagccagtgtgtaatgagcacctgctgcctggcaaagagaggttcagttgcaggtggtggtggtggtagtggtgattttatcattgccttcattagtgttactgttattggctatgaggtgttccttcagtagtctcccttgagcatctcttgcatacatagcactggaatttcctgggtctttgggagcagaattttgaagatctgggcacttccttagctataaggccttgcttaactgccccacctcagtttcctcatctgtgaaatgggtgtgctaatagtacctacttcctagagtcatgggaaccatgaatgagtgaattcacagtgtccagagtggcttggtcaggaggaagagaagaagtagccttggggccggaat

SEQ ID NO: 175041 - DNA, 2561 bp, Homo sapiens
ttgcatacggtaaggcgggacttccggcaccgctccgagatggtaattttggtggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcggttcccgtgactgcagaagctaaacttatgggctttacacagggctgtgtgacctttgaggacgtggccatttacttctcccaggaagaatgggggctccttgatgaggctcagaggctcctgtaccgcgatgtgatgctggagaactttgcacttataactgcgctggtttgttggcatgggatggaggatgaagagacacctgagcaaagtgtttctgtagaaggagtacctcaggtcaggactccagaggccagtccatccacccagaagattcaatcctgtgacatgtgtgtcccattcctgaccgacattttgcacctgaccgatttgcctgggcaggaactatacttgactggggcatgtgcggtctttcaccaggaccagaagcatcatagtgcagagaaacccttggaaagtgacatggacaaggcctcatttgtgcagtgctgcctgttccatgagtcaggaatgcctttcaccagcagtgaggttgggaaggacttcctagccccattgggcattcttcagccgcaagctattgctaactatgagaagccaaacaaaatcagcaaatgtgaggaggcctttcatgttggaataagtcattacaagtggagtcaatgcaggagagagtccagccacaaacacactttttttcaccctagagtctgcactggaaaaaggctttatgaatctagcaaatgtgggaaagcctgctgctgtgagtgctcccttgttcagctgcaaagagtccaccctggagaaaggccttatgagtgcagtgaatgtgggaaatcttttagccaaacctctcatctgaatgatcatcggagaatccacactggagaaaggccttatgtgtgtggtcagtgtgggaaatcatttagccaaagagccaccctcattaaacatcacagagttcacactggagaaaggccttacgagtgtggtgaatgtgggaaatcttttagccaaagttccaaccttattgaacattgcagaattcacactggagaaaggccttatgagtgtgatgaatgtggaaaagcctttgggtccaaatccactcttgttcgacaccagagaactcacacaggagaaaagccatatgagtgtggtgaatgtgggaaattattcagacaaagcttcagccttgttgtacaccagagaattcacactacagcaaggccttatgagtgtggccagtgtgggaaatcatttagcctaaagtgtggcctcattcagcaccagttaattcacagtggagctaggccctttgagtgtgatgagtgcggaaaatcctttagccaaagaaccaccctcaataaacaccacaaagttcacactgcagaaaggccttatgtatgtggggaatgtgggaaagcttttatgttcaaatctaaacttgttaggcaccagagaactcacactggagaaaggccttttgagtgcagtgaatgtgggaaattttttagacaaagctataccctcgttgaacaccagaaaattcacactggattaaggccttacgactgtggacagtgcgggaaatcctttatccaaaagtctagcctcattcaacaccaagtggttcacacaggagaaaggccatatgagtgtggcaaatgtgggaagtcctttacacaacactctggcctcattctccaccgaaaatctcacactgtggagaggcctcgtgacagcagcaaatgtggaaaaccctacagcccaagatctaacattgtttaactcttgaaactccaaacctgagaaaagccttagacctgcagggaatgtgccatgtctttcttcagtgttatggctatagagagcctttgtgaaggagccgtctgcctaaagttaaacctcatacttctagacctcccgatgggtcagactcccattagttccaggcatatgtgtcttgcaggagctcctttgcatgttctaaactgctggaggcctttgccagagttaaatcattagtcacccttgcatactaaggcgaggcagatacacctgtgttctcccaacccttggaggaaattccttgagcagtctgagcctttaaggggaattccttcccttttctgactgattacagcatacatctgaccagttttggccagaagggcccagcctgggttctgctggaagctgatgtggaaggcttcccttcatggaaattcttgttttcacacaacacttggtagtttttccagcctccaagtcaccacctagtaactggctgcctcacattgctctggtttgtgtggtaataaaggccttatttttaaatcta

SEQ ID NO: 175042 - DNA, 348 bp, Homo sapiens
tactactactaaattcgcggccgcgtcgagcagatacacctgtgttctcccaacccttggaggaaattccttgagcagtctgagcctttaaggggaattccttcccttttctgactgattacagcatacatctgaccagttttggccagaagggcccagcctgggttctgctggaagctgatgtggaaggcttcccttcatggaaattcttgttttcacacaacacttggtagtttttccagcctccaagtcaccacctagtaactggctgcctcacattgctctggtttgtgtggtaataaaggccttatttttaaatctaaaaaaaaagtcgacgcggccgcgaat

SEQ ID NO: 175043 - DNA, 1609 bp, Homo sapiens
ttgcatacggtaaggcgggacttccggcaccgctccgagatggtaattttggtggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcggttcccgtgactgcagaagctaaacttatgggctttacacagggctgtgtgacctttgaggacgtggccatttacttctcccaggaagaatgggggctccttgatgaggctcagaggctcctgtaccgcgatgtgatgctggagaactttgcacttataactgcgctggtttgttggcatgggatggaggatgaagagacacctgagcaaagtgtttctgtagaaggagtacctcaggtcaggactccagaggccagtccatccacccagaagattcaatcctgtgacatgtgtgtcccattcctgaccgacattttgcacctgaccgatttgcctgggcaggaactatacttgactggggcatgtgcggtctttcaccaggaccagaagcatcatagtgcagagaaacccttggaaagtgacatggacaaggcctcatttgtgcagtgctgcctgttccatgagtcaggaatgcctttcaccagcagtgaggttgggaaggacttcctagccccattgggcattcttcagccgcaagctattgctaactatgagaagccaaacaaaatcagcaaatgtgaggaggcctttcatgttggaataagtcattacaagtggagtcaatgcaggagagagtccagccacaaacacactttttttcaccctagagtctgcactggaaaaaggctttatgaatctagcaaatgtgggaaagcctgctgctgtgagtgctcccttgttcagctgcaaagagtccaccctggagaaaggccttatgagtgcagtgaatgtgggaaatcttttagccaaacctctcatctgaatgatcatcggagaatccacactggagaaaggccttatgtgtgtggtcagtgtgggaaatcatttagccaaagagccaccctcattaaacatcacagagttcacactggagaaaggccttacgagtgtggtgaatgtgggaaatcttttagccaaagttccaaccttattgaacattgcagaattcacactggagaaaggccttatgagtgtgatgaatgtggaaaagcctttgggtccaaatccactcttgttcgacaccagagaactcacacaggagaaaagccatatgagtgtggtgaatgtgggaaattattcagacaaagcttcagccttgttgtacaccagagaattcacactacagcaaggccttatgagtgtggccagtgtgggaaatcatttagcctaaagtgtggcctcattcagcaccagttaattcacagtggagctaggccctttgagtgtgatgagtgcggaaaatcctttagccaaagaaccaccctcaataaacaccacaaagttcacactgca

SEQ ID NO: 175044 - DNA, 107 bp, Homo sapiens
atatgaaggaataacttcaagagctttcgtacccccccaccaaaaacacccacaaaagttccatgaagaagaaaataaaatcctgcaagagacatttagattatata

SEQ ID NO: 175045 - DNA, 695 bp, Homo sapiens
atcggctcctgatccaggacaaggacccggccttttatctgtgtagcccagtgctctccatagcacctgtctcatcagaggtgagtgataaacacttgaggaatgaatcagtgcgttaatgacattcttcatagcagaaaatgtgtattaatcatttctgtgtcccttgactgtatttagccaaatgtttttttatatggaaactggataatattttttaagtaaacagataaatgaagaaatgaatgagtgattgaattaatagtgaaacttgctaaatatatgttgaatttaaacagattagtagatagaaaaagactttgggaaaaggataaaagctctatactaaatatagttccttaatggatattttattcttccccggtttccttattttgtcaatttttcctgacattattcactgtctcttgtgctagtactgttcattctcctaccttgtcactggaatttaatgtgagcgtctgtggtggaggaggaggccccaggtttgcaccgtacttagtacagggatgtaacattcagtcgtgaatatgtgttaaactgtttttcttgtacagggatggatttgcacaggtccattgccaagctcttgtcctgttcatttgtgagcaaagatgggtgtccggggacacatggcagactgtgcccattgacgggagtaagcgagctgaaca

SEQ ID NO: 175046 - DNA, 320 bp, Homo sapiens
aaggcattactgggaatcagggatttgtcagtgtttctggcaggtgtgatctcttggatgtcaattaagcaatcagcatcctctgatgcatattctgagctcagaggtgcaaattagagacccatgtgcctgtttgctagtagtgtttacaagtttttaaattagttatcaacattccataattgtaagaattcacataaaggtctggatagcctgcttttccttaaactgaaagatcaaacaatcttaggcccatatttctgcagagtaaccaggtttgagctatcctaaattggctttcttcagtgatttgtgctccc

SEQ ID NO: 175047 - DNA, 216 bp, Homo sapiens
atggcccaaggggtatgcagacgtcaccagtcaatcacaacactcactccttagccaagttcagacagaccttcaaatccttctcaagtcagtactccaacctcctgccctttaaagcgtgggcctttgaccaatggcattggcatcacttgggagcttataacaaatgcagaattacgcctgtaatcctagcactttgggaggccgagacgggtg

SEQ ID NO: 175048 - DNA, 379 bp, Homo sapiens
aaacttttgatttgttcaagagacagtaatgaggcctgtatggctaaaaattattaccactgaagaaagtagtatgagctatcattagagaggtaagcagagggtccagaccctgtggggctttggaagagtttgatcttgagtcaatggtactgggaagccactgcaggtttgtaaaagcaaggggtgatgtgaccagacttatttttaaacatgtatgctctgtgaaaaactgatgaaaacaggtcaacagtggtggcaggaacaccagttgagaggttgagtagttcaggaaagagataatgctggcatggactagggtaaaagagtagacgaggggaatggagtagtctgagatttacttaggaggaagtagcaa

SEQ ID NO: 175049 - DNA, 642 bp, Homo sapiens
cagggccctaaagtaccagtggcagtagtatccaagtaagtgagaagacagaaggtagagcaatatttttccaggctcatggtacagaggttgattacaatacctctgtactgtatcattaggctttgtgaatagcctgatcagtttgccaaggaatggaagtggagatcggaagttttcattaatttacttacttagggctcagacttacactattggttttattacccttgttatattatctttcatatctgtttctaggttgattacacattgaatcaagttgtacattcctaggccctcacagggaaagaaggagacagatctgtgtttgaatgtctgtctctgctacttagctgtataatcttaaggtagataacctaacccctctgaactctagtttccccatctgtatgatggattgataatgcctaccttatcaggtcattgtgaaaattaaagatatgtgaaaatactcaacatgttcttagcacatagattctttcacatttgcttcacttcttatttagtttttgttgtaggttatcctgtgtatttgaccttccaaacaaaggttgcttttgactttatgacttaaggttggaatatctcctactactcccctgtcctccttggaccaga

SEQ ID NO: 175050 - DNA, 610 bp, Homo sapiens
agaggaaccttgcctattgatcaggacactgggcctgggaagagaatgttccagtcacgaggacaggatggctgtcatttcacctgctatggcagatttacaaacaaatctagcctgtggcatgagtcgtttggaaagttttgcaataaatgtatcagtaacttcaccagtagacacatccatgtctgtctgtcctactttgcagccagtttttcttacttccctgttcccctttcattttacgatcagtttattcttttcagattgccagttactcttcccctgccccccatcctctgggtttcattagaaagaaaccattccccaactcaacagggcttgatttctgaactgtgctttagaattctgctggagaggctatctgctctcagttctgccattggtaggctttaaccacaaattccaaggcaatttcatttgcgtttttaggaaaaacgtatctccccaaccttgtaactgacactggaaattgaagtgccttcacttgctgctgtttaatggcaacctcatgacatgtgctcagttggctcgatttgtgagtggctcgatttctgagtgctgggatggcactgcatgagtagggatctct

SEQ ID NO: 175051 - DNA, 577 bp, Homo sapiens
ggatgcaaggatatttcaacatacacaaatcaatgaatgtgatacatcacatcaacatgatgaaggccaaaatccatatgactatctcaataaatgcagaagaagcatttgataaaattcaacaccttttcgtaataaaaactctcaacaaactaggcataaaaggatcatgccttaatataataaaggctctatgtgacaaaacccacagctaacatcatacagaatggtgaaaagttgaaagctttttctttaggaactgggaaaagacaagtatacacatgttcacccctcctactcaacatagtactattctatctatccaaggggggctgcacatcagccctgtctcctgtctgccatcttcctggcaagagctcataaagcaagttccaaaataatcttatatttagaaaaaccaaacactccaccagaacactcttagaactgataagccaattcagtagacttggcaggatacaaaattaatatgcagaaataagtagcatttctattcaccaacaatgaaatagctgaaaaagaaatgaagaagagaattccatttatgatagctaca

SEQ ID NO: 175052 - DNA, 678 bp, Homo sapiens
gatgtcatccaatgaattcacttgagtcctatgccttcaacatgaaagccactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctgagctgttgtaactgggttacaacagctcaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtgtgttagatcaacaattaagatgaaaacaaaactttaaaacaaatggaagaagtttaaaggcacactctggcatgctcttggtattatttacaaaggagttttcctttcaatgttgtttataaggaaactccaggaagcctgattttagcatctatacaggccattatcatattaattttttgcattaaccaacactcccctcttttgaattttcacctcatcttaagttccttctctacgtattttaaaacctcttttgc

SEQ ID NO: 175053 - DNA, 502 bp, Homo sapiens
tattctactcatagataagcttcctgatggcaaggatcctgcctaattactgcattttccacaatggctaacccatggcaggtccccagtaaaggttaatctgatgaatgctgaatcactattttatagaactgaatcttatcttccctcttgatttgtaatttagatcatatagttcttgactatattgaggaggccaagtgtttgttgaatggcattttacaaaagctttccaggtatttcctggccttgtttacttccagcaataatcacaaaagtcattttcccccttacataatgtaatctttgttcttaaattgaaatattcttgcacaagatcattcttctgaccattttctgtgtaatgattactgtagctcactgccagctgagaccattgctcttacattttggctttcattaaatttgagagagacttttcattatgctgtcattatttgatgggcatgcctagatagtgccttctccacactgacacagt

SEQ ID NO: 175054 - DNA, 1174 bp, Homo sapiens
  misc_feature (1)..(2): n is a, c, g, or t
  misc_feature (4)..(4): n is a, c, g, or t
nncncggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatg

SEQ ID NO: 175055 - DNA, 1620 bp, Homo sapiens
ggaaggtcctccctaggcctcacctcaggtccagactgcgggaggaccctgaggggccaggggtagccatgaggcctagtctgggacggagcctcgggctggagtagcttcgggggcctgggctgccccctggctgtggtccgtgggaaagggccctgctcaggcggggcgggctggggaggcctccggggacagctgcactccagagctgcctccaggctggtcccgggcgccctgccttagtttattgcccatgcagcccacccccagcttcctctctccttctgtctgtctgtctgtctgtctgtctctctctctctctctgtctctctctctctctctttctctgtctctggaccacaggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccggaacgctctatctcttcaactggatctggcgctaccatttcgagggcttcttcgacctcatcgccattgtggcaggcctggtccagacagtcctctactgcgatttcttctacctctatattaccaaagtcctaaaggggaagaagttgagtttgcggcatagccccggtcctctccatctctctcctcggcagcagcgggaggcagaggaaggcggagaagatgaagagctttcccatccagggtgacttttttaagaaccactcttgtgctccccatcccgctcctgccgggtttcagggggacagtggaggatccaggtctggggagcctcaggactgggctgttggtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatg

SEQ ID NO: 175056 - DNA, 1540 bp, Homo sapiens
  misc_feature (1)..(2): n is a, c, g, or t
  misc_feature (4)..(4): n is a, c, g, or t
nncncggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccggaacgctctatctcttcaactggatctggcgctaccatttcgagggcttcttcgacctcatcgccattgtggcaggcctggtccagacagtcctctactgcgatttcttctacctctatattaccaaagtcctaaaggggaagaagttgagtttgcggcatagccccggtcctctccatctctctcctcggcagcagcgggaggcagaggaaggcggagaagatgaagagctttcccatccagggtgacttttttaagaaccactcttgtgctccccatcccgctcctgccgggtttcagggggacagtggaggatccaggtctggggagcctcaggactgggctgttggtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatg

SEQ ID NO: 175057 - DNA, 338 bp, Homo sapiens
aggtgctggctatgggattttgtgagggacctaaggaggtataggctgagcactgagtccactgtgcagagaaaggtcttatgtgttacaaacctgtctcgctccctccctgcctgccatctgactcactctgctcattcatcaaaacccagctccatggttacttcaaaggctccccaggacctcactctcatttagttactgtttgctatgacccctctgggattctacgcatgtctctgtcctagaccttactgtgggataactacagtggttaatttatctgcctagcatgattcaagtaaacgtattaaacaaatacaaatggagtacctgct

SEQ ID NO: 175058 - DNA, 346 bp, Homo sapiens
ttttatggattcaccacaataactttgggcctaataatgaaattttcgactgaaatccaaattcctaaaatcactactctgcttttcagtgtcttcatatttggtaagtccacatgcaggaaaatatttgacttgctttaccttatgaaaactaaaagtaaaattgtgaacactacagactctacacatagacatgctgatgtcaaatcacaggaaaaaaaatgtgtgttttctgttatttgaattttttgaaatgagtatcttcaacaattttataaatctttccctggacagctataatgtgaccaactttaagttgtgacatccctctattttttcaatcacc

SEQ ID NO: 175059 - DNA, 567 bp, Homo sapiens
aacaacatagtcattgttttttcctgtggtaatggtttccaagttggacttttttttcctctaacaagaggccagtacccagttgattagcttacagatatcaactcactgaaagtaatcttttgttccctcatttcacacagcacaaaggttcgttctgatgtttcttcttctttaaggaaatctttagccatagaagtgtcactttttttttttctgcaaaagaattccaagatgaacgggttgaatgaatcatgccagccagggtcacatcctgtcctcagggggcccagtgctcaatagtagattctgcgggagtggagaagcgtcagtggcagctccgctcacttggtgagtgagggatttggctgtgatgagcctcagctccgagctctcaaatgtcctccagccagcatctgcctgcttcccacaaaaggatagaagagaggcaaagtgcgtgtttcataaaacctgcctgcacttttataacccatcaaagaggccatttttaaacacaggtacaatttaaacatgatctttctttgcaaataaatatgttttgtttca

SEQ ID NO: 175060 - DNA, 386 bp, Homo sapiens
tgtttcctggggaaagcctagctgactacctagcaaaggctgtaggatggcaccattgtatagtcacttaagtcatgaggtccagttctcattttgtaggctcagaaatttgattctgttggtgtacatagaggtggctcatactagccaaacgcatgagagactgacttatatactagaatatccttttataatttccctgggaaaaaaataaactgtcaggtaggtctggtcagcacttcctctgcttttggggagagaaacaggtggagaagtcagaggtttctgattggggcggatgtgcagcatgttcactagtaccctttctctggagacaccagcagtctgggcctctcgggcctccctggcattccttgcataccatt

SEQ ID NO: 175061 - DNA, 500 bp, Homo sapiens
atccatgacatatatattctgtatagcactaagcacatggtgcatttggtaaatggaacaactgaaaatattttgaagagcttatagacttttagcctgatatttaaaacccataagaaaatggcacaaagaccagattgcttttactgcagtatctcaagtgaaactgaaagtaatgacgtttattttgtgtgtgtggtaaaaacacataaaaattaccatcttatgacctctgatgtggtctccacagggaggaaaaaaatgaccattttaaccatttttaagtatatagttcaatagtgtaagtatacagttcaatagtgttatgtatattcatattattgtaaaacagcaccagagctttttcatcttgcaaatctaaaactctgcactcattaaataataacttcctttccaactactgtagccccggaaactaccattttactttatgtttctatgaatttgatgtcacatattaaataccgcacataaataga

SEQ ID NO: 175062 - DNA, 290 bp, Homo sapiens
caaccttgcagttccactgccatgtgaaaagcagagataaaaagagtgctgggataatccaggttaaaagacttgaataaaaaagatgacagtaactcacaaacagaaaagcatgactcttcatcccaactcacttgaaaatcaacactttcacagaaggcctccaagactggatgggatctgtttcaggatacatttggtgacagatattctatgaccttttgtgtgagagagaagatgcccaagttactatcagtgggaaatgaacaggaagccagggatggtgtggt

SEQ ID NO: 175063 - DNA, 866 bp, Homo sapiens
ctgacattcttctcatcacataacacataccagcagagaataaaaaggaaaaagaaaaagacatgaatatttgaaaaggccttttgaatcttgcaggcataaagtagaagtatatatcattctctcagacccggagtccatgcagatacacattgaaagacatgctttgtaacatcatcctcagctgatatgtcaaaggaaaagaattcattctcaccttttcagagtgcctgtcattaggtacattaatatggatgaaccaccacaaaatcaaaaagcagtaagagtggtgagtttaaaggaagaaagaccttaaactatatttaagttgggcttaaatttgagaacgaaacttggggtttccataattacctttttttctctacttaccttagaagaaaaaacattactaattagactttctcttgaagtctatttgccagcatttcactaaacattcctcaagcttccctataaatgagggaatggaactgatgtggacaagttgaggaagatttgttttttctgtcataacatcccttatttgaatgcatcacatttgacagtagaacacagaagtatttgcttttccaattcattctataacacaaataatgttaattcacaatcagttaagtagcaacccaaatgcattttattaacaaaaattcttaccaaaaatgtcaataagcatagacatttctataacattgaatattcaaaataagtttctgttaattcatatcccattcctatatatgatctctacaacacctagttcaatatttaagtcataattgcactggattactgtgtatataatatcatcacttgggaaagaatttgtcattaatacactaacaacg

SEQ ID NO: 175064 - DNA, 334 bp, Homo sapiens
  misc_feature (315)..(315): n is a, c, g, or t
gctcaaaagggaggttcgtcaacagtggcttcagggttttagtttaattaaagccagtgtataacctgagatgaaagaataggtttagaggaataggtgactggtttagtattggatgtactgaatttgagatgactctgcaagtggagatatttgtcagataattggaaatttaagattgaagtttagaggaggagttgggacagagataaaaatttggaaatcctactttggcctcccaaaatgtggggattacaggtgtgagccaccacgcctggccggtgccctggttttatctaatgtatttgtgacatntgttccctcctctccattt

SEQ ID NO: 175065 - DNA, 543 bp, Homo sapiens
gataatagccatcctgacaggtgtaaggtgatatctcattgtggtttggatttgcatttctttgatggttagtgacatagtttggatatttgtccccactcaaatctcaggttgaattgtaatccccaatgctggaggtggggcctagtgggaggtgtttgggttataagggtggatccttcatggcttggtgctatcttcaaaatagtaaatgaggtctcacaggatctggttgtgtggctttgggaggctggggtggtggatctcttgagcccaggagtttgagaccagcctgggcaacatggtgaaacccaatctctacaaaaaatacaaaaattagctgggtgtggtggtgcatgcctgtgggcctagctactggagaggctgaggtgggaagattgcttgagccagggaagtcaaggctgcagtgagccgagatcgtgccactgcactccagcctgggtgacagacgtgagactccatctctgaaaaaactaaattaaattaaaaataaaaatactacatacccaaacttatgttgtg

SEQ ID NO: 175066 - DNA, 868 bp, Homo sapiens
tgctcaagaagctgtattccagaaattaattgatgtaagattaaattgtaggtccttcatattgatgcttggaaatacccgaggctctcatttataattattctagtaatatggtggaaggagttttggtgtgagagaaagagatctagattttcttccttgatcttccatttccttgctttgtgggcacaggtgaaaacatggccacaccgagcttgattttatatctgtaaatgaaaaagtttacagtagactaggggaacacatggaaatgtcctcagggctcagattgataactttattagtttgctaggcctaccataacaaaataccatagactcaatgggttatacaacagaaatttattttctcacagtttcagaggctggaagtccaaaatcaaagtgcctcttgttgtcccttggtctcaggtttggtttcttctgagacctctcttattggtttgcagatgactgcccccttgctgtctcttcatgtcctctctgcacatgtaccccctacgtctctctgtcctaatctccccttatgggagcaccagattaggacccactgtaatggcctcatttaaatgtaatcacctttttaaagccccatctccaaatacagtcacattctcaggtacttgcttagggttaggtcttcaacatatggattttggaggagcatagttcagtctatgacagttacctaaacatagttggcagcttagtctagtagagagaatactttgccctcatctttatctctgcaactatgactgaaactcaagtttgtcttgatatgtgatgctgactgttatgggtctcagagtgtctgaagcaagcttgacactcttaagtaacttcta

SEQ ID NO: 175067 - DNA, 338 bp, Homo sapiens
gacagcgagctactggaagcaaggggtttttttaaaaatttttttacgattaacaaaaatctcttcactttgagacttaaaatggagatctcccaaagaaaatattttgatgtgctttttaggcataccaacatcatctaaaattcagtattagccatttttaacagctggattatgtttcccttatctaggtgttagtaagcatgcttggttaagcactttctagaaagaggactcagggctgttcttgatcacttttaagatcgttccaaccctaagattttcagtcattcttaggaaacataaaatcatttccaaccctaagattttccctcaga

SEQ ID NO: 175068 - DNA, 289 bp, Homo sapiens
gctagcaatatactcccaaagttgcatatgttttgagtgaacttcctagaatcaatttttcccacaagttctattatttaggtgctgttttgttttgcattgtgaggattacaagttgcatatgtcttattatgaactaaacctcattttacgaacatgaacctctccaactctgtattaccttatagtttctgaaagttataatgtgttgaatggtttgcaaattgcaaaataacttacttcctcagagagattatttcatttctttgataccactagtgttgtattt

SEQ ID NO: 175069 - DNA, 730 bp, Homo sapiens
tgcggtggctcacacctgtaatctgagcactttgggaggccaaggcaagtggatgacttgaggtcaggagttcaagaccagcttggccgatatggtgaaaccctgtctctactaaaaatacaaaaattagctgggtgtagtggcaggtgcctgtaatccctgctacttgggaggctgaggcaggagaatcgcttgaacccgggaggtagaggttgcagtgagccgagattgtaccactgcactccagcctgggtgacagagcaagactttgtctcaaaacaaaacaaaacaaaaattagccaggcgtggtggcaggtacctgtaatcccgtgctcctgaacaaatgtgagtttgaaaacatggtttaaaaggcaaatgtataaaaagggcagttttgtcaaaatttaagttcagaatgatttaaaaagaatggcatagccaaaaacactaaacgtgataaaagatagaagggaagtatatatcaattaaggcagttggtattcacactatggtttgcactggatggactacagatacagcacttaatttacgagagggacccagaacagtgaagggatttggaaaaatgaacaagggattcatttggcattcaacaaacagttcctgagcaatattccaggatgtaactgtataaaagactgacaaggtctcaggctttcatgcactttatatcacatcttttcatccgccttcccctccaaaaaagaga

SEQ ID NO: 175070 - DNA, 563 bp, Homo sapiens
ttttatattttatgtcctgttttactgaattcttagattcttaattcattcttattatgcctttaagctgcagtttttgatccactcctatggcacctattgttctcactcaggaaagtggatttttttttttggcatgaccaccacagaagaagccacattctttctgaaagagttattaaatgattaaatcacaagcaaacacttgaaacttgcacaatccccctacagatactgcaatccattctaattcttaggattaatttggttagtacagactctggttaaatctataaaacccatttgtagcaagagaagaaacaacaggtatctacaacccgaagatatgggagtcaactatcagaactgattctaaaacacagatgagtcagataattcaggaacatctcttggatagcaatgttccagttcaatggaaaaaagcactctaaaatgcacatgtgaaatccatttaaaggagaaagacaactagtaagggcatccacaattcctttgagttcagatacttagtgtgataatggatgatacttagacttcatggc

SEQ ID NO: 175071 - DNA, 308 bp, Homo sapiens
ggtgtccacttggaataagagttggaaaacactccaagaaatggatcctgtattaatatcacatctgtcccagatctccaacactgttcactttccttccacggtgccaacaccaagctagctgataggtgggaacagggcagctctgcggttggcccccaagagccagggagtcccccaagctgaccccctggggtggcagtggcacctaacaagaacttccaccttgttttccctctctctgttttgtccttttggactctgctcacgcatcacatccagaaagttccctaagctctccagtggga

SEQ ID NO: 175072 - DNA, 339 bp, Homo sapiens
ttacacagagccaactatgtggcttccactcaaagatacacttgattggaagcataaaaacaacttcataatacattgatgttgaaaatcagtgagttatagtcaatcttttcaaatcacctcttaaaaataattcgtcttgctctgtcacctaggctggagtacagtgacacaatcagctcaccacagcttgaaactcttgggctcaaactatcctcccgcttcagcctcttagtagctggaacttcagctgcgtatcaccacaaagagctaactttaaaattgtcttagaaatgggatcctactatgttgcctaggctgccattgttcttgatagag

SEQ ID NO: 175073 - DNA, 843 bp, Homo sapiens
acccccatcttccagtaatttgccaaaatgatgaacacaaacggaaagaggagaggcacccgatatatgttctctaggacttttagaaaacatggagttgttcctttggtcacgtatatgcgaatctataagaaaggtgatattgtagacatcaagggaatgggtactgttcaaaaaggaatgccccacaagtgttaccatggcaaaactggaagagtctacagtgttacccagcatgctgttggcattgttgtaaataaacaagggcaatattcttgccaagagcattaatgtgcatactgagcacatgaagcactctaagagccgagatagcttcctgaaatgcatgaggaaaatgatcagaaaaaaaaaacaaaaaaaaaaaaaaacaatttttgggcggcttctgggcctggaaaaagtttttaaaccccattctctttggggcgcggggccccagttggggtacggggacaccctgggccaaaggggtccaaaggagaaacccgggcacggacatcctggggttgggtttccccaccaaaataaaaaccgcgggggaacacggaagttgtttgtggcaagcacatccccgagggcagtttccggcggacccaagacggggtctccacacacgagggttcccagggagatcgaaataaatgccggccggcggggtgggaaacagcacaacccaccaccaaaacaagtagagagaaaaaacaacacgacagaaaaagcgcgacaacaacaacacacagagaacagcacgaaagcacgaaacaagcagagacagagaagcaacacacacatagcgaagagaaaaaacgatgaccgacagaa

SEQ ID NO: 175074 - DNA, 303 bp, Homo sapiens
cctagaggatcccggtattgagtgtcatgtgatgtggggctatgagccaagggatgtgggtggcctctagaagctggaaaaggcaaggaagcctacagatggaattcagccctatagataccttgattttagcccctcaagattcatttcaaacttctgatctccagaactataagagaagacattcatgttgttataagccacaaagtttgcggcagcaaatacaaatgcaaaggtgaataagaaagtaatcttatttccttttactatatctctttcgaaaggcagcatgatagagttgaa

SEQ ID NO: 175075 - DNA, 873 bp, Homo sapiens
actgtctcctctcacggccccgacagaaacggtttctgaggagtagaagtgtcctaagtggattggaaattacaaatgccggaaagaacctagggatggaaagcagccctcaactcagcccaccagcacccagttgaaataaacagccatgttgctcacagaaagcctgtttggtgatctcttcacacggacacatgaaacatttggtgccaaagacccgggtcagtgggactccttttggagaccagtcccctgtcctcaccctcactccgtgaagagatccacctacgacctcaggtcctcagaccaaccagcccaaggaacatctcaccgattttaaatcaggaccccactagaaattggactgtccaactggcccaaggctctgatcgactccttcccagatctcctcggcttagcagctgaagactgacactgcctgatcgcctcggaagccccttggaccatcacggacgctgagcttcgggtaactctcacagtgaaggccctgcatcccaatcctggtctccagctgctttccaagattgataggaaactgaattccaaaaaggaaacgaactaactcaaattttccctgatctggaattacaagcatcagctcattattcctgcaataaaaccgattggcaggagctaaacagaagacttctaaaaaatgaaaacccctggccgggcgcggtggctcacgcctgtaatcccagcactttgggacgccgaggcaggcggatcacgaggtcaggagatcgagaccatcccggctaacactgtgaaaccccgtctctactaaaatgcgaaaaatagccgggcgtgttggcgggcgcctgtagtcccagctactcgggaggctgaggc

SEQ ID NO: 175076 - DNA, 827 bp, Homo sapiens
actgtctcctctcacggccccgacagaaacggtttctgaggagtagaagtgtcctaagtggattggaaattacaaatgccggaaagaacctagggatggaaagcagccctcaactcagcccaccagcacccagttgaaataaacagccatgttgctcacagaaagcctgtttggtgatctcttcacacggacacatgaaacatttggtgccaaagacccgggtcagtgggactccttttggagaccagtcccctgtcctcaccctcactccgtgaagagatccacctacgacctcaggtcctcagaccaaccagcccaaggaacatctcaccgattttaaatcaggaccccactagaaattggactgtccaactggcccaaggctctgatcgactccttcccagatctcctcggcttagcagctgaagactgacactgcctgatcgcctcggaagccccttggaccatcacggacgctgagcttcgggtaactctcacagtgaagggaaactgaattccaaaaaggaaacgaactaactcaaattttccctgatctggaattacaagcatcagctcattattcctgcaataaaaccgattggcaggagctaaacagaagacttctaaaaaatgaaaacccctggccgggcgcggtggctcacgcctgtaatcccagcactttgggacgccgaggcaggcggatcacgaggtcaggagatcgagaccatcccggctaacactgtgaaaccccgtctctactaaaatgcgaaaaatagccgggcgtgttggcgggcgcctgtagtcccagctactcgggaggctgaggc

SEQ ID NO: 175077 - DNA, 241 bp, Homo sapiens
gtgcgctaaccccagctctgctgctgaccctgggaaaacaccttgagttctctgagaacctcagttttcctgtttgtaaagtgggggcggtaatagttcaagtctcatagagtgattataaggattcagtgagacaatccatgtgaagcgtggggcctgacacacagagagtgctccaggaatgtcagctactgtttttagaagtatcactagctagtgtggtgccctaagcatgtaaact

SEQ ID NO: 175078 - DNA, 320 bp, Homo sapiens
atgtaaacacgtcacaaagtatgtatttagccaaaattatgccttcaaaggcaggaaagaatgttactgaaacctaaagatcatttctaagcatacaatccctaacttcagtaaaatcatatatacaaaacagttaagatctaatcaaattaagctccagacttggttaaaataaagacggtatactggtcagttttagtcaaaacaacaattaggttatgcagattttcagaagtaacacaaaatgtacaaacaaaattctctttgtaaaacaataaatataatctcagttacacttataactaattcattgataccgg

SEQ ID NO: 175079 - DNA, 409 bp, Homo sapiens
tttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgtttt

SEQ ID NO: 175080 - DNA, 689 bp, Homo sapiens
attttactgtccattttacagctcaggaaactgaggctcagtcaggttgtgtaatatccctaagattactcagcttgcaagtaaaatagatggcagtcaaaacaagcactgtctaactgcaaaccccaggctcctgactaatgtgtttccagtgagcaatgttttatggtttttagcacatttactttggatacttatgtataagctcatttgtcatttttcaacctatactttaaaaaatttaagatctcaaatttctttttgatttgcagcattttcattgtcttaaccagctttgccaaattcatttccaatttcttttggtctctttctacaaatatatgctaaagatttttcatcgaattttccacaaattcccacaaaagatactgcaacagtgatgaaaacaaagtctttctttgatgctctatagacataagcatgtatttgttttatttttaggtatgatttttatagtatttttcatttttatgtataattgcttttatttttaggtatgataagtcaaaaatgtcatagggagtatcattgccctaagagactctggtaagaaatttatcaaatgaatgttccatacagaaaattttgaaagagtactacagcaaattttcaaggttgaagacactctgtatgagcagggtgatggaattcagccatttctcattttt

SEQ ID NO: 175081 - DNA, 528 bp, Homo sapiens
aggcggaggttgcagtgagctgagatcacgccactgcactccagcctcagcaacacagcgagactccgtctcaaaataaaaaataaaaacaaagaaaagagaaactcagatggtagctatcagaatcatccaaactagctcaaaattttgcttaaatctggctgagaagcaataagaagcaacatctatacatgtgtcttttgctcatgtccctcctgattctgaaacattaatttgatggcatattttaaacactgaagctccatggtcatgcacaacaatcaccagtaagatataataattttacggatcacttgaggtcaggagttcgagaccagcctggccgacatggtgaaatcctgtccttactaaaaatacaaaaattagcccggggtggtggcgcatgcctgtaatcccagctactcgggaggctgagccaggagaatcgcttgaacccgggaggtggaggttggagtgagcccagatcgcgccactgcactccagcctgggtgacagagggagactcct

SEQ ID NO: 175082 - DNA, 514 bp, Homo sapiens
cctgtaatcccagttactcaggaggctaaggcaggagaattgcttgaacttgggaggtggaggttgcagtgagccgagattgcaccactgtactccagcctaggcaacagagtgggactccctctcaaaaaaaaaaagaaaaagcaaagaaacaaacctctcttcttaaccaaagcaaagttttctaacactgggcaatacttgctaataatcagagctgttggctgaaatgaaatccatttagaatagtcagtgtgtgatgaaagtagtactgtcatcactttgttgttgtttttgcagttgtataattttatttgatgaccagtggttagttcttatccacatggagtgtctgtagattttgaaagtggtaacaggtacataagtaaccaaagtatagagcttgttttagtgaatttttatcttcattacattttctggacaaccacgcagggatacactgtgtgagacattccttattcctttggcccagacagctttgttgagcctgcta

SEQ ID NO: 175083 - DNA, 368 bp, Homo sapiens
gactcgagttagtaccctcgataggcaacagcaacgtatcatcactgggcaatacttgctaataatcagagctgttggctgaaatgaaatccatttagaatagtcagtgtgtgatgaaagtagtactgtcatcactttgttgttgtttttgcagttgtataattttatttgatgaccagtggttagttcttatccacatggagtgtctgtagattttgaaagtggtaacaggtacataagtaaccaaagtatagagcttgttttagtgaatttttatcttcattacattttctggacaaccacgcagggatacactgtgtgagacattccttattcctttggcccagacagctttgttgagcctgcta

SEQ ID NO: 175084 - DNA, 383 bp, Homo sapiens
gtgcttggatcacagaaatgtgccactttctgagaatgccctagtagatgtacacagcaggggcctcactggccatttttctgccatgtcatctcttggcccttttttatggagctctacaaatcactgcagcgtggaactggttcttgcccatcccgaggtttggatgttcagtttctcctgaagtctacagtatttgttttcaattgtatcccccttttttgcttaaactagacagaattggtgtttttgggcaaacactatttaaaccttttaaaaagggtctgggggtctgggtactgtggctcatgcctataattttggcattttgggaggctgaggtgggcagatctcttgaggccaggagtttgagaccagcctgg

SEQ ID NO: 175085 - DNA, 1204 bp, Homo sapiens
ggccgcgcaaccagcgcgggagggaacacagccccctacttacctaccccagaaaggatacctggaacatacagtcggtgggcccgggttctccctagtatttccttataaaaacattttattcggaggcggagagtgagggacgttttgaggaaccacacaaagtagttgcgagttctaccccagaacaatggtttctggagctccctcaaacaatgcctgcattaccatttccaccaacacagataaatcagacgaatgtcaccattaacaatatcttcctctcgacgacagtaaactgtctcaattgctaaaagatctacttccatcgctgagtctggcgtggagatttctccctgtcctgggaatgatgttaaatgcaaccaaaagagctcattaaatgtcctcaaaatgtaaaaggaagtgtaaaagacacactaagatcattttaaccggattttataagcacaagtgaaacctaaaagttatgtgtacaccctatcctgattaaagaaaaactaagtagcaaatccaagcagagggacattaaaatgcagccttcttcttactaggggtgctaagtggtgacctcataaatcattagctaggttcccaacgcctatcagaacctgctacactccatattaaattaaatgtttcgagactattgggtaatacattatttgagttctaatttagttatcaataaatgcagtttaaaatgatttctaaataagcatggcattagcacatttactatttacaatgcaaaccaggctattgataatttgaaaatactttctggaattaaacttaaaccagtacctctgcttcaattctatatatttatggtttcctcacaaccctcctgaaatggaattagagcgagccaataattttattaaagctgtaaaggcttctgttaaagctgcttttctttggagaggaaatgtatctggatgtgatttttactaaaatgctatttcaaattactgcatcaaatattgcagcagtatgtccgttgacagtttaatgattactacattagattgtaaggaaaatggtcagatgaacttacctccttgcttggtgaatttaaaacattatttaagttccgtaggaaaatagaaaatttattacatctctcatttggcccagttagtcactgaaatttgttggttatgtttagcagcccttgcatgga

SEQ ID NO: 175086 - DNA, 621 bp, Homo sapiens
aaatgtcaacaggggccatcgaaattattgaaatgaaaggggtgttaggcaggggctgttgtagacttgcaggaggctggccttgcccaaggaggggcagcactcattggagtccggggaaagctgggctcagtattgccccatcttctgttttctctagaaaaatcaaatatctggttttctagtgaaatctctacctgttgaagtcacatttttggaaatactgtgtgggctagaacaaaacacatctgggagctagtcatcttgattctagggcttctctttcttttttcacctcaccatatttctctatattcatttgccagcatttctttgtctccagggtcacttcttttccttcctgtctcacatgtccagttgttttctctctaccttttatctgcataaaaacattcaggatgtcccccttcctaagcacatagctaatgactcctccttctgtgctactccccgtgtcccgtcttttcttcgttctttcatactgagtttataaacagtgaaggggtctacgttcattgctcttacttcttcactccttttaacacctacagtcgtttgtcttcacgacttctctgaagctgtctcattccctggacccta

SEQ ID NO: 175087 - DNA, 194 bp, Homo sapiens
agaatctccctgtgtttttatttcctgtactgggtgattgattacagaagagcaaattagctcctactgcttttaagatgcattttctttcttaaagagaagatgatgtgagcattacttctccctgtccactgtgtgccttggctttgggcctgtagtcactgcagctttggtagggccttcctggaagggag

SEQ ID NO: 175088 - DNA, 285 bp, Homo sapiens
gaaagaacttttgcctatccaaagactcaggaaaaataaaaaagaaagccagccctcataatgagataccacttcacagttacatctgttggaaaaaaaaaaaaaggataacaacaaatgttggcaaggatgtgaggcaactggaagccttctgcattgctggtgggaagatggagctgcgcggctgctgtgggaagactcctctaaacgctacacctggagtcaccacggggtccagcaattctactcctgattatagaccccaaagaattgaaaactggtgtt

SEQ ID NO: 175089 - DNA, 221 bp, Homo sapiens
agcagctccatgaaaacaggactcactccaatacagttggtaaaatacttccatttctggatatgagctttcctgttcaggaggatgaggccaatgattaatcagtttaccatatgtcaagcaattgaagctggtgaactgtaagatcagccaaatctttggagaatattagtccctgggttttctctattaaaatatttctagccaggagcggtggctca

SEQ ID NO: 175090 - DNA, 278 bp, Homo sapiens
gtgtacacacggtatactaccttctgtgtaaatgggggtagggaaacaaggttataggttcatacttgctcatatatacattatgaaactttgcaaggctacacaggaaaccaacaacagtggttacatggggcagtggaggtggaaggggcacactagaaactgggcagatggaggaagcctgagaaggagatgttctctctccccccctttctttttatctaacacacacttttgaaaacattgtatgattcacctggtcttatatgaacaaaaaa

SEQ ID NO: 175091 - DNA, 269 bp, Homo sapiens
tggtcggcgtgacttggtcagggcgatagtgaatccacagcgctgtcctgtacgtaagccggtgctgttactttctaaagctaatgagaaacacggcagcagcttcaaagctgatacgcagggtacgcgattcccagctgctccgaagtgctgaccgctctacaacacggggagcagcccggggcgcagccgcaaagggagtgtggatgatctttctagagcagcagtttgactcaacagtaagtattttaagcatgaaacatgattgt

SEQ ID NO: 175092 - DNA, 558 bp, Homo sapiens
caaagtaaccataggatgaatatggggacccatgtgaggagaacctgggttaaacttccattgaccacctaacctcaacaagtccctactctgaatggcgggccaaaatgacactttgagtgtcctggaattagtgtcagttcagacttaagagttcagtaatctgtgagaagtctaattatttcctcttctccagtgcacacttaccctgataagccataggtccctttgggaaacctgagaaaaaaattaacggtataaattcttagcagcgcaatggggtccttcctcaaaaggatccagcctcccctcagtcagggggttctgagtctgtaaaatgactcaaatctgggaactgattgagggaccatgactctttctttggtaattaaagtaaagcttccattcacttgacctagaactcttctgcttatagagatcaagtcagaattcagtagactgcccaacgagttctcttctagggacaccatgaccacctacccaattaggacccccaagtcaggctgttcagattgttgctttgactccgctgtcccc

SEQ ID NO: 175093 - DNA, 384 bp, Homo sapiens
attgctggtgaagagataaaagtggatgcattacagtaaaaacagaataattaaacacttggcctcacatttgtattgaaggatgaaaaaaaatgccaacagtctgtcagactctccaagaatgccagaagagtcctccatttcctccctctgtaagaattgtgataaattctattgtgaacacttagttaattaattgtggggcaacaaagtcaatgatatagaactgtggggaaaaccaaattccattaatttggctttgggctacagaaatggcctagaaaatgttgagatcgaaaggagtgggtaactgatcaagtttagcatattctatatgagggagagttgaaagctattaattggtgttcgtttctgtttagtgca

SEQ ID NO: 175094 - DNA, 384 bp, Homo sapiens
ctcttcctctacacatggaaaacatgtacatttgagggtatcaccttttctttgcactgcaacttttcacttgccagttctccacttgttcttgctggttgtgagtcactggtgaattttagaactagaaccatattatatcaatctttatagttccgcagcctggtaccaggtgtgggcatcaaaaaatggttcccaatccaagcttgctgaaagtgatattcaacagatgacaaaagaaaggagccagaatgctggtctgctaatccacattgctttccactattgctttgctgaaactctcccaatgtcatgagaaatataacaatgataataataatactagcagtaaatagagaagacaagtcagttaaaattgagctg

SEQ ID NO: 175095 - DNA, 813 bp, Homo sapiens
cgccccccccccccccgccactcccgccccgccccccccgccgccactacgctaggtcagccggggttgaaaacattaaaaatactgtacagtattactagtaagagaaactctgtagccacaagggaacatcactcccaccctactgatgagaaaaagcctgaagtacaaatctttttttcttaagcatgtcagagaacagaggtcacaaggcaaccaggcgaactgaacttcaaagggtgataaacccctctaaggaaagacaaaaactgagaatgggaggaagaggcagatgccataaaagagggtaagaagaagtgacatattacaaaatacttaaagtcccacggtaggctagtattgaatgtagaatctctggaagccccagatagtcactctctaactcttctccacagacctcagtgtgtgctcacaagaaagattaggggtgaagctggagagtaaagagagcccctgctaatggtacagggaacaaaaccccactcacttcctggaagtttatctcatagaagaaaacctgtcaggcgctgggaaaggggcaggaaaccctttcactccctctaagaaaagggtatatgcaaaaggcatgtaatgctgggaggggcagaactccactcccctgccccacacactcctccaccctcaccagcccagtgtcaggcaaaagtccactattctagagaaggggaagaagcaaaatatctaccactgggcagcgggggtgggtggcaggaaagtctaaggggcccagagtccttaagtgacataaagcagatatctaccacgggggca

SEQ ID NO: 175096 - DNA, 1024 bp, Homo sapiens
gtcagagcctgagtgaaatgggggcatccacaaccagcaagcagcctggcaggaggggccagagcccgagacaggtggcctggtgtagggcatcacagcctgagcagctggacagggcactgtacagagtggtggcctggcacaagcagggacagggcatccatgagttgtagggaaggcagcaatgatgggagatgggttacacacagggggactgatcaaatgagtcaacatagtaagaataacgggagccaggtttcactgttagaggagggggttgaaaacattaaaaatactgtacagtattactagtaagagaaactctgtagccacaagggaacatcactcccaccctactgatgagaaaaagcctgaagtacaaatctttttttcttaagcatgtcagagaacagaggtcacaaggcaaccaggcgaactgaacttcaaagggtgataaacccctctaaggaaagacaaaaactgagaatgggaggaagaggcagatgccataaaagagggtaagaagaagtgacatattacaaaatacttaaagtcccacggtaggctagtattgaatgtagaatctctggaagccccagatagtcactctctaactcttctccacagacctcagtgtgtgctcacaagaaagattaggggtgaagctggagagtaaagagagcccctgctaatggtacagggaacaaaaccccactcacttcctggaagtttatctcatagaagaaaacctgtcaggcgctgggaaaggggcaggaaaccctttcactccctctaagaaaagggtatatgcaaaaggcatgtaatgctgggaggggcagaactccactcccctgccccacacactcctccaccctcaccagcccagtgtcaggcaaaagtccactattctagagaaggggaagaagcaaaatatctaccactgggcagcgggggtgggtggcaggaaagtctaaggggcccagagtccttaagtgacataaagcagatatctaccacgggggca

SEQ ID NO: 175097 - DNA, 491 bp, Homo sapiens
cgttgaataaaagaatataccagaaaaataggttgtttttctcacttctctgagagtatttctgatttcccaggccaaaactaacctattgtggattgggacaggactaaggaggatggtgagcacatagaggggtatgtgtgggtcaggaactgtgcagtgactgagtagtggaggccatggctggccctgtgctccaagaggaagggaaagggatctggcagggctggccaggttggaggtagagagagaatttatgagcagaaggactgtgtgctcaaggaggcatgctgctgttcaaggaaatggtttaaatggggctgccacgtggttatgtgtctgtcacgagaggcttgttaagcagttagcacttgagtcatttttctacacttccattcagccaggcagacagctgtggttatgagtgggaacaattttggccattatgtggtgtggcttggttgaaaatgcttatggcaagctgcctaagg

SEQ ID NO: 175098 - DNA, 335 bp, Homo sapiens
tagaaggtcaagtccaaatatccagacgtatatgaaaagatgaaaagctgctcaaatttgctactagtcaaggagatgaaagcaatgagagggattgatgttttgattagcctggattggaactttgataactctgatactttgataactcttattgttatcaaaaagctatgggatttgccttaggtgttaccaaagacaggatgaaggacatttgataatgtttgaaaacagtaataggaaaaaaaaaatgaagctgtttcctaattgtatctactaaattcacccatttctctcttcctctctctctcactctctctgttccatctcactcc

SEQ ID NO: 175099 - DNA, 516 bp, Homo sapiens
cgagacgtttggagctggtcactcctctcccgctcacaccccctctgggcctcggtcccctcaatcataaaaacaattgaacgggaacgtcctttatacctttaactagaaaagcttgactcttcttatctagtagtgttaaagttggcggtttctagctggaaactatggcttaggtttttcagttctgctctggaaagcgtagccctgggaaggtgtggactgtgttatacccaagagtacataggatgaaaaaagccacgacagagggaagaacacaaaatcagctctgtgtccaagtagcaaagcagtcctgcttcattagtcaattaaaattctttggtcttaagagatgtaacttgggctgggtgctgtggcccctgcctgtaatttcagcgctttgggaggccaggcgggaggatggtccgaggccaggaaggagttcaagaccagcctgggcaacatagtgggtccctgtctttacaaaaataaaaaaattgcctggtgtggtggtgt

SEQ ID NO: 175100 - DNA, 570 bp, Homo sapiens
ggatcacacataatttgcaagattatctcaacagctaaattgccataattagaagaccacatattatttttataattagaatatttacaaaatcataataaatgctacatggaaaaactatagggaaaaataagtccatatatatgtatatataattcatatatctcagaaagtgcaacaagtgctatttgttcttgaaaaaaggttataaattgaaaatgaagactatggaaaataaggacaatgacaggactgattatgtgtagttgttctagtaatgaaaagcaatactactcaagctaggcgagagagaagaggaagtggtgcaatcgtgcatcttaatacggagcaagagcccaaagtggagcacataatatcacagcctttgaaatagattcatcatacactacgtttagagtttccaaaagcacacaattttcaggaagaactaagttaaataatgcttcaaatcaccatatatccacttttaacataaaattcaattctataaccaattcagtagaaagctaaagaacgtagtgccaatattcttaagtcaataattcttac

SEQ ID NO: 175101 - DNA, 174 bp, Homo sapiens
aggcaggctcacggtgtcgtcagaattcagaacgatggtcgtggggctgggggtgctgggaggggctgggcatggttggctttgtgatctggggtctggtgtgttccatctctgaatctctctcgagctgcactctttcttaatacattttcataagtttaaccaaaaataaaa

SEQ ID NO: 175102 - DNA, 184 bp, Homo sapiens
gtttcctgagttgggaagggactggaaaggggattaaagagaagaaaaaatgaaagggtaggcatgatagcaggtagagatcagacttcatctgtgtaactccagagaccagaatcaggtctgaaaaacacagttgtagacaggttaacttctattcaatttaataactactcctggagctgct

SEQ ID NO: 175103 - DNA, 514 bp, Homo sapiens
taaaacacagcctatatcaatgagggcctgggagaaaactggggtgggggaggactgtgcctctcttgaccttcatttacaaaaaataagttggctcctagacccgtgttggagccacactgcccgggacagccctgaagcagccacgtccccacctttcaggagtcggccaagagcacggtggctgcagaaggccctggctgatggagataacatttgacaaacagggtgagcgccttccccctccgcccctcttttagaaacccggcgttctttatggctttgctcaggtagatcattcattgccataaattttcttatctccagtgcttttccaattatggataacaacagaaaagcagtcattggtttctaaaaggtcatcaagatataaagcccgtttgggaagggaatgacttacgcagtgggcttgtataaatctggagaagttttatgcacaagtcggacaagaaatgtaagtgagattcataaaatatataacgattcatggtgt

SEQ ID NO: 175104 - DNA, 250 bp, Homo sapiens
aatatcagtgagatgagtgcttggttccacaagatcatgaactggaaggacttctcatttgggtattaaagtgctggcatgcttactttttgaaagtctcatttattgatgctttgaaagctcaaatacagcatgcaaatatgaatttcttttaatgatttcattttgtgagattattttattaggataaaactgactcattcaaaataattggagaaaagatgaatcatagtcattatatagtatgaaa

SEQ ID NO: 175105 - DNA, 141 bp, Homo sapiens
taatgcaaagttatttgcctaggcccatatttatacgatgagaaatccatgttttgagacaataaagtggtccatatatttttgtgttatctagataagccattttgaaaacatacagctttgaaatctgtcttgaatcca

SEQ ID NO: 175106 - DNA, 665 bp, Homo sapiens
  misc_feature (529)..(529): n is a, c, g, or t
  misc_feature (553)..(553): n is a, c, g, or t
taattgatatttatagactactgcaacaaacaacagcagaatacacattcttttcaagaatcatagaaaaatgaccaagatagaccataccctaggctataaaaccaacctcaacaaatttaaatgaataaaatacaaagtatgttccacaaggaaatcaaacaaaaaatcaataacagaaagaccacagaaaagtctccaaaggaattaaaaaataaaaacaaaagctttctggaaaagcaaaaactatttggaaattaataacccacagttaaatgacctataggtcaaagaagaaatctcaaaggtcattttaaaaataaatacacctggccgggcatgatggctcagccatttttgtatttttagtagagatggggtttcaccacgttggccaggatggtcttgatctcctgaccttgtgatccacccaccttggcctcccaaagtgctgggattacaggcgtgagccaccgcgcccggccatttttttcaataaatatattggaaacttctttggagatttgcnacaatttgaaacaacagacatagnctagaaatatcggtaagattaagaaaaagttaagcatgtcatgaatgcgtaaaatataagtaggtactaagtctgttcatcatttactagcataaatatcacaaatctattc

SEQ ID NO: 175107 - DNA, 413 bp, Homo sapiens
gattaggggagagaatgctgtatgtgaagtttccctatttggggtgaggcctgaagcccctaagagaggaggagatttgaaaaccacagacagagcccagtcctttcatgttatagcaggggaaatagaaacacataaattttgttcagctgcctatagctttctcctcctgtggttctgctcagtttccagaaagcctgggtaacgtctgaatcctcctggaatctctcttcttccttctggtacggtgtgggccatttcaaagctcaggcaggtggcctttcctagagggagcagagacagcgcagctactggatgagctcctaggcacctttcagtgtgggagcctcaagaagtgaaagaaaaaaagcaaatctaaaggggagcaaaatagcatctcaggattaggcaag

SEQ ID NO: 175108 - DNA, 366 bp, Homo sapiens
aatagttgtatcaatgacttgaatgagatcgatgtggatatatttttcaaatttataccttttgcaaaatttttaaagggtgggtaatatgttggtgacagattttaaaaaacaaaaagatcttcagatgtggaatcttctgttggatcttataacaaaaagaagacattaggctgggtgcagtggctcacgcctgtaatcccagcacttttaggaggcagaggcaggcatatcgcttgagcccaggagttgaagaccagcctggacaacatggtgaaaccccatctcaacaaaaaacacaaaaattagccaagtgtagtggcatatgcctgtagtccaagctacttgagaggctgaagtccaagg

SEQ ID NO: 175109 - DNA, 284 bp, Homo sapiens
agtagagatggggtttcaccatagccaggatggtctcgatcttctgacctcgtgatccacccacctcggcctcccaaagtgctgggattaccggcgttagccaccatgcccggcgaaagattttgtattttatttcaagaggagaaggaagctattgaagtgttgtaggcagggaaatgacatccaaagtaatgacaacagtcatagtttaaatatgctgctatcacgttttcagtaaatatgattggttttttgtcttaactgggtttctgctgcatcatttc

SEQ ID NO: 175110 - DNA, 484 bp, Homo sapiens
tgtattttgcagttgttggatgaaatgttctgtatatatttgttaaggtccatttgttcctaggtatagtttaaatccattgtttatttgttgacttgctgtcttgatgacctgtctagtgctgtcagtggagtattgaagtccctgactattattgtgttgctgtttatctcatttattaggtctattagtaattgttttataaatttggtagctccagtgttaggtgcatatatgtttaagattgtgatattttctagttgaacaaggccttttaccattacgtaatatccttctgtctcttttaactgttgttattttaaagtttgttttttctgatataagagtagttacccctattcactttaggagtccatttgcatgaaatgtcttttaccacccctttactttaactttatgtgagtccttatgtgttaggtgagtctcctaaaggcagcagataggtagtttgtgagtttttttc

SEQ ID NO: 175111 - DNA, 235 bp, Homo sapiens
gagcaggtaatcagaatgagtcagggtggagtaggtaatcaaaaaagattgctttacgaggaagttaagtttaaaagtagaaggcaaagaattgaacataatgacatattaattctttgaaaagaaatttagaattcatatctaacaacccctcctcttgtatttccttacagctttcttttcaaactttttaaacatagcttagttattttgcttgattttctaaaagaagaag

SEQ ID NO: 175112 - DNA, 558 bp, Homo sapiens
aatggctttatcggaaggtatgggactggaggttattgtgtgaggggaaaaaaccctcacccacatgtggtgagcaaacaacccaagattctaagaccagttatcaaaatccccaacattactacagagcaagagactccaaacactattttaagacctaattctgaaatattctgcaggtagggagtaaccataaaactacagaatcactagagaggatggatgggagtgaacattaaaaatttaaaatgaaactcattcaaaatgagcctacaaactaaatttcccaaaacataaaaaagtagttctaaaagagacaaatatccaaatcaacagtcatgatataataccataaaatgtaaagaacatctcaagaactaagaatgtctaagatgaaaaagaaaagatgaagttatgaaagttttcaaatatttagaggattatggcagaagaggattaaacttaagaacccaaaccagctcttaagttcaattctctcaaatcaattttgagagatgtttcttatcagaaaagtaagttttaggtttgtcagatgat

SEQ ID NO: 175113 - DNA, 289 bp, Homo sapiens
gttaactgagtattccttggagtttgcagggttctgaaagaacctaataaacacacagcttggtgaaatgtgagttatgtttctaaacttatgacctctaaagttatttgttgtttgtatgtaagaataagtggtggaaagataagcccccgaaaattctcgattagtaatttatgttaattgtattttttcagtatattattatagaaagacaggaaaggtaaaaggcaccaaatatgactttggctgataatatttctgttttttactctgaattcaaggtaaatta

SEQ ID NO: 175114 - DNA, 320 bp, Homo sapiens
tgattgtctgggaaactcgacaactaagcttgttaccttatgtgcaggtctgaactggtaaattccgaatttgaccttcatgctcctatcccagagaaaaagtatgtgggcttgagatagcaaatttttgcaattcccagaaacatttcttatgcctcgcgtctcttggctgtgtcctggaaggctgagattttgccaaattaactgaggagttaataggtataaatgactgccgaactctttgttgcatcctttataccgtaataataatgggtgtaaccaaggcttggtttataatggtttgtaaccaaagcttgtca

SEQ ID NO: 175115 - DNA, 607 bp, Homo sapiens
taccatgctcgtcccccaacactctgacccaggaatgaattcttagttggaagacctggatctatcatttggctaacggtctagtcttagacaaattactggccatttaggtgtttctttagtgttaaaatgggacctaattaatttagctttagagaatagaatgaaatcatgcatggatgcacttctgtaaaacacagtgtcttcgactgggctgccacaacaaaatacagttgacccttgaacaacacgggtttgacctgtgtaggtccacttatccacggattttctcccacccctgacacagcaaggccaacccttttcccactgttggagataaggatgaaaatctttatgatgatatacttccacttaatgaatagatatattttttcttcttgatgattttgttaatattctccagcttactttattgtaagaatacagtataaatgatacatatacaaaatatgtgttaactgatggtttatgttatcagtgagacttctggtcaacagtaggcaatattggtagttaaatttggggggacgtgaaaagttatacacagattttttactgtgttttgggtgttggctcccctaactct

SEQ ID NO: 175116 - DNA, 525 bp, Homo sapiens
ttatgttttgagtgattcgctaaacagcaatagtcaacaaaatacaaattaacatgtgtaatgatgagcttatttaatcacatctgaaaaaatgcgtttgcacttccaggtaattttcttgccattaaatctgtcttaaatacttatcagaatgctttgagtttctttgtatttgcactctcttttagatatgcatatacgcatgatatatatgtgcttacagaagtagaaaaaggatttctggattgacagcattaaaggtgattattctctgtgacacagagaattgtatattaaaagtatgattctacattatcctttaaaaaaacagttaaatgttttataggctatccatacagtttgagtcaatatattttgaggtcaatttgctatttaagattttaatatgaaactgtaaaaacactagaactatgtctactatctccagaattagagttttatcaataatatccctaaggccaaatactttgactgttctattccaaaagcagatgcattcaagca

SEQ ID NO: 175117 - DNA, 411 bp, Homo sapiens
ccagtttgcccatccttgtgttgataaacattacccatgaagtgtaatgcttcagtgactatctacccagaatgggattgtgggtttataggatacatacttcttcacccttattttttactagatattgccaaattgctttccaaattgtgctgtttcatatatccacaacggcatgagttctgtttgttccacatccataccaagacttgatcttgttaaattaatttttctagtgtgtaaatgagtgcaaaatcctgttactttagtctttactagattactagtgaggttaaatgtatatgtgtatgtatatatatgcacatatgtgtatattattaggtatttgtgtttcccattcaatagcttttttgtatcaattgtcctttttaaaaattgggttatcttttt

SEQ ID NO: 175118 - DNA, 435 bp, Homo sapiens
ccagtttgcccatccttgtgttgataaacattacccatgaagtgtgttcgaattgtctgtgatacaaataatgcttcagtgactatctacccagaatgggattgtgggtttataggatacatacttcttcacccttattttttactagatattgccaaattgctttccaaattgtgctgtttcatatatccacaacggcatgagttctgtttgttccacatccataccaagacttgatcttgttaaattaatttttctagtgtgtaaatgagtgcaaaatcctgttactttagtctttactagattactagtgaggttaaatgtatatgtgtatgtatatatatgcacatatgtgtatattattaggtatttgtgtttcccattcaatagcttttttgtatcaattgtcctttttaaaaattgggttatcttttt

SEQ ID NO: 175119 - DNA, 461 bp, Homo sapiens
gaaaaacggaaagaaaactatttcaaataccttgaaatgtgtgcttcaagctgactttcagaataggtgcacatttatatagctatgtaaaaaagaaggggaaaaacacagaaattccaaaatattttcaaactggcttagacatcttgacactttactgttttcctctgccaggagagtaaatgagtggtttgccctctggggaaaaatccatttaaaagcgaaactattttaaatgcatacctttttacaagaaagaaaagaatagttcttagtagtgggggagtgggtaggatatatgtatatggaagggcacagtgaaatgtattagtatagggtcttgtttacttgtaagtattttcttcctttttgtcattcctcacacatttacatggttagcactggtgatacaaagaagaaagaaatattcctagccttcacgtgttttagtctaaagggag

SEQ ID NO: 175120 - DNA, 457 bp, Homo sapiens
tagttatttgcatgaggaacaaaaaataacccttttaaattgttattcttataagatatatatttagtgagatggaagcagcttagtgtagtagaagtagattggctcttgaaaaaacaagctgtatgttcttggtcagtctgttaactcaactgcttcagtttcctctggtctaaagtctttccccacctcatgatggtcatgaagctcaaattagattattatatataaaataattttcatatatactgtgctttcaaattttaatataaattatcaagtaaatgtaggtgagtgagttgaggaagcactgtaggattggtaccttcatgaacattagcttcagaatagttgccctctgagggtaataagggcttatctaaaacttgtctttacttcagaaacctatccatcctccactcccctcactcgctgccaagcaaggaataattctaaa

SEQ ID NO: 175121 - DNA, 387 bp, Homo sapiens
taatatggagataaagtcaatcacagtatccacctcacagaattgtgaagattaaaggaggtgatggatgtatagtgtttaacacagtgtcagcagatgagaggtgctgtgatagctctagttcttattattatagatttctgttatgatgaagacaatagatacggtatgaaataagagagtaatttttttcctgtttatttgaaatgcttcttttaaatcacatacatgtatctttgtgctccttagatctttatttctttatgagttgcatactattattgaaaagcaagaaaattatgtaaaaatactgtatgactttatgtcctatttcaaagcagatgtatattcaagttattaaattttaaaatttttaacattttactt

SEQ ID NO: 175122 - DNA, 445 bp, Homo sapiens
ttttagaaacagcttgccagttactacagaaacacacacacagagagagagagagatttccctatcacaaccacagcactctgctgagcagcagcagaggttccaggagccgtgcctacagcacttacaaagccgtggagctgcaaactgctctctcgtagacatccacacagccaagactcttcttttatggtctgtaatcatggagtatattttctctacctggttcaaagcttccatgagagaacggctcctgggatcttgagatctggggtgacagatacagctgacctggaccgtgtttctcacttctgtcatcagagtagcatattcttgggtactttttagtttgacttttgtaagccaagaaagcttctcacttctccaagctcacatttcactccttcaggaaaaacaaactcatttaaattcctcatcttccaga

SEQ ID NO: 175123 - DNA, 170 bp, Homo sapiens
gtagaagaatgtctggggaaaaccagtaaatatagaaagatagtaccaaaaaataactcctgtgagggaagcttttaaaaaaatgagtgaggttgtttagtctgcagaaaagatgtcttcacagtgacttaatgactatctttgagtaaacaccagagtaacgctctttt

SEQ ID NO: 175124 - DNA, 341 bp, Homo sapiens
gtgtgctggtacaaaattaatatacttgaagacaaaagctttctcatgtaaacacctaagaatgaaaaaatcccactgataagagtaattaaaaactctactgtgtgggatttttttgttttttgagacagagtttcactcttgttgcccaggctggagtgcaatggcacgatctcagctcaccacaacctctgcctcccaggttcaagcgattctcctgcctcagccttccaagtagctgggactacaggcatgtgccaccacgcccagctagagatttcttttttttttttttttcctttttagacaaataaatagagaaagcaatcttgctcttgaat

SEQ ID NO: 175125 - DNA, 572 bp, Homo sapiens
gtaaagggaggaggtgcgacttgaacccaggtaacctatctcctgagaccacacttttagacatcacattatgctgtccaagttaagattggttaactttataagctgttagttatccttaaatagatggggtataaacaacagcagtcatattaacaatgtgtagtttatttgtttacccttagaataatgttgcaaataaaatagttacagattctgttatttgctatgtgctttaacaaatcagtataaaaaacaaaggctatgacctaacaaagtttcttttctaaagaattcagacataaaagcatataaggtactgtactgatatataaaatttgtcaatctgtgcatgtgtgtgcatataaaataaatttaccatgcaggtagccatcttatgttttaatatacccttacctaattatagtagtgaacttgatgaaacttggaaatgctatttattatgattttaatacctaccttgactatcctggctgactctttaaaataatttttaaaagcacacttttagaacttgctaggcaaatgattctaaggttctgtttgttatc

SEQ ID NO: 175126 - DNA, 412 bp, Homo sapiens
atgttatttcttaaatgcatttgattggcttggaagaattttgcattagtgaactcttgtctagaaaatgcaaatgccttgttgtggcgcttgagaaaagattattttcaaagagtttttcctgtgatcccaggcaaaatgacaaagagattcccttccttcacaatacaaatccttccttctccattaaggttggaagtaaagctttatgtcagtttccaattaagacgtacatatattattttaaggaaaactgaagaaatgaaaaagtgttttagtttgtcctgaagaaacagaattctgttttcaaatgatgggaaaagagaccggtttccaatctattcactgtcaaggctgcagtgagccgagatgagatcgtgccactgcacctcagcctgggcaacagagtgag

SEQ ID NO: 175127 - DNA, 657 bp, Homo sapiens
tactttttcaccttgcagtctcaacaatccttcctgattcttagaaaaagcacaaatctccagcagccaaagtaagtgctatttggagagggggctttcctctgagcccacatgcagccagcttctccaggtcatccttattgctgcagttctcttacattaacaccatgttgggcatggcaaaaaatgaagattgtagcacatcaacctttctgcttgagaaaaaaaatgcataaatgcatacgttttgcatttcataatcggtaaaagcctcctcctgtataatctactgataataacagtttatttgtccttaacccacgaaaaccaattacagccactgctggaggtaagcatgggcaaatcaaggagaaagcagctccaggagcaccaacttgaaaaaaagatcatctagccagtttcatctgtgaagaattctgtccacgttgcccctccccctctttcagattccaagacaaagggcgtttttaaatatggtaaactcagaaaattcctagaaagcatgtgttgagttgacacatattcagctgatgccatcattttcagggtcagaggaaatctggccaagagacatttaatgttcctcgataaggtagcatttgacaagactcctctgagaacttatttttttaaagc

SEQ ID NO: 175128 - DNA, 650 bp, Homo sapiens
aaaggaaaagaggtaccaaaaaaacacttggtcttaaggagcttacgcagagttgtggtaaaccaggatgcagcatctatattttgtcagttaaaattctccagcagaacagaaaatgaagaattgatagagttttgcttaaagtgtttattattttctactactggacagaagtacgatgtaaatatgaaaaaagacctgaaagaaatgaaactgaatcagtaagcccaatactcagtgccaggacagccgggggaaaggcagccaggataaaataccttaaagtcaggaactgggtgcgcaccaaggcaagacagaacttccatgataccatataaacacaacctatattcaattaacattcattagaaatatttcaactgtctacttttaaatatatttgtattaccttaaaatatcattttccttttatttgttgacaatggaaaaaacacctcttaatatagtttggtcatcgagttcagcttcacaccacagaatgctaccatcgagattatagtcaatatatttggcatcacagaaactaaatatatcaagttgtatattatactagctctaaattccaattatttcttgttatatattaacactgtcatatcacacagccaccggagaaaggtaaacataag

SEQ ID NO: 175129 - DNA, 516 bp, Homo sapiens
gaataaagaagaggttctctctttccatccttaggaaaaggtgggctgttttggcttcctaccatggaggaggaccttgaaggagaaaactggcagaccttctccattccctggtgcttcagcagggcagctgaggatgaaggagaacatatttgccatgctctgagttcctctaacagaataccacctcatctggggctgaaaactcaaatgcctacaggatgccaggcaagtaaactaaaaaggagtactgagcagcaagaagggaccatggcaattgtggaaagtttgagcatgcaagtctaactaaaggcatttaaacacacgtttttaagaacactggggaggctgaatgaaacacatccaagggccaccactttgcaactcctgaaccaagcaaaaccaactggtgtcctgttgtatgcgtgtgttgtagagctttaaagctataatcccttgaattatttgatatttctttataacttttaacatgccattttgttgccagcctctctt

SEQ ID NO: 175130 - DNA, 960 bp, Homo sapiens
gcaacccgttggagtccctttccacactgtggaaggtttgttcttttgctctttgcaataactcttgctgctgctcactgtttgggtccacattgcttttatgagctgtaacactcgccgcgaaggtctacagcttcagtcctgaagccggcgagaccaccaacccaccaggaggaacaaacaacttcagacgcgctgccttaagagctgtaacactcaccgcgaaggtctgcagcttcactcctgaagccagcgagaccacgaacccatcaggaggaacgaacaactccagacgcgccgccttaagagctgcaacactcaccgcgaaggtccgtagcttcactcctgagccagcgagaccacgaacccaccaaaaggaagaaactccggacacatcctaacatcagaaggaacaaactccggacacgccacctttaagaactgtaacactcaccgcgaaggtccacggcttcattctttaagtcagtgagactgagaacccgccaattccggacacacagctacagccaagcctctttgcttctctgggccagcctctctggagctgaatcgtggctggctggatttgaggagcctgcatgggcgcactctctctttctgaatcccagctagggctctcctggctgtaattactaagactcagctgctgggaatttccacgcctcctacctctctacagggcagtccctccatattaggaaacccactggcacgctccgccgttatcttcgcaagacttccgttgttgcctcaagttgcagattgccttttaacagagaagaaagtgacaggaatgtgctgggcactgatgacacagtaatgaccaaaggtcttcagtgtttttggggcatctccctaccttggatcacccctgaaaggcaacaaccaacaagcagacaaagctctgcccagtaacattgagatcccagaaaccagagc

SEQ ID NO: 175131 - DNA, 314 bp, Homo sapiens
agcctctctaagtgctgggattacaggtctgtgagccactgcacctggccgaatatcatcactagatactcttagaggagatggctagtgcaaaggccctaagatgggagcaagcttgaagtgttttcttaataagagcaaggaggccagtgtggatagagtagagtgagcaaaggggcaagagatcagggatgagagtagagagtactggggaccaggttatgtggagttttataagccattgtaaggaatttggcttttcactaagtgaaatgagggggagccattggagaattgtgaacaaacagtgaaat

SEQ ID NO: 175132 - DNA, 464 bp, Homo sapiens
ccagtaggttcccatccttctagagttgaatcaatgaattgttctcatagaaaaccaggtggtcaggaaaggaaacaccatcatcctgcatcaggcttcttggggctgtcagatagaaactccctgttcaaactgatttaagccaaagggaaaaggttaagccacataactgagaagtccaagagctgtgtgatccaggggctcaaagagtgtcacttagactttgctttgtttccatctttacacctgcagggctggctcatttggaagctgcagtgatgttcagcagctccaggctaatgccctcctgagttcaagtccaaccaagagaatttctcttcctctaacagtatgactgaaagtcctgggcctggtagacatcagtctaaattgggtcctgtggccatccctgcatcaaccccagtggtctggaaacggatggtctaaaataacagggcttacag

SEQ ID NO: 175133 - DNA, 389 bp, Homo sapiens
agttgctagtgtccttcagaccttcctcttttgtagaaagtttcattctttgtgtgtctcagactgagatggaggaggggtgactctgttttctaagggatctagagagaaagggcagatgtagtcttgagcagtgggcttctcagctgtgctgcttcttccacggagaccatctggatctactcggttgatggagcagctcctctcattctgagtgggtttagcatttgagaaatagaggggcaccttggctgactggactaaaccttctttggcaatttataataaatgctctctgatttattgtttattctttcacattgaggttgaacctgatttgcctttgaaagttaagagcaggactaggactagaactagaaatgcctgat

SEQ ID NO: 175134 - DNA, 144 bp, Homo sapiens
tgttacctcattttcactgtcctggaggtgtgaaaagaaagcaacatactttacttttcatttaaagggccacatgtcttaaagatttacatcttgccaatctcttgttctgaaattcaaaagctcatcggccaagcacagtgg

SEQ ID NO: 175135 - DNA, 410 bp, Homo sapiens
aactctgataaagtcttagctcctagcaacctctaattattgtcctctgtcttcctttaaacccagaggacttcttaaaatgagaagtcacatctgttacctaaattgccaatggtgtatttcatctgtgctttaaatgcaacacatctacaatcaacattattgctgtctttcctttcccgcccccctccaaacaacactttcttctcctcactttttgtgtttgtgatgccactgtcctcaggcaaccatatatgaaacctcaggcacctttgatttcccccttttcccacagtccccagaacaatcacttggatattatttctgtgccctcctccaccaaacctttcatctatccctttctgttcattttcactgcctcttaaccctctacaaatcctttcccagaa

SEQ ID NO: 175136 - DNA, 276 bp, Homo sapiens
atagacatgcctctctgggctgttgtaaggattacaaattaggtcgagtgcttggcatgtggtgggttgaacagatcacagctagcattacagatgatatattaaagccaaaaaaagatgcctaatgtccaccagttggtgaacggacaaaggaaatgtaccatatttgggatattatttggcaatcaaaaaaagtactgacacctgctacaacacggatgaatcttgaaaacattagactaagtgaaagaagccagacacaagaaactgctaatg

SEQ ID NO: 175137 - DNA, 474 bp, Homo sapiens
ctgcactccagcctggcaacagagaaagaaaagtatttaatatttatattttcctacttatctaatcatttccttaagatttagtgagtatacatacttaaaatttggttttcattgccatatagccttcaggaaggttgtatactttacattttgtagtttgagaatttcatttatatacttgtcaattgtcagttttcttaatccttgccagtttaatgaatgggaaaaatttaaatgatgtctcattgttgagggcttgtgttttggccaggcctggtgggtcactcatgcctgtaatgccagcattttaggaggccaaggtgggaggatcggttgagcccaggagttcaagaccagcctaggcaacatggtaagaccctgtctttacaaaaagttaaaaaaaaaaaaaatagctgggtgtggtggcacatacttgtagtcacacctacttgggagattcaggggaggatc

SEQ ID NO: 175138 - DNA, 257 bp, Homo sapiens
ccttggacctacatgccagccactcagtacccctgtcaacccccaccttcttccccactctgggctcactgtgacttaatttacctactcaaagagtctgcttcacaggggagccttcctccccaaatctaagaatctagaaagcaagcagcagtatcttggcatgatccactgtgttctgagcaaccagctccagggttcctgtccttcaactagaatggtcccattgtccccatgttatatgtttctggttgtca

SEQ ID NO: 175139 - DNA, 370 bp, Homo sapiens
aatagcactgtcatgagaactaaaaaccaggtgagcactcacagtacctggttttaacttcatacacctgaaagaggcactgaagagggtagaaaagacagccttgaactgccgatgccaacccctcttccatcccccagcagcggccgtgtagtgtggagagagaatctgtgtacttgggggagggagagcacaacaaatgggggacatagaattgcaccaatgctgccctgtcacagcagacagtaaagctgtgctgggctcaaccactgcatgcccacagaaggagcatgtggaccagccctagccagaaagaaattccccatcccagtggtcaaaacttgagcttctcagcaagcctcaccacaac

SEQ ID NO: 175140 - DNA, 488 bp, Homo sapiens
ccacacgatgttccctgctctttcttcactcttggcactttcttctctccattgcctttttctcctgacttgggtaagggtctgccgctcttcctcaccttccgggtcgggccttcggcattctaagtggagctttctggagagggagccccgttctaagggcactgagagaggagtggctgaactgagaggtaaccaggaaagcaagatcagtccatgcccccaggccatacctgccaggtggccgacaggagatgcaaatgtgcttctacctgagacaatgcaagcagaagaagggatgtcgcaaatggagacacacacccgctagcttcacacgccgttcccattaatcacgctgcaaagaacaaaaatcctggaaaatcattaaaattacagatggctagattaagtaattagaatttaggctaaagcagatgtttgtaattaagtgtttatttcattgaataaaatccagattgtaagaacta

SEQ ID NO: 175141 - DNA, 462 bp, Homo sapiens
gtgtgtgtgtgtgtgtgtgtgtgtgtgtgtgtatgtgtatatgcgtatatatgtgtatgtatgtgtgtatatatatatgtgtgtgtgtatatatatatatgcaattatacctttatccctactctagtccaccttcctataaataagatgtattgagatgctcagtgcccccattctgacagcatccaatcgagtgaatcctcacttccttgaaatcacccaaccagggccaaaatcctaaaagaggttctttgtgacaccctctgtctgagaagtcctatggttctctgtgatgaatagacccaactttttcaaatacaggcatttctggtgggctttggctgaaggcattcacacccaccagtgaatgtcttgcacttctaattgtgtctcggggcatgcctggtggaggacctgactgagacaattgtgactggatgtggtctgagagcaggcagtagg

SEQ ID NO: 175142 - DNA, 110 bp, Homo sapiens
cggtgtagaacaaaacccttgccagggtcccaaacctctctttagaactctaattaaaggtacttccgtttcccacacaacttggaatgaaggggaagcaacgactgtta

SEQ ID NO: 175143 - DNA, 2838 bp, Homo sapiens
agcggggtaggaggcaaccatgtggttccagctgaattttttttttccctctctctttcttcactcctttttctttccaaacagggaaaagtgttccacgaagcggtagcgcctttccgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaa

SEQ ID NO: 175144 - DNA, 1188 bp, Homo sapiens
tggacgagttctgctgcagaatcttaccatgtcctactctggactgtaccagtgcacagcaggcaacgaagctgggaaggaaagctgtgtggtgcgagtaactgtacagtattgctggatttgacatcgagctacgaagtcgcagactaattcctggggtcatctgtttaactggtggataaattatttccatctctactagacagaggtctacaagttgcccctacagagttgtaaattgccaagttctgtagttcttttgtctatttccaagtttagataatttttcttaaaaacacaacagtcaggccgggtgcagtggctcacgcctgtaatcccagcactttgggaggtcgaggcgggcggatcacgaggtcaggagtttgagaccagcctggccagcatggtgaaaccccgtctctactaaaaacacacaaaaaattagctgggcatgcctgtaatcccagctactcgggaggttaaggtaggagaatcgcttgaccctgggaggtggaggttgcagtaagctgagatcaggccactgcactccagcctgggtgacagagagagactccgtctcaaaaacaaaacaaaacaaaacaaaaaaagtaacaggcagttttcaggaaaagaaataaaaaatggtgaataaacatgaataaagaggcccccaaaaatccttttttccccactaggttgagaaaaaaaaatcacccttttaattttaagctatcagtttagtaaatataaaaactgtagaatctatattagaaaggttatgaggaaacaggtgcttttacatttttgactaacatatacattagtagcacaatttagatttatctatagatttctgaggggtaaatatattaaagtaaaacttatacaaagaagaaggataagtgtacaacttgatagattttcaaaagtgaagataactgtgtaaccagtatcatgattaagaacctgtttctggccaggcacggtggctcatgcctgtaatcccagcactctgggaggccaagctgggcgcatcacctgaggtcaggagtttgagaccagcctgaccaacatgccaaaaccccagctctactaaaaatataaaacttgccgggcacggtgactcacgcctataatcccagcactttgggaggccgaggcaggtggatcacgaggtcaagagatcga

SEQ ID NO: 175145 - DNA, 2448 bp, Homo sapiens
tgtactgtatttttaacttttatttagaacagaggtctcttggactctcagccccaggcttgactactttgtgccactgggagtactccctttcctcttcttcacaccatcaggaaaggcaggctgagagttacgctgcttgactctgcctcggtctatcccacaggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaa

SEQ ID NO: 175146 - DNA, 2572 bp, Homo sapiens
agcggggtaggaggcaaccatgtggttccagctgaattttttttttccctctctctttcttcactcctttttctttccaaacagggaaaagtgttccacgaagcggtagcgcctttccgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcaactgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagacaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaa

SEQ ID NO: 175147 - DNA, 1899 bp, Homo sapiens
tggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaa

SEQ ID NO: 175148 - DNA, 397 bp, Homo sapiens
ttaataaaccattacccataaaatatttatgttgccaatttctactttttatccattagtgtggaatatacagtaaaaaccaaaaatctatcatttctgtgaaaatggcaggtagagtgaagatttttatttatgtacttttgtatcagcataatttatagttcataattgcacacttgaacctccttgattatacagtttttatacttttttgtgtgtgtggaccaaataccatacttgctaattctcttatttctctgaaacaaatttaaagaaacaaaagatgtgtcttccactttggtttcctggtatttcaggaaattaatacaattatgaacccaattttattatatttaagtctactaattgaactacaaataaaaagttatttgctttt

SEQ ID NO: 175149 - DNA, 690 bp, Homo sapiens
cggcttacaagggacctatccatgtactcgtgtacgctcttatacaactccctcctctctgtatctcaccccgcacgatctatctgcttccgctgctctgaaccctgatttccacatcctccactccgtgggaccactgtgctctacatggactccagctatctgtgccatggttggaagtagttctaagacagaaagttgggtgatcatggggttcacctcatgagtttccctctgtctgggatcagtagttctgtgctacctattgttcactgcctgaaaatagttgtctcatctattttgtcatgttgtatagcagtttatggtgggagggctagcctagtaccagttactccatcatagccagaagcagaaatccaaagaaagcttcaaaaaatataagtctgatcatgtcacttctctggttaaaatctttccatggctctaagaataaagatccaaatttgaaaatggcccgtggggtcttgtatgatctgagccaaacctgtgctccagcgtcattccccctcttcctcaggccctcgttccttccttagcctctggccttccttcagtcccttgccgttttctcctgtctctaggcttttgcacatgaaaacacacttttgcacatgaaaacacaccaccaaacattcttcccatccttcttcaccaaccagctacaagcca

SEQ ID NO: 175150 - DNA, 592 bp, Homo sapiens
agggacctctccaggaaggaagccagcccactgcaagaataactgagcctgtcagaaaacactgtgacataaatcaaagtgctaacctcataaactataaagatcattctcaaggtaaggcaggtgttaattactaccaaatgttaacagaggcatgtatggtgacagtggttttacttcatggttatgagactgaatttgaagcacttacaaatggcacattgattttttaattgcttttctgtccttccattcatgtatttggtaaatcttagaagtacaggctgaaagagtgctgagaggacccattcatctcatctagggcatgctaggaatcattagagaatcacaaacttggagaggtgtgacttgtcaaagatgaaagaggaaaacagaaggtgtcttcagggtgcttctcaaagaatggtcccagaatctcctggggtgtttaaaactggaagttccctctggtccctggctttgagcccactgggctgtacaacccacttatctctcacctgtcatgttcaagagtgatatgcaaaaaaatatggtaaattcaacagaaagtgatggacatgcatattctcaa

SEQ ID NO: 175151 - DNA, 379 bp, Homo sapiens
taataggtgctcaataaacgctgcctgtacggaattttactatcaaagctgccaaggaaagtttccagaaatcagctcttccaaaatatgtcctcagagttttctttgtccaacaaaaaaatatttttgaagatccaagagcaggaaatctgcgaggcaacgaggagccaaatataagccaagcggctccagctgggccccacattccgctaggactccccagtacctattccccatctctccgcctacatcctgagtgcgccctccctctcatctcggctgtttccttcccacaaccctacctccatactttcggccacacacaccccaagtgcgtgctcctggaacctcacagcccacctctccctctccagcaagg

SEQ ID NO: 175152 - DNA, 690 bp, Homo sapiens
gggctcattctaatcacatgagtcttttaaagcagagtgattctctctggctggacttagatgtaacagaaggaaaagttagaagtatttaaagtgtgagaagaattcaacctatttctggaggggcacacgtagaaagcaccagaatgtgggcagcttctacagagaaaaggccaacccccagctgacagctaagaaaacagggtcctctaccctgcaactgcaatacactaaattcagccaagaacccaaatgaatgtggaagcagattcttcctcagagcctccagggaaaaacacatttggttttggccgtatgaaacgtgatttggaccttgtgagactctaagcagaggacctagtcaagtccaatcaagcttctgacctatagaaattgtgagaaaatatatggatgttgtttcaaaaaacaacaacaacacaaacaaaaaaaaacaactgtggttgggcgggcctcggaccctgaaaaaacttcaaaaaacccattgggtggggccggggccccaagatggtttaggtgaccctggcaacagcgggtccaaagaaaccggggccggacataggcgtggggtttcccacaaaaaaaaagccccgggggaaaccggggttggacaaaccaaagggcgtcggaggcctacggggcaaacacggagccagggggcgccgaattaat

SEQ ID NO: 175153 - DNA, 419 bp, Homo sapiens
tttctttctaatcctaaactcacattttcacctattcatatgatttgcttttttcagttttatcttctgtgtatttcactatgatactagccagggttttgcctttgagcaatctccaattttatttttttgtgtatagttcttttcctccaatacttgtccaatgttttattagctcataattaaatacttccatgctatctgttttagtctgttctcacgctggtatgaagaaatacccaagattggctaatttataaaggaaagaggtttaattgactcacagtcctgcattgctggggaggcctcaggaaacttacaatcatggtggaaggcaaggagaagcagccaccttcttcacagggtggcaagacggaataagggaaaggaggggaaatgccaaatgcttataaaaccat

SEQ ID NO: 175154 - DNA, 274 bp, Homo sapiens
gtactggcaggctgctaggccctgcagcatgctgtgtagttgaagattttatgctgtttctcacatgaattttacctaagcacaaagttgccagagtatgtagacttaaagcagggtaggattcttagcctctccctggtactgagacacaaaaagtacctcttatagctcgattttttttaagtcccaactcttcccttttaaccactctcccttgttctgaaaatcagatcagtcactttgaaagttctaagaaccttttcccttggttgag

SEQ ID NO: 175155 - DNA, 369 bp, Homo sapiens
tacacaaaagccttcaataaatatgtgtggaataaactgaaggtttacatacaataaatacagacagctttggggcaagtatagtgataaagtacagaattctccctgagttcgtggaattattttaatttcatttccgtacagtcagtgagtatgaggacttgaagacatggtttttctcctgttaagtgaaggtctgcattttatttttttagtctagagaaatagccaaaatattattttttttaaccaggagaattttcagttggaatggttcataagacagttgtaagttaaatgctgaaggtaatatgaacaagtggctatgtatccttcatatcttcaaggaggttcagttttagtgtgtct

SEQ ID NO: 175156 - DNA, 320 bp, Homo sapiens
gcccacttcatggcttcaacagctatctatatgcacacgcacacacacctcaaacctttcttttgagttcccaacccacattagctaatatcccaggggcacctaaaactcattatctcccccctaaacgagaaagaaactggtatcattattccccagttgtccaagtcacaacattcgtacctcttaaaccaatctgtatctccccatccgcactctcccttccacaggcagaccatcatcatccttgcctggaaaagagcctcacaactgctctccttgattctcctcaattcattcatccttcacactgcacgcag

SEQ ID NO: 175157 - DNA, 924 bp, Homo sapiens
tgactcgggaagatttgggatgtgtcaagggctctgatcatgccactctactattcaatgccttccctcatatcctattgcctggcatacttcagtggaataaaactccacttctataacatgggagacagccctctacagtaaatggccccaatttcccaaacatatgtaactcctgccatttcctgcagggccccaatagcatcaacagaatacttactatttcctgaacacaactgagctctggtttatgtttgtttgttcatttttgttttggtttttgcatcttggtgattatatttattggaagagttggaggaaaaagtgacatttagctcaagaagtcatgagttatctgcaaatcaattcatttccagagtggaaaaatcctcagaattatttcttaatatcaaaatgtatgcaggtttctctttcaaatgctttgtacatttaaagaggcaattgtacaaagtctcctattttccatacaggacaaattctttgtgtcagccaactttcagtggagggacaaccaggacaacaccatctccctggataatgcgcgttggaatactcagtttcattgatttacatatcccttcgtatgtttattcatcaatttctatagtagccacagtttcttctacatctcccaacatcatatttaaatgttgatcataagcatgtaatctgccttgaagccatcagtcatttcccattttcatgtaaatttgctcatctaggctgagcctgataagatcgaggggctcctctgcggttttggtagtttgttgatggtccacataatctgccatatttcaaatcctgcacccttccccctgaactcttactcttccccctgaactctatgacagatgcttgttacataaaactctgcttgttttatcatatccttccttgcct

SEQ ID NO: 175158 - DNA, 537 bp, Homo sapiens
caaactctccccttcgttaagtaatttttaaagctgaattactgtattttatttcttgaagacatacccactgctttcttataaacaaccaacctttcaattactgaccagtcaggcaaaatcaaatacacaggctaaaagagtatcttcctaaatgcaggcaaaaatacaaaaaaacaaactgggtaccctggtgtgtgcctgtaatcccagctacccaggagattgaggcaggacgatcacttgacccaggagtttgataagagcctgggcaatatagagacacccccatctcaaaagaaaatttaaaaatacatacatatatattttttcaaaaaccctaagcacaatggagctacattatcactaaattcatgatggctcagaactcagtgtaattcaggcctgttttagaaacagaaagtagatacacactagaaataaccacatagacatttgtatacaaattgttatctacaaaattatggcaccctaagtccaaagaatggcattgctgcgagatcccagagcccccag

SEQ ID NO: 175159 - DNA, 976 bp, Homo sapiens
aactcatcccttcctctgttcctttcatcacaacaaacgttatggagattatgcgataccaggcactgtgctagctgatagggtgggggtcagagtacccagcgaggctagacattgtgtgggattcagagaaagcatataatagggctcctcccacaagaagcttgtggccacaccagggagagagaatggatgcacatgagcatacgaaactcttagaaggacttaggcaggaagcacaggtgataggcagaatgtgtgatatgagggtaagggctgagcaaccaacgcagaggaattggagaggccagaataatcagaaaagctttggagggggtaggatgtgacctacattttcagaacaagagtggagtagaaaaggcattccaggtgggataaacagcggaggcaaatacatgagagggaattaaatctgttgtgatttatttgatagtaagattgacctgcctggcatcgagttgaagtagaggcaaaagacactgaatatttgcaaggaggtccttagaatggagtgatatggaaataagcagccattataggttcttgagcaggaacattttgcatgaaaagcactgctttggaatgatgagtctagaaaggtaacactgacctctctaaggtggcattctagggagagacctgagtatttggggctgagattgagagaggagcttacttttcttggtatatttttatttactattcaagttctgcatcatgtgtgtttactgcctatttaataattatttttaaatttaaagaacccattgtggcagcagggggaattctctaagctcagttactaaagggttatgaagctgggtatggtagcacacacctgtagtctcagctacttgggaggctgaggtgcgaggatcgcttgagtttaggagttagtgggaggatttcttgagcccaggagttaagagaccagcctgggcatcaaaaaaattaa

SEQ ID NO: 175160 - DNA, 444 bp, Homo sapiens
tccagcactttgggaggctaaggtgggcggatcacttgaggtcaggagttcaaaaccagcctggccaagatggtgaaaccccatctctactaaaaacacaaaaattagccaggcatggtggtgtacacctgtaatcccagatactcaggaggctgaggaaggagaattgcttgaacctgggaggccgaggttgcagtgagccgagatcacatcactgcctccagcctgaacgacagagtgagactccatctccaaaaaaaagaaccaggatttaggaacagagaagcccatacatcatctaatttatccccaacagccctttaatcaatgtggaaactgaggcaggagaaatgaagtaactggttccagattaccaccgacacacagtattggagaattgaaaccctgatcggaatactgaccttggtgactctgggctgtcac

SEQ ID NO: 175161 - DNA, 107 bp, Homo sapiens
attgaaaacgtcttaaaatttttattctgaagggaaaaaatgaatgcagtatggcctgtttttttaaaaaatatctgttggactcatttcacttttgaagtgagtca

SEQ ID NO: 175162 - DNA, 495 bp, Homo sapiens
tttttgtgtgctgaaggcatggctggggtttgtcttacagcagaggcaagcaattgcagctctgaaagacgttgctgcttggctgcctcttctctattgttgaacaccttgaaggcgagattgattaattcctgttgtggggtttgagggccagattccaatttttgaagctttttttgtaatgtcaggagctgactgagtgataaaatgcatattgagaataagatggccttctggcccttcagggtctagggctgtaaagtttctaagggtagccaccaaacgggccatgaactgggctggattttcatctttaccttgggtggcttcttaaagcttgtcataattaacagctttgtatgctgcctttttcagcccttcagctaggcaagagaccatgtaatctcgcctagctatacctggggagcctgtctggtattcccatcaaggatcctctcagggaactgccctgatgccttcttggaggtctggctc

SEQ ID NO: 175163 - DNA, 199 bp, Homo sapiens
tgatgaagatattctacaattaggtattggtgatggttgcacaactctttaaatatactaaaaaaccactaaattgtacattgaaagtattatttaaaagctggttttaaaaaaagttttcattgatctaaaaattgctcccataccttgtcacctttgtttctctgctcatatctttcctctacctgaaatgcacatc

SEQ ID NO: 175164 - DNA, 323 bp, Homo sapiens
aagtcacttaatccagtagtttgagactatagtgagctatatcgcaccactgcattccaacctgggcgacagagcaagattctgtctcaaagaaaataaaacaaaacaaaacaaacaaaaaaacagccttttctctttctctccttcaatctgacaaagacctttcataaaagtcacacacgggcagaatgtctgtccctaacccaggtgtgtgcttggggctcctctccctccctttctccactgagggcttcagttttctgctggcttccaggcatggagagcaggtccgcaagtctcctctgcttccccctgactgaggc

SEQ ID NO: 175165 - DNA, 263 bp, Homo sapiens
gcagcaaagtaacggcaagttctctttcaaagcctagcccactgttttgcagaaggtgttctgccagccccattcttatctccaacccacctaccccatctcctggatcaaagccaaaatcatttctaagggaagcaattgtgaaatcattcccttctatcaagagcagtttgcattgtctccatgcagaaagtgtgcagtttaatatattagggtgggttgcggagtggcaactaatatcaaacaatttttttttaaactaa

SEQ ID NO: 175166 - DNA, 309 bp, Homo sapiens
ccaacaagggcctgtgcattctggccttgctctctccccactaaccactacatcttccaccaccagcaaccttcctgcagttcctggaagagccatatttctcgccatcacagcttttccagaagctatgctctttgtttagtacgttcttctcttcctcccctcaccatctctacttccactcatccttcaggtatatcagcttagataccaccctgtcacgtggccatcctggacatcgcctccttaacactagtcatgtgccaagatttaagactcaccaactgaagttggaccttttatccgatg

SEQ ID NO: 175167 - DNA, 155 bp, Homo sapiens
aactattactgttcaatggggtattccagatgactagtcagcacatttcctgcagcttttttcaagattctgtaagagaattaagccctaatgtcataaggcatctattttatgtaactaatccatttgaaatgactaatttctcctttgtgtat

SEQ ID NO: 175168 - DNA, 698 bp, Homo sapiens
tagagccccagaatcagtaccactgggtcaaagagcatgaatgttttatcatttgcttattttttttagagtgaaaaaagtacggccttattacttgtaagtcattatatatggatttttaaattattatttgtacataagaacaattttaatgatatttgcactatcaaattatctttaattggccaaccaatttttatgacacactgacatgtttggattatatcagtccataaggtaaagattccaaaatggcaatgaccaaggtctaccataggcaccttggttagaaagtatcactctgcatagtactgacttgtagatgaatagctggatattggaaggaagatttgattcatgaaggttaatgggctggggaaagcaatgggtccaattagcaaatggattgttcttggaccttctgctagtctcaaaaggataagcttatggttcccatggcccatggcagaaaacacagaacaaataaccaggttaaacactgaagttcaaaagttggccagtaatggttgtcaagggctgtgtccaggaaatcccgccagacaggcactgtttgcaaatggctgggaaatatggtctgttgccatcaaaaacagatgaaaagcaggatttggttaaaagagtaagtctttgcgcaagcaaaacctttccaaaataaagaaacagtgtatagctgttgc

SEQ ID NO: 175169 - DNA, 554 bp, Homo sapiens
tttagatatctgactcattcagtactaccccaaggctcactgacaattggaatatgtgcaaatgagggttcataacacataatttgacttatttcacctatttatctagctttggccaaacaattcaaaacaaacttcctagttacttcctgggaaaaaaattgtggaggagaaaaatgaagagggatgttctaacggctcttacagaagtaactgccaagattcccattctagcatatttattagggtcatttatggggatatttgcctttatagtatgagccaatgatgctctatcaccattttataacatacaattgcaaagatgaaagaaatatgtctatacatatatgcaccatagaattatatggtattttaatgatgtttagagagccaggctcactccttggttgtgaaaatccagacttgattcttgatagttaactgcaaactgcttttctttctctgaagtggcttggtaaagataaagctaataaacaattgactattttaagttaggggcatcacttcttgttctctatgcacagcaatta

SEQ ID NO: 175170 - DNA, 250 bp, Homo sapiens
aatgctcaattccccgcacagttctctacaatccaattaccctagtttccccctacccccacacagtacatatcgttacctaaaataatttcatggactcatttattttatgtttcttatctgtctcctccctatacaatataagctctctcttgttccttgctatgttgctgacacataaaagagtgcctggtctgccacagtagatgttcgaacacatctgttagataaataatgatcacagataata

SEQ ID NO: 175171 - DNA, 763 bp, Homo sapiens
gcttcagtgtgggcccccaaggaactggagacatggcccagacttgaacaggaagcacacacgggctctatcctctgtccagcttcagggggcgttctttcctgcccggcctctctggagttaggaagtcggcctggacggatgggtttgggccaagtgtggatgggcaggctctgattcatggactggaaaatccctccttagtcatttgccaactgtccctgaggcctgggctggtcattgcctctcccacttcccctagaaacccaggtggagtaggggctaaggagggccccttcattgcatgtgagacacacagaacaatctgaaaaccatctccgagcctcccacaaacctgccctggccaagccgagccctcagagttcttgacccacagaagctcatggaatcccctgcaaccctttggcagttgttcttgttcccactttgaggaaactggggcacagagaagttgagaaacttgcccaaggtcacccagccagggaatagcaagtccagattggaaggcaggctcagccagctcactgtattgcccagagcccacagcggtggccaggacaccccctcccctcctggggccccttcccagggatggggcatggaagggaaactgaggaacgacagagtctgtcttaggagttgaaacaactcacagctctgggaccctgaacaagtgaattcatcccactaagtctcagattctcccagctataaaacaggttcatgatttagtatcaatgtg

SEQ ID NO: 175172 - DNA, 712 bp, Homo sapiens
cgcctcggcctcccaaagtgctgggattacaggcgtgagccaccgcgcccggccctgtctcactcttaataaggacaattgtgattacatttagggatctcctgaataacccatgctaattttttcatctcaagatccttaaaatctgcaaagtctcttttgccttgtaaagttatgtattcacatattccaggaattagaacctgactatctttggggctgattattcaatataccagtgttaccatttagtattttatgactttttaaagagtaatacaggctcacttgatattggcatgaatgagagaactaatctgatatggtaaaaatttcttctgtacaagagtaacaaaaagaaagaagaaagagagaaagaaaggaaagaaagagaaaaaagaaagaagggagaaaaaagaaataaggaagaaaaaagaaaaagaggaaagaaggaaaagagaggaaggagagggaaagaaagagaaatgaaggaaggaaggaaggaaaaggggaaggggaaggagaggacggaagaaagaaagattataggaataaatttaaccaaggagatgaaagatctcgataacaaaactacaaaacactgacgaaagaaattgaagaggacacaaaaaatggaatgacatcccaagctcatggattgcaagaattgatatttttaaatgaccttaccacccaaagcaatctacagatg

SEQ ID NO: 175173 - DNA, 101 bp, Homo sapiens
ctgtctaaattgtttagatgtcaggttttttttcttaaaatataagctcttttagggtggggacaagattttatgtctctagctccagcatttccacatca

SEQ ID NO: 175174 - DNA, 548 bp, Homo sapiens
ccgagtcccttggatctgggtcccaaccctgcctgtgtggctctgaagtcaagtgactcctcctccccctgttgtattccccggcagcactaacagtggctccccttagctggacacctagagtgccaggctctgtgctcaggacttcactgtttgaggtccctggagagtggaacctctcacccacaaggtggtgattcccttgggagtgggcagcatgcagtcagaagggaacttgggtggggacaggcatcctatatcctgggtttacccactcctacccatgcactgatgggcttgactgcctggccaacacttactgagcatatagtgaatgacgggcactgaggctcaggggatgaagccataggctttgagtcccagagtcagtgatggaatcaccagggagcccaggcatcgtgtctatgctctgtgccatgtgacaagtctctgccttctcttcatcctgaagagaccctgggttcttgcctccctgggctgtggcaccatgcaaggtggccaaggtaggggccctggtgttctggccc

SEQ ID NO: 175175 - DNA, 729 bp, Homo sapiens
gggaaaggacaccctattcaacaaatggtgctgggataattggcaagccatatgtagaagaatagaactggatcctcatctgtctatatatacaaaaatcaactcaagatggattaaagacttaaatctaagacctaaaaccataaaaattatagaagataacattggaaaaatcttactagacattggctcaggcaaagacttcttgaccaagaacccaagaaaatcaaatgcaacaaaaacaaagataaataaatgagattaattaaactaaaaagcttctgcacagcaaaagtaacaatcagcagagtaaacagacaaccttgaaaatcttctcaatctgtacatccaacaagggactaatttccagaatctacaaataaacaaatcaccaagaaaaaaaaacaaacaattccatcaaaaagtgggctaaggacatgaatagacagttttcaaaaaaagatatacaaatggccaacaaacatatggaaaaaaaatgcttaacatcattaatgatcaggaaaatgcaaattttagccattatgtgataccaccttactcctgcaagaatggacataatcaaaaaatcaaaaaataatagatgttggcatggatgtggtgaaaagggaataattttacactgctggtgggaatgtaaactagtacaactatggaaaattgtgtgtagatcccttaaagaactaaaagtagaactaccatttgatccag

SEQ ID NO: 175176 - DNA, 709 bp, Homo sapiens
gggtttttttaagtaatgacatatatatcattctaaatataccagatgccacattctgaaagataatcttttttaaaaacctttcatttggaatcctgggtgcttccatttttaaatgactgttctctatagaaagagaagtttgcaataacgaaccctgtacactatctgagctgctagtgtcaaagctacagaagtggtttgctggggagaatagcttttctgggttgaacctagttgtcatctatagtcctttttcatttgaaggaacatttaaaacaatacgtccctttttagtaggaatatagttgaaacttcaagattggccaggggtgctaattgcttaagccaaatgttattagaggttcctcatgttattctttttacttttgtatgtgtttaaaatttctcataataaaaagtgttgcttttagcttactttctaaataggttcttcatagattttttttccaggttatgtcttgtagtcgttctaatattctctgattaaatgctttgtcattagtctgagttgcatttatttgctatttctgtatataatcaaattttagatttggagtcagttcagtacaaatagcatactaaaattcagagacactggcaaaaggagaaaattttaaagtccctaaaaatgcatgccttttgtatagaagtttgtgcttataaatacaagcaattaggatgtgct

SEQ ID NO: 175177 - DNA, 131 bp, Homo sapiens
agctcctgcaggagtctgggaaggcagaaccagagtgataagacagctgcttctttctgttgctctcccacccttaacttgaggtttccctccaaggtggttgctctagccactgacagcacttccacctt

SEQ ID NO: 175178 - DNA, 842 bp, Homo sapiens
gttgctctgtggcccaggctggtgtgaggtggcgtgatcttggctcactgcaacctccgcctcccgggttcaagcgattctcctgcctcagcctcctgagtagctgggataacaggtgtgtgccaccatgcccggctaatttttgtatttttagtacagagagggttccaccatgttggtcaggctggtctcgaactcttgacctcatgatctgcccacctcggcctcccaaagtgctgggattacaggcgcgagccactgcacctggccaccagcctcctattctattcaaagtcactcctctgctcactgagatagatgcatatctgagttgcctcctttggaaaggctcatcagaaactctaaagaacgtaccgtttgtgtatcacccatctgtgacctgggagctccgtcccctctttgagtattcctgccttcgcttcaagttgtcccgcctttacagatggaaccaatgtacttcttacatatatcagttgatgcctcatgtctccctaagtgtataaaactaagctgtgccttgaccaccttgggcacatgtcgttaggactccctgaggctgtgtcacaggggcttcctcaacgttggcaaaataaactttctaagttaactgagacctgtctcagattttatgggttcacattatggtaaccacgaggggattctgagtggaggtgcccctgacctttgacaaatctattggttcttggtagcagcatgagctaactttatggctcaagccaataggacaatttgctgaggtttgagagcaccccctccagagaatccctgatctcttaaaatttggtcaagatctaaagttt

SEQ ID NO: 175179 - DNA, 289 bp, Homo sapiens
aaaaaaattcagacatggtaggtttattaccaatctttttttgtgctagtaatggtagaatttattttttcctgtggacacctacgttaaacttatagactacttttacattttaacatttttttcctttgagttcttttaggagttgttaaacaatcctgaaatttcccttacaatatgctacaaactaatcataatttctcaaattcatttgacataatgattgattaaagaaatatgtgtagtataattacacctgctcataacaagagtatttgaaacttcaaga

SEQ ID NO: 175180 - DNA, 501 bp, Homo sapiens
ttgtggatggggtcatgggatatttcgagagaaaagtagttgagtttcagacatttccattttgaggactcatgaatgagatcattgaacaaaaatgatagcaaaaaccactcccaggggaaatgcaccatgcagcaggggataggtagggccaagtctagagcttcagttgttaagcatagctgctgctaccaaacagcatttgactaaggctggaaactgttggcacagctggagcttggtcattttcagaaatagctttgtttgaagccttagcaagcgaaagtaagcacttcggaaacgataaagtcatttgaaaaatatccctcccaagttgaatataaactgcttttatattcaacttggtaattctcaaaataagttttttaaaccaaaggtttgctgtagttgtggagctgaacttactgagagcctttttgtttctttaagctattgtctgaaattgagaacgaaattattaaaaataaaggatttatttca

SEQ ID NO: 175181 - DNA, 333 bp, Homo sapiens
tgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagagg

SEQ ID NO: 175182 - DNA, 417 bp, Homo sapiens
ggaagagccatgtttaattcacctggcagtgcagtgtggccaggcagagagggagggcctaccctgtgcttatgatcccaccccagttcccctggggtgtgccctggcggtgaacaccaggaggctgcagtggggcccaacgtgaaagggaggagcagcctcaccggggccagatggggcagcagcagatattcacagatgtccctgtgagtaaccagggcagaggccaggggtctggccttccctttcttggagccctgggccagctgggcaaggcgttgagagaaagattacccggtgacctttatcaaagcagagtaaggagggctttattcagaaccatcactgtaggtaccaggaccccagcggtgggattttgtagtaggggaaagaaaatgggctcgacgttgaatacag

SEQ ID NO: 175183 - DNA, 275 bp, Homo sapiens
ggaggggagggtgttctagtgcttgggacgctgggaagctcctgtgttgcactggatgatgttcattccatgtcagtttctggccccgatatgagtagggggagcgcagagtacggtgaccccaactgctttttgtcctgggttggtacattggtgagggactctggctaaggctcttcatttcccctggagcaggggcagaagtgaggaggggagggtcggagtctctggaggcttttgccgtcctgctgggtcttttagttgctactttgagt

SEQ ID NO: 175184 - DNA, 477 bp, Homo sapiens
cgagcccaggggacccaggagccccaagtggtgactttcatacccaaggtagtcaggcctttggactacaaagtgtggattagtgaacggaacaccccaccgagaaagccaccccttccagtttgtctgccttttagcagctgaagctggggagggccgggacagggtgtgaaccccgttgctcccgttgcccgggttcctaatgacaggtgtgggagttgatgttcacacctgagctaatgacagagtcaggccagatggtgcaggtgaccgaggacagcctccagcctagtagagaggccctggaggagacccgctgccaccctcctggctgtgcgacctcagaggagctgcttggcttctctgagcctgttttctcacctgtgggatgggaataagcacggtgcctgcctggcgatgttggctcaggattaaatgaaataatgcaggggaaaggttgtgaatgataagcggccg

SEQ ID NO: 175185 - DNA, 264 bp, Homo sapiens
cagcggaacaagcaaaggaaaaagtaaagaagaagaagaagaaacagcacaagaaacatagtaagaagaagaaaaagaagtctggatcaagtcacaagtcaaggtaacatcaagaaaaaaagcaagaatgagtttgccgagttcccctgtgttagtagaattatttctggactttgagttgcctatcaatcccactgtgccagtaaggggcatagtggctgctggcaacttcaatatacatttttgtttgtttgcttgtccttc

SEQ ID NO: 175186 - DNA, 322 bp, Homo sapiens
ctatgaataggctgtaggttccttaattctcaatgcttgctcaatgcttctcttatagcaattgagtaagggaacctgtcagtagcaggaggcaccactggtttcatgttattaggatgggcgggttaggggaagttatcacttagcctgcccacatcaaaacacagcacacttcatgtaccttttttctgctgatcaatttcctctcatttttaagaatagttaagaatggcagagtagcttatcattttgtagaatacctgtagtgtcctgcaggttcccagtgaactttctccccagttttcatgccttactgtgtctt

SEQ ID NO: 175187 - DNA, 115 bp, Homo sapiens
atcacttgtgttaaaggttaatttattccagacttatgtgatagaagcttctgtttgtcaaatcctaatattagttttgttctacttttgttcaatttaatattcaaagccactc

SEQ ID NO: 175188 - DNA, 362 bp, Homo sapiens
atggtcatttcacttcattcacagttttggataatgacttggttacatgtgtgcaggttgaggctttgccaggtctgtcagaaattgtctgctctggggctaaatggtgattccataggttgcacggtactctgaaacattggagttctgagaagtcagaatgcagacatattgcagggtacttcaaacactccatttagactacagaaagcctggacctgaatagaaaggatcacaccctataggaagtgccatctataagactgagataaaaaccagaaacctagcccgataggaagtgaaggattcaccagttaatctaaccagtaactgatgaaggattaatcagtaatttagttgcc

SEQ ID NO: 175189 - DNA, 160 bp, Homo sapiens
aatggacaaatgcaatttggctctaggctgtgaactcagggactttatccaaatcaccaccattctaatttaggtaatttggcaagattagcttagtcaataaattaaatatatatggatttacaaaagattttcacatatccccacaactaccctaaag

SEQ ID NO: 175190 - DNA, 503 bp, Homo sapiens
  misc_feature (4)..(4): n is a, c, g, or t
ctgnatagtcgactcctgaggatcccccaggcatgcacttgggtgtgaatgttggttggctcagatgctggctgtggccttgaagtcacttttcagggctggactgagtcccaaagggcagtccctgggtcttctccattttcatcagatatcaaatggggaggatgagaggtcctttcgtggcatcagtatattagagtttgaaggattctttagaatcagctagttttcttactcaccttatagatgatgaaactgagagataaaatgattcacataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaa

SEQ ID NO: 175191 - DNA, 166 bp, Homo sapiens
accctccatgaatggtgccctctccatagaggcagggtgtattaaactgaaccttgtttagagtccattcaattagagccctcctgacctctctattggtccttaactcctagaagccagaaaagctttcttctggctagacagattcaggtgttctgagttccaa

SEQ ID NO: 175192 - DNA, 563 bp, Homo sapiens
aaggcagcaaatacagaatagagcaaatctagggagggggaagtcaagttcatttctgaatatgtctccattgatctgacttcaatacatgaaagtgaagataatggttagcaaatacttggatatgtcgccctagatcgagaggtctgggacaaaaagttaactgaggactgatcaccacagtgatcagtgaagctacagcagtaaataacatggctccagaaagatgttgtaaagatgaaaagatctaaaggatgagcagagaaaaataagtctggtagagaagatggagaaggtgcttccagaggacaggaggaaaactggagaatatggcgtgtcagaagcaatgagaaaaagtgttttaaaatgtaatgagtgactcaacaataagaaaataaaacaacctgaagttaaaaacgaccaatagacctgaagagacacctcaacaaagatatatagatggcaaataagcataagaaaagatgctcatcctcatacatcattagagaattaaaaattaaaacaacaatgaaatatcactatatacctattagagtggccaa

SEQ ID NO: 175193 - DNA, 96 bp, Homo sapiens
gagccattgtggctccggccggttgcgcgggccctcggaccctcagagaggcgagggttcgagggcacgagttcgaggccaacctggtccacatgg

SEQ ID NO: 175194 - DNA, 660 bp, Homo sapiens
gtatttacatatgtatgcccaaagaaatgcttatgctctcatctgttagggagcaggaatttaactgtattctttcacaacatgcaaaggaactatagcaaaagaaaaactgcagagcttggggcttctggcttcccacatctctacttctttaggtagctaaactgtgccatcaccaggagacatttttaagccatgactcaatggcatccatggtaactttagaaataatttagcccaatgacagccaattaaataaataccacttataaatcagtttgttttaaaactccgtctttgtagttcttcttatacatcttaattgctccaacagagaatgctatcttctgcagtcttttctctttttatttaaagaaaatcagatatgtttcctcactaaatattgagaagtagaaatgcaagggttgtaaataacttactttaataccaagggctgtgaacttactcaaagactaaaattccatgagattaaaaatacctatgcaataattctaactgactaacactgttaactattgttatctcatctagttctgtattttggactccagttaacctatataaaacaaattgggccgggcgcggtggctcacggttgtaatcccagcactttgggaagtcgaggagggtggatcacat

SEQ ID NO: 175195 - DNA, 351 bp, Homo sapiens
ctgctcaagaatgttgctgcatcagatcgcccctcttttccttgcatcattaaaattccctgcataggccaggcatggtggctcacggctataatcccaggatttcgggaagctgtggcaggcaggtggcttgaggccaggagttcgagaccagcctggccaacatggggaaaccctgtctctactaaaaatatttaagaaattagccaggtgtggtggcacacacctatagtcccagctactcaggaggctgaggcaggagaatcggttgaacctgggaggtggaggttgcagtgagccgagatcacaccactgcactccagcctgggcaacagattgagactccgtctc

SEQ ID NO: 175196 - DNA, 594 bp, Homo sapiens
atacgaattcagctcgtaccctctataagggccaatcaaaagccattaaaatttcacagctaaatttgtatttttagctatgaaacggggttttcacctatgttggccaggctgatgttgaactcctcacctcaagtaatcccagcactttgggaggctaaggcaagaggatcgcttgagcccaagagttcaagaccagcctgggcaacacagggagacctcatctctacgataaataaataaataaaggaaaagagttaataagattggctgtcaggaataaaggtgaagaaagatcaagtgaaatcccaaagtttcttctacagcatgcttgaaacatgacctacagggatgggaccctcagaatgagtgtggagctagaggtgggaggatgtcatcagatggaggtatgttgagtgtgagatgagagcagcacgtccagagagagggggccagagggctcagctgtccaacgggggctgggctgaggcatgttacctggtgtgggctgagtccccacctgcgcacagtattttagcataagtaaagcctggttgaaattgtcattgtggacagcactgaaaaggaaatgaa

SEQ ID NO: 175197 - DNA, 234 bp, Homo sapiens
tccaggaggaagaggtgaatgccaacattggtgagcactgactgtctctgctgcatcctcaatcctggttctctttttggtaatgacactatcatctgtttaatcatggaggccagtcttctcatgcatccttatccttcatctctttatggccaaggtcgcctcaggccttcacagtctgatctttgcttgttcctttgatttgtccacttcaatgcattcccacctccacca

SEQ ID NO: 175198 - DNA, 112 bp, Homo sapiens
actcagagccaaacaccaaagcaaccattagcaatgatgcaggactttccggtccatgcactaattctgccactggctttatctgcttctttcatttcttcttggcctttat

SEQ ID NO: 175199 - DNA, 413 bp, Homo sapiens
gttttctttgaagcaatttgaataaagtgtttccaaattataatcaatgtaagattattgagattcatggttttggggaaaaagggtagaaagtttcttgtgggaagattttctaggctagcttaaagaacaggctgggcaaatgttcaccttagtataaagtgcacagatttggtgaggagattctgacaggacttcgcacatctaggcagtgaagatttgaaataatctactaggttttattgcagtcagtactaattcagcttcagaatcactggatggaattgtaagaagtttgttgaactttctctttcccttaggctcatatttttctgtaacgttatgagacaggtaaactagccctcctattaaggtgaccttcagaaccagtatagaattcaatattgtttttg

SEQ ID NO: 175200 - DNA, 508 bp, Homo sapiens
cgtgatgtgctggtttatagcagatgctgattactgtggtgtaaatactcctattatggccaatttcaagcaccaacagttaagatttggcttgcaaaattcctgaaaatttaacagtgatacatcttgagttagcaggtctgttacagaatggatgttcctgcttcatgtccttgggtgtggggagctccaggattggaagacacccctcaggagagtaatttctgggcaggcgtagtggctcacggctgtaatcccagcaccttgggaggctgaggcaggaggatcacttgagcccaggagtttgagaccagcctatgcaacgtatgagaccctgtctctccaaaaaaaattactttttaaagagtaattagctttgtcttcttactgtatttcctacctggggctcacagagttagtaatgaaagtccttaagctatttttgttattttagtggttcaaaactcataatagaaactgagcatacagccataagatggctgcagag

SEQ ID NO: 175201 - DNA, 518 bp, Homo sapiens
tggggaggacaggttggcccagatgcccccactagaccccttttatgcagtgcacaaaactctcagctgtgtgtgctgatcccaaccttaacttcctgcaaactagcctttcctgtgtgttcctggtgcacacacacgtgggcacacagaacaaaaggatctgttggtaacagggcttgtgtggctaccgtggttagaagtcttccactggaatctctcttatggaagtatctagatatgaagttagaagttgtagacattgactcttaaggtctcttgtagctctgacattctatgattccccaactctattctctgacattctgattcctcgactctattctctgacattctatggttcctcacctctgttctctggtggtctgtgattccttgactttgttctctgacattctgtgattccctgacttagttctcaagcagtttttctcccctatcttcatctcgtatcatcaccttaggactaggatggacaggactgatgtttccagccttat

SEQ ID NO: 175202 - DNA, 517 bp, Homo sapiens
ctgctgatgtgacaggaggcggagctcaggcagtaggtaatgctcacacagtggctgctcactccctgctgtgcagcccggttcctcctaacaggccacaggtcagtactggtcctccccagttcctaacaggccacaggtcagtactggtcctcagcctgagggtcagggacccctggtctagaggacaaaagtgttcaccacatattacatcagctaagaaaggcactttgattaacaataaatcctttaagggctatttttataacaaaaaggattaagtctattagtcattcagagcatactatagtgactttaatctgcttgccaagttaatgcaacaggaattacagtgggtctgagagaggtgaaggaggatggaagaaggaaaaaataaaacaatgataacttgggagagagaggcgcatatcaagagaaatgtagagaaggttggactgccccagtgcagggcttcaaacagctgtaaaacccctgggggaaagaaaggccaaagcta

SEQ ID NO: 175203 - DNA, 321 bp, Homo sapiens
agcaaatgctgccaatgtgggccaggcaggcgtaaaagattagacacccatgctttagactataagtgcagtcacttaaaagttgtgtttacaaataacctttagtagaatatggaacggaatataatatttataaagcaaggctgaaaacaaatatatataactaaataaaaatacataatcattcaaggaaaaagaaacaaaacaggcccagcacagtggctcatgtctgcaatccaagcactttcggaggccacggcaagcagactgctcgagtccaggagtttgagaccagcctgggcaacactgcgagacctcgtg

SEQ ID NO: 175204 - DNA, 726 bp, Homo sapiens
tcttgtgaaaactgtgtaataatccttggtacagttatcagttatttaaccagtcccctaagatatatatttacattatttctaattgtttcttgctgccagcaatactaaaatgaatttccttccttgtatgtgtgttatttcacacatgctgaacaattgtgtggttttgttgtccatatttaaatctgatctatctataatttatagatacaatctaaggtagggctccctctcctttcctaggttagataaccagttgtcccaatgtcctgcattgattaatcagtctttctaccaataatgtgaaatgccacttttactgtaatgaaaattccgatttgttcatcttttttctttgcatcagtagaatttcagaatttacacaaattttgtcattctatttcttcctggaaattttatttttcttactgttgttgtaaataattgagttttggtcttcttttcaatcacctgtctttttggtttctgtatatgaatgctgttagtaaattagtttgtacccaaagaatttattgaactatatacttaatttaaattacttaaaaaagcatatcagctgattttcttgggttttctagatacatgatttgcaaactccttatcaacttttataactagtccagttatgttggttattacctttgcagagtgttaaggaaaagtgacaaccacagacatctttgaatattcttgattaggtta

SEQ ID NO: 175205 - DNA, 206 bp, Homo sapiens
tacatattgccaagtaatactaactacctcaaaatggaattgtagggtggggatgccaatcagagcaaccctgagcatagtgttctaatcacggccaaatcgaattcacttgtagtgattctagatggagatttctaattagaacagggacaaatccaggttctgtggagcctaaagtttatgcaattctaacagccctccttggt

SEQ ID NO: 175206 - DNA, 170 bp, Homo sapiens
aaagtgattcatgggatcccctataatcgccctgctgaccttcaagctcgactcagggccaaatcgaattcacttgtagtgattctagatggagatttctaattagaacagggacaaatccaggttctgtggagcctaaagtttatgcaattctaacagccctccttggt

SEQ ID NO: 175207 - DNA, 566 bp, Homo sapiens
gcagtgagccgagatcgcggcagtacagtccagcctcagcaacagagggagaccgtggaaagccggagagggagacagaagagaggggagaggggagaggaaccacaagaaatatttgaagatataatgctcaagaacttcccaaaattcatgaaacaccacaaaccacagattcaagaatctcagataccctcaagcagaaaaataccaagaaatacagacctagggaattactactaaactgctaaaaattgaggacacagaaaatcttccatcagcctgaaaaaaaggaaatatttatacaggggccaaaaataagaattagaccttcctcttgtcagaaacaataaaagccacaacgatagagtaatatcattaaaggtatattagtctgttctcacactgctgtaaagaactacctgagactgggtgatttatgaagaaaacaggtttaattggcttctggctccacatggctgacaaaccctcaggaaacttacaatcatggcggaaggtgaaggggaagcaaggtgtgtcatatatggtggcaagaggaagggggaagt

SEQ ID NO: 175208 - DNA, 290 bp, Homo sapiens
cttttttgagtaggggattctgaaccttttgagaagtcataacatctttgataatgtggtctaatctgtccttatagttttcattataatcataagttctgtgaaagagaggtacagaccatcaggaaagtgcaaaccactgatccttaacaaagaggacataatccttggagggaacgtcaaaaagactttctaaagaaagtgaattcaaggtcaagtctgaaagttgaagagaacttaacaaaaagagggagtatttttcagatagcgattatattcagtaaatcctg

SEQ ID NO: 175209 - DNA, 638 bp, Homo sapiens
ttacctagtaggcatgtctatgaagctaacaccagaattcctccaatataggttgcaactccaataaagttcagaggtaaaaagaaaactattcaagaaacacattggactttcaggacctgcaagttaatgcagccatgccccaaaatacatcagacatagacataatctgcaaaacctaggagctaagtaataatccaatctctgttcttgggtcaggatatggagttttgaacttggctgagccacgaaagtagaaactgagacctttctaaaaagcttcaactctatgaaaattgctagtgcgaaagcagaaaacagtaactacagtatcttataagctaaacataaacgcaccaaatgactatacctagtcccaggaatctacccaagagaaataaaaacatccacacaaagacatgtctacaaatgttcatggtagcattattcataacagctaaaaaccggaatcaacccaaaccaccaaatgcagatgaataaactgcagcacaggttgagtatcccttatccaaaatgcttgggacgacaagtgttttagagtttggaatagttgcattttcaaccctatctttacgccacagagcagagaataagccaaaacaccaccaccaccacca

SEQ ID NO: 175210 - DNA, 178 bp, Homo sapiens
tgagaatttacacaaggttcatcctttgtttcacaaaagtatacagtggcttcagctctccattccttagaacatcgtttcctgccctgcatgattagctttggctagaaggtgcttctgtaacatctcacattgtgtatctcacatccctctttgtacctcagctctgtgtattctt

SEQ ID NO: 175211 - DNA, 366 bp, Homo sapiens
cctatgtgtttctctgtttgcattgctataaagaaacatctgagattgtgtaatttagatagaaaagaagtttatttggctcacagttctgcaggctgtacaagaagcatggtgccagtatctgcttcagatgagggcctcagaaagcttccatttatcccagaaagtgaagggggagcatgtatgttacatggtaagacatggagtaagagagagaaggggtaggttccaggctccttaaacaaccagttctcacatgatcccagagtgagaactgattgccgtgaggaaggcaccaagacattaaggaggaatccactcccaggacccaaacacctcctatgaggccccacttccaacgctgga

SEQ ID NO: 175212 - DNA, 393 bp, Homo sapiens
gttttgcctccacactcatttgcgcaatccagcttcccggacccctgtgacgctccaagaagacgaggaggcaaaagccggcagttcaccaacaggaaacacagaactgtctggtgctagcaagacggccgtgtcgccaatcaaagaagcgcaaatggaaacaagagactgtcctcatccttccccctggcacagattaaaacgcctgataacaggaggtgccagccagggtgttgggaacaggcccagcggctggcaggagtgaggagtcgcacagacaagatacttctgtggagggcaggttggcaggcccggccagagccctgaggaaacctggcccctcccctctcagaatcttccaggaattcgcccgacggctggagtgagaagcct

SEQ ID NO: 175213 - DNA, 198 bp, Homo sapiens
aaaggagacacagcaaggactctcaaggtatttatctgatggagaacacacacaagaggcagtcacagcacagaaaagcaagtgctacacaggattacaagaacgcccaggagaggcatccaatctatgctgtagcatcatagaaggcctttcagaggcagagggacctttcccagaaggctgaagaatgagcaagag

SEQ ID NO: 175214 - DNA, 305 bp, Homo sapiens
ttatgaaatcttaaactgaacagaatagctactatatgagcctcaagaaccaactgactataggtgattaaaaacatattgattgaagctaaggacactgtgtaatagagacatatctcattacacaacaattaaccctcaaataggtttccaacaatcaggtggtatttatttaatggacagtaactgctttatgaaatataaattaaatacatacacaggaagcttcatttatgaaacttccattttcaagtggaatggaggccaaggcttgaccaaaagtctgatacttctcatcaccacag

SEQ ID NO: 175215 - DNA, 233 bp, Homo sapiens
ttggcctttccaagtgctgagattacagccataagccactgtgcccggctcattcggctgttttgattgttttagttagccttataattattgtcttatatcattatgaatttttttaacacttatagctgctttctatttcatcatatagtataaacgtgaaatattctgggggaggtaaagtatttaaaaatcgattaaatggtcatccattgaattgtataaaaacttat

SEQ ID NO: 175216 - DNA, 601 bp, Homo sapiens
agagacgatgtctcactatgttgccctggctggccttgaactcctggccttaagcaatcctcctgccttggcctcccaaagtactgggattacaggcataagccaccgtgcctgaccaagatgcagaactattatatcaccacaaagatttcccttgttacccttttacagtcacatgcacagccctccctgctcaccatccctaacatctaacaaccactaatttgttctctatctcaataattttgtcatttcaagaatgttacatatatgaaagcaaacagtatgggaccctatgaaactggcttttttccttcagtataatgtccttgttattccctgttaattcaagttactgtgtgttccaatagcttgctcctgttctggtcaccctgcaaatgcaacagggactcccaaccaaagtttggtttggatggtgaaactgatgacgccacacacacacagcaagaggatatgaaacgttttcttacatacttgaagcctagggagagtagaacggccctattaagcagatctgaaaaggcctgagaaagcaaggaaaggagactggccttggtgtttactgtggttaggaggtggg

SEQ ID NO: 175217 - DNA, 474 bp, Homo sapiens
ccacgaacgcggtatatttctcaagttctaacacgtcagcgtaactgagtcttccaatccacgaacgcggtatatttctcaagttctaacacgtcagcgtaactgagtcttccaatccacgaacgcggtatatttctcaagttctaacacgtcagcgtaactgagtcttccaatccacgaacgcggtatatttctcaagttctaacacgtcagcgtaactgagtcttccaatccacgaacgcggtatatttctcaagttctaacacgtcagcgtaactgagtcttccaatccacgaacgcggtatatttctcaagttctaacacgtcagcgtaactgagtcttccaatccacgaacgcggtatatttctcaagttctaacacgtcagcgtaactgagtcttccaatccacgaacgcggtatatttctcaagttctaacacgtcagcgtaactgagtcttccaatccacgaacgc

SEQ ID NO: 175218 - DNA, 102 bp, Homo sapiens
gatgcttctcaaatcatctgtaatgacttttatttatagaaaaggtagattattcattagtttttatgaaaaacactcagtttaaatagccgggtatggtgg

SEQ ID NO: 175219 - DNA, 185 bp, Homo sapiens
catgttggccaggctagtcttgaactcctgacctcaggtgatccacccgcctcggcctcccaaagtgctgggattacaggcgtgagccaccgcgcccagccatctaagtcacattttgagaatccacttgtccgtgggtggacaggcgggttgttcccaccttttggctgttgtgaattgtgctg

SEQ ID NO: 175220 - DNA, 264 bp, Homo sapiens
catgttggccaggctggcttcgaactcctgacctcaagtgatccacctgcctcagtctcccaaagtgctcgtattacaggcgtgagccaatgcacccggcccttggtgtggatttctttgggttttcctgtttggagctgacttactttctttaatctgtaagtttatgtctcatcaaatttgggatgttttcagactttgtttctttgaatttgactcatcttatttgcatcatttgatcgtcttctccctctctctcgcgtt

SEQ ID NO: 175221 - DNA, 483 bp, Homo sapiens
  misc_feature (445)..(445): n is a, c, g, or t
  misc_feature (459)..(459): n is a, c, g, or t
cagggaaaccaatggggttgccacagagtaagcaaagggaggagtggcagatcttgaaacagactttagctactattaataactggagaacagataataagaaatcaagggcagaagcagagaatgcacttcaaaagaagatattgcaggccgggcatggtggctcacgcctttaattccagcactttgggaagccaaggcaggcagatcacttgaggtcaggaattcaagaccagcctggctaacacagcgaaaccagtctctactaaaaatacaaaaattagctgggtgtggtggctcacgcctgtaatcccagctatttaggtggctggggtgggagaatctcgaactcaggaggcagaggtttcagtgagccaagactgcgccactgcactccagcctgggcaacagagcgagactccgtctcaaaagataaaaaacaaanaacaaccttactcntcaatccctggcattccctactca

SEQ ID NO: 175222 - DNA, 185 bp, Homo sapiens
gggtcaccatctagattattttcacaatccccactggtctctttgtcttcccttccaccctccatgcttaagtgagttattttcataaacttcacgtcttatcatgagtcctcctcaaataacgtggaagacctctgttcccctcacactcaagatcacccagcagggcttccaggcagctcaga

SEQ ID NO: 175223 - DNA, 642 bp, Homo sapiens
gatggggggtggagaagaccaagtgtaactgaccaccttgtcagaagcagccagcagtttgatgcggcttctgaaaatgacagtgctagtgttaaagctgaagttccagtggtttcagcactggtcctccaatatctaagatcagtaaataacggcccatgggccaaatgcagcccatagcctgtttttgtacgcctctccaactacaaatgggttttgcatttttaaatggttggaaaagaaaaagcaaaaggcacataatatttcgtggcatgtgaaaattttatgaaattcaaatttcagtgtccacaaataaaatgttactggaacacagccacgcctattcatttacatgttgccctatgcctgctttcatgttatgaggtcagagttgagtagttgcaacagagaccttacggcttgcaagtctaaaatattgctatctggcggtttgcagaaaaagttagttgacctctgctgtaacgcattgcgttcaatattttctaaagggcaataagaaagaggaaccacaggaatggtgagggagacaaaagcatttcataaattcaatctgaaggaattgagagtagcaagccagtggaagagaagatcaaaggagaacaatctagatttcttttcttt

SEQ ID NO: 175224 - DNA, 360 bp, Homo sapiens
aggatactagtgctctaactgatgaaacagacttttctgacttagaccttaccactgcatttgactaatagttgcttttcaaggactccctagagataattgagtgctggttgaaaagtagggccttcaaggatatgttttaagttctccgcaatgatataaaggacagcccttagctggagccttcaagaagtttgtataggaacttgttcttatccttatcagttcagctaatgagaggcaaattctgagaggcaaaattcttataattttctaaggatagttataaaacctttttctgctaaaattgtttcaactctgggtggactgtcatttgtccccttgcccccagtagttgtc

SEQ ID NO: 175225 - DNA, 411 bp, Homo sapiens
gcagacgctggatcagagcacggggaaggccgtggtgaccggggattgaatgcagggtgaggaagagcatggaatgaaggatgagctttagcttagcggcttgaggaactgggcggtgctgttgactgaggtggggtgcaccctagaggaaaaggttttctaggagcagctagcactctgctttgtgaaatttgagctgtccattgaacaatcagtggagacactaaggaagcagctggctattggagtcggaccgaggggcgagatgagggtggggtgtagatttgggagccatcagtatgtggatagtatttaaggccacaagactgggctgtatgttatgtgtcacaaaggtgaagtgtctcaggtgtccccacaagccgacagtaagtgctgaaccaaacaaccacg

SEQ ID NO: 175226 - DNA, 524 bp, Homo sapiens
caatacaaccatcacataaattttggagcactcatattctaaactctggacagattcttgactaatttctgaagtagagatgccaaactcatttttaaacatgactgaaactggcataaaaacagatacatagaccaatggaacaggatagagaacctagaaataaatctagacatttacagccaactcattttcaacaaaggtgccaggaatattcaatggtgaaaggacaatctccgaaaaaaacagtgctgggaaaactggggatctatatgcagaatagtgaaactagacccccacctctcactctatacaaaaatcaaggcaaaatggatgtaatactaaaatataagacctaaaactatgaaactactagaagaaaacatgggtaaacacttcaagacattggtctgggcaaagactttttgagggtaagtcctcaaaaacacaggtgacaaaagcaaaaattgataaatggaattacatcaagctaaaaagcttctgcacagcaaaggaagcaatca

SEQ ID NO: 175227 - DNA, 667 bp, Homo sapiens
tgatctcagactgctgtgctagcaatcagcgagactccgtgggcgtaggaccctccgagccaggtgcgggatataatctcgtggtgcgccgttttttaagcccgtcggaaaagcgcagtattcgggtgggagtgacccgattttccaggtgccgtccgtcacccctttctttgactcagaaaaggaactccctgaccccttgcgcttcccaagtgaggcaatgcctcgccctgcttgggctcacgcatggtgcacacacccactgacctgcgcccactgtctgacactcctagtgagataaacccggtacctcagatggaaatgcagaaatcacccatcttctgcgtcgctcacgctgggagctgtagaccggggctgttcctattcggccatcttggctcctccctccgtccacatctagaatggagacttggaagatattttgggggatcatcctccttgaagctggttttggcttcaagtcacagaggattggtaatacctgggtttctttaagctgaaaaccatctagtggtagtgaccatcttaaaaggaaatattacagaagcttcagaattaataagaggcaatcgattcattgaaggagaatttagtcagaatctggaagcttatagtgaatggtgggcacttgttttttcagtactta

SEQ ID NO: 175228 - DNA, 489 bp, Homo sapiens
ctgtcctctgcagggactccttaagagggaggagtcatgactgacccccagctttccaacacaggttgggtgagctgtgatgccaccaaccaaggcaggaatgcaggcctgtatgtcagtgggttgtggggaaggctgggttttgaataaactgaatgtgagatggcctcagaacatccatgcagaaacgtaagcaggcagtggaaagtaagggctagagagagatctgagtgttactgacattagggtgtagctgaaacccgaggcatggacgacaacgcttcaggagaaaatccagaatgacggagatgctggagacagaagctggtacgcatgagcacggagggccagcctgacagaggagtgcagaggcagagaaggaaaaggcagaaagaaaaacccaggagtgcattattgcatgtggcaacagtccagaaggggtagtgatcagtaagtgaactgaaagggtcagtaatctaagggctaaaa

SEQ ID NO: 175229 - DNA, 314 bp, Homo sapiens
gaaccactgtgcctggcctttacctttcctaaacatcaatttccttcttaagcatttatgttcagtttttccagttttaaatattattttcattaatagtaacttctagtatataagttactattaatgaaaatagcttcctgcttctgccagggtcttctttcaagctcatagggctgttggaaactcacacggatgtcatttgatcagcactcaggaggacctcatatattgtaaaacgctgcttcctgcttctgccaaccttctgctgcttcctgcttctgccgcttcctgctttgctgccttcctgcttt

SEQ ID NO: 175230 - DNA, 284 bp, Homo sapiens
ttgagcttgactctagtctggcacggtgaagagacatgagaggggcagaagcaggaagcgcttcctgcttctgcccaggtcttctttcaagctcatagggctgttggaaactcacacggatgtcatttgatcagcactcaggaggacctcatatattgtaaaacgctgcttcctgcttctgcccccctccgtgcggtccaacatccgggtcacagtcacagccaccgcggtcatcatcaacctagtggtcatcatcctcctggacgaggtgtatggctgcatag

SEQ ID NO: 175231 - DNA, 405 bp, Homo sapiens
accaacaaaatgggtccagagtacatgtaccgtttgagatttgacttaccagtgagtatatgagatgactcataggagctaggattagaaaggtagtgttggccaggttgtggaaatgccgtggagtagaactgaattttagtcttcaggcatggtcactgttggcattttctgagcccaggagtgatagcatcagagctgggctttgaaacgttgaatggatatgtgattggggtggacttaaaaggagaaatactggccgagcggaccggtccgctcggaccagcctggccagcgtggtgaaaccttgtctctattgagaatacaaaaattggccgggcatggtggcgggcgcctgtggtcccggctgctcgggaggctgaggcaggaggatggcttgaatgc

SEQ ID NO: 175232 - DNA, 450 bp, Homo sapiens
cttatcctgcactcaaaataattccctagcccaagaagtgaatgaactgagaagtaattactgatgatcctctggctacacccaggcctacggttgttcagccactctgcctcagccccaacctcaagcaaaaattacttttaggagctaaataacccctttgctgaccaaaattgctcatttggaagccaggatcctctctgcttaggaaagcttgggtattccatggttatctttatcgtggggcccaacttgaagtcagctcaaagtcacggtctaaccataaaccaatttgctgttttcgtaaactgtctgcaaacaaaacataatcgtttggttttcccgttgtcctgaagcaaaacaaaaatatttaaagtcactcatatgagaatctaacaagcagtttaaagaggagtcaaaatatactttgtactctggatggaacaggta

SEQ ID NO: 175233 - DNA, 343 bp, Homo sapiens
actgatttagaataatcagggacaagagacaaaaagatggtctaccttaacactgcaacaaaatcataatgctcatctgatgaactggggcatatgtgcatacagctttagagactcaatggggtcatctgtcactggtgcatcccatgcggacaagcaaacggaacacaccaatttcaggcagtttaagattatcaagcaggttttgtaaccttcccacatcttattaacaccactcatttgcttgacaaacctgccctctggtcttggactgaaggactgaggcatgagccctgccctgaggccagttataaatttcaaactgagccacccccaaaaaaca

SEQ ID NO: 175234 - DNA, 387 bp, Homo sapiens
ctaagatcaaggtgccagtagattcagtatctgttgagggcccacttcctgattcatagagagctgtcttcttgctgtgccctttcatggtggaaggggtaagggaagtctcctttattttatttttttattttatttattattattattatttgagatggaattttactcttgttggccaggctggagtgcaatggcacgatctcggctcactgcaacctccgcctcctgagttcaagtgattctcctgcctcagcctcccaagtagctgggattacaggcatgtgccaccatacccagctaattttgtatttttagtacagatggggtttctccatattggtcaggctggtctcgaactcctgacctcaggtgatccacccacct

SEQ ID NO: 175235 - DNA, 490 bp, Homo sapiens
atgggatctttttataatattttctaagtagttattaacagtatgttggaaagctatttgattttcatatatttatttataactatctagtttattaaacttactttctagttctgatggactttcagttgattctcttgggttttccagagagctaatcatataatttgaaaagaagtatagtttaaacccctctttttccaatacttatatttatttcctttcttgactaattaggtaggtgagcaattctagaatgtcaaatagtggttgtgatactgaccatctttaaaggggttctggtcaatatttctccatcaggttattaagtatttttatctggaatagatattgaaaattgccaaaagcagtcaaggtcagtggctcatacctgtaatcccaatgctctgcgaagccaaagtgggacgatctcttgaggctaagagttcaagatcagcctgggcaacaaagggagacattatttctacca

SEQ ID NO: 175236 - DNA, 563 bp, Homo sapiens
agcctggtacatttttgagaattttgcaatggatatcatgatatcatgttggtagcttgaagacagctacagtggtggtatttacaccatagaaattggcaaacgttaccaatcagaaattttttctttctcctggagagccaactgttaggcatttccagcataccactgctttgcaggacaaaatctgaacacctacgaaaatctggccattctgcaaactgtcacaccgaattgaggagcagttgcatgtctcttcctgaaagaggcaatcatcatctcaaacagcagttatatgcaaacgtcacttctggagctgggaaagcatggtctgtttctggcagtagaatgatcttttatctaattaagctcaacttgggctaatgttgtgagcgtgcactctctgatcagacaccaacagctggcggctgaggtgcatgccggggtggcctgagaagctggtctggagtgttaaaagtgctgtgggttgcccaccatctctattgagagggaagtctcagaaagagcccagccatgcagtcaggaagttggggttcaagccc

SEQ ID NO: 175237 - DNA, 448 bp, Homo sapiens
tcaaagtactgggattacagacatgaaccaccacatgcagtctgcaattaccatttcttaaaacacagtatatgccaggcaaggtactagtgtttttttacccattatctcaaacatcccttatcctgggtcaagaaggttgtccaagatcacacaactcataaatggcaaagttaagattccaacctgaacttacacatgtgaatccaaatgctatatatttcatgctacaggcccccaaatttaataattatagctccttcaagtccaggctttactactatcaaacatacaagccctgggatggcaaaaaggtttcaccaactggcaatggtttcctggaccctgtgttaaggatggtatggtgccctgtttgtcatgaggaagtatgtgggataacataagcaccttgcagtctacccactctctgtccaaactttctcattca

SEQ ID NO: 175238 - DNA, 419 bp, Homo sapiens
ggacatcaaaagcacacacaacagaagaaaaactaaacaaattgactacatcaaaattaaaaactttatcaaagccacagtaagacatcccctcacacctgttgggatggctattatcaaaaagacaaaaggtaacaagtgttggtgaggatgtggaggaaagacaacccttgtacgctattggtgaggatgtaaattggtacagcgaacatggaaaacaatatggaaggtcctcaaaatactaaaaacatgttatgatccagcaattctacctctgggcatatatccaaaggaaatgaaagcagtatctcaaagtgatagctgcactcccatgttcattacagcactattatatgtatatgtgtgtgtgtgtgtgtgtattaattatatagcaaagacatggaaacaactaagtgtcc

SEQ ID NO: 175239 - DNA, 304 bp, Homo sapiens
gtactacctgtaagaggatgtcaattcaaatcagatgttgggaacaagaagggaaggaagaaaaggcagttacaggagaatgtgagtactgctcctagtaggaaaccaatggcaataactgaaatcagaggggatgatgggcattgcacgggaggacaagtaaaggtaacaactcgaatgcaaacacaaaggctcccacattctggagataaccaggggaaaagatgtatgtgcagtgaaaactgcttctattgggtagaaaaggggcaggatgccctgtaggaaaagcagcccctggaggaag

SEQ ID NO: 175240 - DNA, 549 bp, Homo sapiens
ggtatgccttctggaaaattccaacctgacccttgttggaactgtgaaaaggggacctccagcagctctgtcaggattggccatgcctccagttctgggagtgggctgaccaactatcttggttttcttggggttgtcctggttttaaaacctgaagtctcacaactcaggagaccccctagtcccaggcaaatggggatggttggtgactctcccaggaagaatggttgctttgccttcatctccagcttctagaaaggaagacatgagcttggggcaaggtgagaagaaattgcagggatttggggagctctagacagccaaggggtggtgcttcctcggctttctggctgtaacaggaagtggggctcagacttgagatgcgccagtttctgctgaatatgagaaagggctgaagtgtgagctcctggtcacaagaatgttcaccgcagccgcagccgggaggaagaatggatgcctggctggggcccaggggcctctatggccacgcccacttccaggctatttcctacaaaagctctacctctt

SEQ ID NO: 175241 - DNA, 541 bp, Homo sapiens
ccatgtctggcctaataaactcggagataaccaattcgaaacaaatagttgatatgttaatgtaaaacacatacgcattctcttagattgcattgttcctttaggagaaagatgcattcttctgtatgttaaatgttgttgtatacagcaaatatgattccagcaaaatccctatatgtgatcactagcctaaaaccactcctgtcaagcaatcactttcagcaaagtcctaatggaaagtttcagatttctctcataaagttaaagttcatgagattgtgcaagtacttgttgacaaagttttgaaaactcaggaaaagtaggtttttaatgtgttgctagtagatataataaattggttttaattgtgatttttgatgttgtgaggtttggattttgttcttttatatgttctttcagtcatcattaaacatttttaggtcttgattgaggaggttgaagttagagtcagtgcctgagactgtgcagtattaaaattatgagaggactatgatatctcatttttgggtaaaatctgtaa

SEQ ID NO: 175242 - DNA, 325 bp, Homo sapiens
ggaggggattaatactcgggaggctgaggcagaagaatggcttgaacccgggaggcggaggtggatgtgagccagagatcatgccattgcactccagtctgggaaacaagagcgaaactccgtctcaaaaaaaaaagaaaaaaaaatgctaatatcaaaatgagtactacattagtggatttaaacatatttcagactagagttttaaagtaagacaaagttattaagtttatagttaagcttaggagcattttgaaacaaagatgctttttagagaaaaagttaagtaaactatggtccaaggttaatgaggagtactatagag

SEQ ID NO: 175243 - DNA, 320 bp, Homo sapiens
ggtgaccctagaggatacggtattgagtgcatgtgattggacagcaagagagtgggcaagccagggacagccaccacagttaaagtactgtgggccatgccttcatgcccccctcactcatggaatttttctggactgagccagagtctggagaggtggtgcagctgttccctaagtgagtggggttcccctacctttcactcagggaatgtttaatgttttccttttacaatttccttcttcagcttccctctctcctaatgatgaatcctgtaaacttttgcattgcctatgttctgctggaaaccatgttactgtgt

SEQ ID NO: 175244 - DNA, 603 bp, Homo sapiens
gggactataggcacccgccaccacgcccggctaattttttgtattcacagtacagacggggtttcaccgtgttagccaggatggtttcgatctcctgacctcgtgatccgcccgcctctgcctcccaaagtgctgggattacaggcgtgagccaccgcgcccggtggaaaggacacttttttacagtatgagcactgaaacaaaaaggcaaagcaaggtctgttcaccttcagctgagaacgtgagcgatggttcacgcgagtacatgcgcaggttagtcatataagcaaattatgtggcacagaagtttggcgtatggatcatttcatcaacccagaaacgacataaaaacaggggactatctcctctgatgtgatttaactaaagtattccttacactcttcagtttgcagaaagagctgaattactcaaagacatacaccacacaaaacattcgtgtacttcatcgaggcctgctgcctggaatgcatatgtgatggctggaaatgctagctctaattcggatcactgaggaagagtcccaacaccatctgcgcatgcgggcatgagcctgcccgcgctgcgggcgggacatgtacgtgg

SEQ ID NO: 175245 - DNA, 142 bp, Homo sapiens
tgaggtcagtgaatacagccctccacctgtgtgtccttcgggtgtgaggggttttgctgatagagcagcaggccccgtcccaccctttatgcatctctgccccccacctcgtgctccagctgacctctcccctgtggcatgg

SEQ ID NO: 175246 - DNA, 375 bp, Homo sapiens
ggggagatgcaatggtggaatgggtggccaatttaataaaacttttcacaatggcaaacacatcaacaataaaacatatgtcccggaaattgttttaataaactcaacaaaacactgttaaagaggccaggtgctgtggctcacacctataatcccagcaatttgggaggccaaggcaggtggatcacttgaggtcaggagttcaccattagactctcacatttacatatattccggaagatgtgagagtctaatggtgagctctatgaagatgaattggacacagttcatacccccagaggaatctggtaaagaagacaaacagggccaggcgcggtggctcacttctttaatcccagcactttggggggacga

SEQ ID NO: 175247 - DNA, 330 bp, Homo sapiens
cctctctccaagtccctgtgaagctacaaacaagcggtgtttggaaaattctaataatagcatcaaagcggaacgttctgaagcatgttttgtgccccatgtagcagaagtagccatgggccctcctagtttcatcacctagggagaacaggtaaaatacaggtagagaagtaagatcagcctactgcaagctttgaaagctccagcccaacagctcccaaaacctctacttaggcaagaatcaaaagatatgaaaggtttaagaatgaagacctgggtagagtacagagtgaggaacaagacagaaaggccaagttttggatttcccaa

SEQ ID NO: 175248 - DNA, 244 bp, Homo sapiens
gaaagaaaggaggagggaaggaaggaaggagggagggagggagagagggaggaaggaagggagggaagggaaggaaagaaggaaggaaggaaagaaaagagaagggaagggggaaagaaggaaggaaaggaggaaaggaggaaaggaagaaaggaagaaataaatcccctccaaacactgtagcatgatggaaagcctcataatctcctaactcaagtacactactgaaattcacctctagatg

SEQ ID NO: 175249 - DNA, 311 bp, Homo sapiens
gcttttgcgagaataccaatcactcctggtctcaagaggcttgtggtctgctgcagatggacaagtacataaattaactgaaacataaggcaaaaagtaagatgatcctgtaagagttttttttttttgtgagacagagtcatgctctgtcacccaggttggagtacagtggtgcagtcagtttgttgcagccttcacctcccaggctcaagtgatcctcatgcctcagtctagtgagtagctaggactaaaggcacatgccaccatgcccagttaatttttttggtttttaatagagataaggtctcact

SEQ ID NO: 175250 - DNA, 286 bp, Homo sapiens
aaggaagtttgatcgactcacagatctgcatgtctgggggaggcctcaggaaacttacaattatggcagaaggggaagcaaggcacatcttacatggcagcaggagagagaaacagagagtgaagcgggaagtgccacacttttaaaccatcagctcttgtgagaattcattcactatcatgagcacagcatgagggaaactacccccatgtaatacctactccagtgacaatgtaggtattacaatttgagatgggatttgggtggggacacagccaaaccatat

SEQ ID NO: 175251 - DNA, 208 bp, Homo sapiens
gtagctcctgaccattttttaataagatctttcagattttgtccgttcattgaaacttcatctacgtgtaaagatttgaactatcaggtcattttgacatgaggtgatggttgaaatagtgtctggaaacaaaaccagtttaaagaaaaatacactttacagaattatgcacagtctcagctcgagagggacattgcaattttttttc

SEQ ID NO: 175252 - DNA, 257 bp, Homo sapiens
gaaataaaggggtagaataaaaagcatcctgttaggcagtggttttcaggactggccagacattgcttagggaatttctcaatctaccaatgcccaggcccatcccaaagcttctgaaattactggcctgtagaggggcccagacaggagtttttgaagctcttcaggtcattccaatgtgtggcccaggctgagaactgcatttgggtaacatgacagatgtgagtggggacagtaacccccacactactccccgc

SEQ ID NO: 175253 - DNA, 494 bp, Homo sapiens
cattcaaatacagcagttttctgtgcgacttttcgcaaccatagctactttgatttctaattacatgattagtagctaacctgattagctctgcctgagatacaaaattcaaatagcactttgctacagaaagtggaatttactgttagaataaacatttcaaaatagtgtcataaatattcctaaagctagaaatgacctggaatgttaatcttgtttatccttctgctttaggacagatctaaataaagacaattccaatcacatattctgtttctgagctattccaatataattaaatacaacaaatatttactgagaatttatatgtaccaggcacaatatctagaaaaagaaaaactaaattcacttggcaaacttttcttactctttaaaattgttaattatgtttgaagttgtaaagaagctatcctgatcccccttccttttttattgttttactaatttatttgtctttttttaaaaaaaaaaaa

SEQ ID NO: 175254 - DNA, 708 bp, Homo sapiens
  misc_feature (60)..(60): n is a, c, g, or t
  misc_feature (89)..(89): n is a, c, g, or t
  misc_feature (176)..(176): n is a, c, g, or t
  misc_feature (369)..(369): n is a, c, g, or t
agcggagttggaacgatggcggcggcagctgccgccgggcctagcccggggtctggaccnggggactccccagaagggcccgagggggnggctccggagcgtcggcggaaggcgcacgggatgctgaagctttactacggcctctcggaaggggaggcggcgggacgccccgcggngcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagcnacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcc

SEQ ID NO: 175255 - DNA, 155 bp, Homo sapiens
aatagagaacccagaaaaaagccaaatgcttaaagccaactgatctttgacaaagcatacaaaaacataacctgtggaaaggacatcctgtttaataaatagtgctgggaaaacaagatagccacatgtagaagaatgaaattggatccctatct

SEQ ID NO: 175256 - DNA, 502 bp, Homo sapiens
gtcatcttagcacagcatccagagtaaactcccacagctgcctgatgtcaggtgcaataagtggggagggagtgtagggcccatcatgcccagcatgtgtaatctccccaagggctgaggagatcagcagtaccttgggcacacctagaaccggggctggctatataacctgagggtcccagtgcaaaatgaaaatatagggctcctttttcaaaaaataggaaaaaatgcctttaaaggtcctaaaatataaaggttttcctatttgtctgcaatctctcaacttgtcatggtattttttatttgctatttaatgttattctaacattactgttttccattttatttgttttctcttattatattccttatttctgtcctgaatattagcccttctgcagacagaaattaaaagaacagagtagttaaatgattgcaaagttttccccactaactccatctctataaaaaattaggtataacagttgatttcttgttttaa

SEQ ID NO: 175257 - DNA, 409 bp, Homo sapiens
gcaggaacatcttacaaagttggaacagaaggaagagagccagagggggaaggtgccacacacttttaaacaaccagatctcatgagaactctgtcacgagaatagtaccaaaaggatgatgctaaatcattcatgaaggatccaaccctatgatccaatcacctcccaccaggccccacctccaacactggggattacaattgaacatgaaactcgggtagagacacagatcccaacccttccggcagaagagggagaaggcagccattttgaaccacagcaaagcattctgttcccgtaacaaggcctttgccatcaggagaaactattttaccagagcctaatctgttgggattttatcagagactaacctacctgggagaagggaaataaactccagcccaccct

SEQ ID NO: 175258 - DNA, 515 bp, Homo sapiens
tgctttgttccttcttgtacataatcctcatcttagcagattctgagtcccactccttgtctcttggtccattccagctgatgccctatgtctcattccaagtgacactttccctaggaaaactctgaccccccccccattacttttcattgttgtaactcattctgttataattatttaaagtcctgcaccctctattagactgtagagttctcgaagactgcagcattacttttatctgtgtattgcaaacatctaccacagtacctcacatagaatcgtcatttaatggttgaatggatgaattgaatgtatttaaatgaggatagacagatggaacccaaccagccatccagactggctggagactttagtgggacaatatataaaactaaagtattagaatgagaaaaaagactttccttagcagacacaggaaaggacaaacactggtcttggtcctaggtaatgcaagggaactggcacagggatatgtctgggactactgtgtggta

SEQ ID NO: 175259 - DNA, 464 bp, Homo sapiens
gtagccaggctactctgagataatattagatagcaaaagtagtacaaacatgaaaacggatctaactcccaagtatgtagaagaatgaaggtaatggtgtcggtatgtgtgagtatgtgtgtgagtgtgcacgtgtcagtatatacatgaaaatgggaatgtatgtgtgtgtgtgtgtgtgtgtgtgtgtgtatgtatatgtagtagtattccatggtgtgtgtgtatatgtatgtatgtgtgtgtatttatatgtctcacattttctttatccactggttgattgatgagcatttgggctggttctatatttttgcaattgcaaattgtgctgctatgaacatgcatgtgcaggtatcttttttgtataatcacttcttttcctctgggtacatgcctagtagtgggattgctggatcaaatggtagatctacttttagttctttaaagaatcaccacactgt

SEQ ID NO: 175260 - DNA, 316 bp, Homo sapiens
ttgcccaaggtcacacaggtggtaatgcagagagtggatctgaagccacattatctaactcattctggagcctaaactcttaatcattaccgttgctgcctctcctggagaggtccagaacacagcttcagcagaaatccaggaaggtccgtactcacagactgaatagtatcgctgcatggaggggcagtgtccctcttaatctaatactttgaggttgaaatgagactttactaaaaacagctgaatagcctgcctcccatttcctccctttccttaaattttccattttcactcatttcttaaatacagattg

SEQ ID NO: 175261 - DNA, 358 bp, Homo sapiens
tagaatgccatggagttaatagcttctgtgatcctacatgttccaagataactgcagcagtccaaaaagccagtttcctttctggtgtttgtgggcatacactttgttctgctcctgagtaagtcacactttgtcttccaggtcctctaggatccctgcaatgttccatttgttgcctgggcattggagtaatagcagtgcttggtgctacagaaatagatggatggaagttgtggttactgtgacaccaaaaacttgtcccctgagctccctactcctctttctcctatattttttggtaattggctctgtcattcacctcactgcaggattcagaatcctggtactgggtcttgta

SEQ ID NO: 175262 - DNA, 264 bp, Homo sapiens
gtgaactcagctagagggtgcagctttctgttgtcctgggaaacacccgaacagcagagtaagtgactctacctaccctgccactggtagccagttgggtaacaactgctagagctcctggcccagcagctctgcttctgtgtggattcaactggtgggtgcagcctcctgttgtcataggaagcacccaaatggcaaggcacatgaccatacccacccttgccactgacagccaggtggataacacctgctagagcttctggc

SEQ ID NO: 175263 - DNA, 373 bp, Homo sapiens
ttgtccactccagagccaggacaagaactcacgggtcctcacctgaatcggccactgactgccttgggcagagacatcgaagtctctgagcctcagtttcctcttctgcaaaagggaactgcagggttcccagtcacttccctgggctgagcgagtgagaagtcaggcaaggaggttccttccggggaagtctccattgggtgccggctggggtcaggagcccagagtcctaggccctggtttgctcctggccatgtgttcacctcattcattcattcaacaaacattcattcaacaagcattcattcattcattcaacaagcacttaaaaacaatgcctgtgtgccaggcactggttttaagagaaacagca

SEQ ID NO: 175264 - DNA, 184 bp, Homo sapiens
tcctttttttgtaaaatagaaccagctgattccaatctctatggtctcttctagcacggagcttcacgttttttctcccttcaggatcctgaggcctctggatcgctagagattgggggtgcccccagaagaggcgctgcttctgtgccctccctcaccccaccgtgcctggctccttgttttt

SEQ ID NO: 175265 - DNA, 548 bp, Homo sapiens
attggcacaacaaagccaccatgagtttgttttttttttccattatcaaattagcaaaaattttaaaacatgatcaagcacagtccctagtatcagggaaggtctaagaaatggggcacttgtgctgctagtagtaatataaactggtagactaataggaacaagtgggtagaattttagaagtctttgaaatacatatcctgggccaggtgcggtggctcacgcctgaaatcccagcactttcggaggctgaagtgggcggatcacctgaggtcaggagtttgagaccagcctgaccaacatagtgaaacctcgtctctactaaaaaatacaaaaattagccgggcatggtggcacgtgcctgtaatcccagctattcgggaggctgaggcaggagaatcacttgaacctgggaggcggaggttgcagcaagccgagatcgcgccagtgtactctagcctggccaacagcgtgagactccgtctcaaaaaaaataaaaaaatacatatcctggctgggcgcagtggctcatgcctgtaatcccagca

SEQ ID NO: 175266 - DNA, 487 bp, Homo sapiens
cctttaatctagctgtgaatcattctgaaaatgagcccaggaaaaaagcatgatgctaggcttgtgtttggaaataacattattttctaatgtgatcactgtttgtccctgtgaaacccacgtcattttgcaaccctgggggatactttttgctgtattaaaaccaatgcatccctggcttctcagccatgtgccagcagcatgagcttaggtgtgttaaaggtgaggtgctgttcttgaacttccagcacagtcagctcccagcttccctcagtgtggtctttcctctgctgtgactggtggccctctaacctcatcccctgtgccctcgtcccctgtgtggggagacactgctggggtcggggctggtacctggggacagcagccttttccaaaccttgattttactcttgaatttcacacttccctcttagagccagaggagtgagttatttcctcttaaagatatttgccacatacaagctta

SEQ ID NO: 175267 - DNA, 290 bp, Homo sapiens
tgcaacaaaaagtaacattaaaagctaatgattaataatgtttataataatgattgataattgtccatgatcatctctgtatctaatttgtattatgactattcttattctgttttctttattatactgaaatagtttgtgccttcagtctcttgccttggcacctgggtactctttgcctacaaattaatactccattttatagatatactccattttatttattcatcaattgatgaacatttgagctgtttccagtttgggactattatgaataatgctgctgtgaa

SEQ ID NO: 175268 - DNA, 692 bp, Homo sapiens
aattaaaaagcaaaaatcaaacagcagtagtcaaaaaactaatcccctaagtagaggctccatgtgcaaagtccagattgcaggtaggacagtcggcaaggcctccctgtttcacagctctcttcccaacccgtggacaaagactacggtctgccgccaggagcggaatgccagatagaccttgggtttctcagtgacacttccaaagacacatttgcatctcaacactttttccaaaaagcaagctgaaacatgtattggtaattaaaatgagaagatggccacatagatggacatatagtaacaaaaactgaaatgtttaaaccacaaatgatagtataactcacaaaccatggcactcaccaagtcaaagaagtcaaataaagccagaccaactgaatgctagctaaaaagggcggaactcagaatcagaagaaacaggaagaagacatgcaccacaaacacagcactagaaaacagcacccagagccatacaagtcattctgctgcagacaaacaataaattgcacatcaatcctcctgaaaatcaactacagtacaaggagaaatgaaccgatttatatcaggctgtgtaagtctcattctgttggccaatagccagatccacttgggaatctcctattttaaaaatatgagtaatgtacttgtagagagcctatttagttcaccta

SEQ ID NO: 175269 - DNA, 230 bp, Homo sapiens
aagaagggtcagtcacatggatatctgggggaagagcattccgtgaagaggaaaaagcaaaggccccaaagcaacaatgccaaggttgttcaaggaacagcaagaggtgtatgtgggtggaacggagtaagagtagtggagatgaggtcagaggtcaatggaagcaggaagcaggtggtttaaagccttgttcaggccgggtgcggtggctcacacctgtaatcccagca

SEQ ID NO: 175270 - DNA, 746 bp, Homo sapiens
catagagccaacatgatcttcatccagcaaacagagagttatcactgcatgtccagaagcaaggcctgtgtggttggagagggaaggttcatggggactgtccatccttttttgaagatgaaaacacatgccctcagatagcagaagttcttcactgtaacttacagtgggaatcagcactcttgtgtttagcccaggacactggctcctgcatgggtcagaaaacaccaaaacacatgattgctctcgctgatggtttggaaggtactttaagatcttatacagccaccaattcatgagatgctgaccaggagtgttgcagagagatgggatcttataggacctgctaatataggcattctagaaggttgggcaacaagtattgccatggtgagcagcatgggctgcaccatcccaaggccaacactttctcctttccatcattcctgataggtgtgcgtggtcctgaacaagtatgtctgtgatggggtcccaacctccagctcaatcagaatatgcaagtgaatattcattcatactcttaactggcattgagtggctctgtgagaaaaagcctaattaagtgacctttagggaaaacctacagaaacaaatttgctgcatatctatacccactgacacattcaaatacattcacacgtgcatacataaacgcatgccacatgctgaaatgcttcataaacaaacagccccaaacacacacatcatatagtaagctcatgcct

SEQ ID NO: 175271 - DNA, 464 bp, Homo sapiens
gaggcgttctagaggagtcccggcgacaggagtgttgcagagagatgggatcttataggacctgctaatataggcattctagaaggttgggcaacaagtattgccatggtgagcagcatgggctgcaccatcccaaggccaacactttctcctttccatcattcctgataggtgtgcgtggtcctgaacaagtatgtctgtgatggggtcccaacctccagctcaatcagaatatgcaagtgaatattcattcatactcttaactggcattgagtggctctgtgagaaaaagcctaattaagtgacctttagggaaaacctacagaaacaaatttgctgcatatctatacccactgacacattcaaatacattcacacgtgcatacataaacgcatgccacatgctgaaatgcttcataaacaaacagccccaaacacacacatcatatagtaagctcatgcct

SEQ ID NO: 175272 - DNA, 156 bp, Homo sapiens
taatgaccatcatcatcaaattacttattaaaaccacacaaggaagcaatctaaatattctgtgatcggcttccactacaacccatacacttttcttttatactgcttatcacattttaattatttgacaactgtctcactactagatagtaagct

SEQ ID NO: 175273 - DNA, 278 bp, Homo sapiens
tttctctgtcacccaggctggagtgcagtggtgcaatcatagctcactgcagccccaaactcctggcctcaagtgatcctcccacatcagcctcccaaggagctgggactacaggcatgagccaccaaatatttcaacttcattacatcatgaaatgggtgaaggggagaagttgtatataaggtgggagtagagagccaaatctcaccaaacattcattcaatggatatgaatgaaagaataaacattcgattggggccagttcgtagagaaccttg

SEQ ID NO: 175274 - DNA, 822 bp, Homo sapiens
ataacaagccctgcccctagagagctttctatctgcaacagcttcagccacattcttaaactagtcgtgactatgtaaaagaagtgacaacactataggagatgcaagagcacctcctgtaatcagtaaaggctcttgggaggaggtgacacttaggctgggacctggatgaggaaggtgacaggcatcagatgactggtactgtaatgtactgtagtctgtttctgctcacaagtccaacttcatacacgacactcctgccccatgatgttctaatcaagcggaattaccgtctagcaatagctgactacattcccgtgcatatgttgtccctttgcttggaatgcaaacctcccctctatttctgttgtgaatgactcctccagctgaagaatgaactcactgatatgagaaagggctccccaggcactgcaaactgatctttatcacaccatataaacacttcagattttacctactccagtaagtaagcttttagggcaaggactgtgtctgccatcactaatctctgcattctggcacaaagtaaatgctcaaaagatttgctaaatggatataaaggtgcattaatagatgccagctgtacagacattggaagagtcctcccttttccatggttttgcttcccatggtttcagttatccttggtcaactatggtctgaaaatactaaaaggaaaattccagaaacaaacatatcacaagttttgaattgtgtgccattttgagttgcatgatgaaatcttgaaccttcccacttcatcccacccaggatgtgaatcatccctttgtccagcgtatc

SEQ ID NO: 175275 - DNA, 515 bp, Homo sapiens
ttctagatttagcggcaaaaaatgagcatagttcctacctgatgctttctcttttctctgagaaatagaaagtaagatcatttactacaagggaggaaacccaagggagagatggaggtctgaagagaaataactgctggagcaagctgactaaagaaaaagagtgaaactgctgggcagtgtgaagggttgaccacaggtctgtgatgcgacaaacagtgaaacagtggcatcaatctaccctgtatgaattttcagttcatgcagcactgtggtactaccgaatgggtttgatgaaaagatgaagggacaagaaataataccagttaatctctaatgagcatgttactatgggccaagccctacaagtggtttacatgaattgttccactgaagcctcatgactactctacccaatattattttcattttatagatgaggaacctgaggggtgaactaattaacttcttgaccatgtgtagagtcagaattcaaggtttgagattttgttgca

SEQ ID NO: 175276 - DNA, 406 bp, Homo sapiens
ctctagcttctcaacagtactgtgcgttctagtttctctcctcttctaaaatgtgcacttaaagctatcactgtcatcatttcagttgctcctaaactggaacctcagtcacaacttcaggtcacgacgcagagcctgagtcacagcctcagggacctctacaaagcctgagtcatagattcagttcaccatacagagcctgagtcatagcctcaggtaagctcaagctgatcatagtgggggctgtgaccccagtcacaaccttaggtcaccatagacagcctgagtcacagactcaggtcactatagacagcctgagtcacagccccagttcaccacatagagcctgagtcacagccccagttcactatacagagcctgagtcacagcctcagttcaccacaga

SEQ ID NO: 175277 - DNA, 1013 bp, Homo sapiens
attgctgcagtcgggtccttacccgaccagttctggggcatgtttgcgtcttgttcccgattacccacgcttacctccttaatatccttttagcaaagtacttctctgcttaaatcaagcattgttgatttctgtttcttgcaattaagaatcttaattgatacaccctgatacacagattctggatcagtggttttaaaattcttttcaggcaaggaagcctttcattaaatgaaatcttatgaggaagcgtaacacatgatgctggtaaaagaggtgctgctctgcattagggccctggagggaatgctagtgcataaagcatagctgtaatccattgccctggacattctgtgatcctggatcaattactgcctccctacccatgttacacaggccctggtctccgccaggcagctgctggatgaggaggggttgatgtttgctgctagttctaaatcagtgtgtatttccagggcccttcatatgctgtttgtctcctccaagacaccggccttctctgccttctgatcgctttcactgggtgaatggtgacataccctcctgtgtgcaggccctgtacaagtgtggatacctggatcaaagagattacatgcctcttagaatcctcttcaaaataccagtccatttctaagattaaaaaacttagcagtcaactaatcagtaagggctgatatttgccctgttaaaagaaagaccttagccaaattaaatttaatagagtttaattgagtgaggaacgatgcccaaattgggcagcctcccaagccagagtaggctcagagagactccagcacagtcactgcagtggaagacgatttatggacagaaggaggaaagtgacgtacagaaaacattagtgaggtacagaaagagctggattggttacaaggtttgccttatttgaccatggtttaaaccgttgatcccctttgactggcaaaaactcagtgattggcacaagactaggttacagtctattgacacctcca

SEQ ID NO: 175278 - DNA, 215 bp, Homo sapiens
gggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacaga

SEQ ID NO: 175279 - DNA, 211 bp, Homo sapiens
agaatggctcctctgtttataacacacccaacaggaatctggggtcaatgtgatgagaggcacaaagcttgtggcctccctacaaacaaatgcctacattatgaatcggcatattaaggagaaagtagtagaatcagtgtcgacacccaaagagaaaatgcacatcgattgaccctgcgtccaaccataacagcgaacacaagtcgctagg

SEQ ID NO: 175280 - DNA, 343 bp, Homo sapiens
ctttccatcctcacaagccaagtattgagaccaaaaaaagagatatcgagaaagaaccatccagaatgaatcagtgttttggggcaaggcaggcagctgctccagggtcagcctatcaatgtccccagtaactgacaagagcaggcacaaggagcaggtgcagttcagctccccaggtctcctttcttctaagccccttctcctcatctcctgtgctggcctcctctgcccctccagccttttaatcctgactctcttacacttggcttcccaccaaactcactgtggccttgactttctgcttgcactagctggctcaatccataaaggaaataagaaagca

SEQ ID NO: 175281 - DNA, 644 bp, Homo sapiens
gggagcaagaagcaggacaggtccagagaccaaggaaataggaataacagtaaccttatctcagatggtcttgtctgggcagttccactggtacagctgaagctgaacaatactcagattcattgttgctgtcattaagattcaaatatcagagaagaaatgtctgattagcctagcttggttcaagtgttcaccatctaaccagggtaagcagagtacattatgggtagtgacgggctaagagttaaaccctaaggaaatcaaataattttagggagcagcctaggatatgaatatgagctgtttgtttaacagcaagaatatccacctcaatctagaggctgctgggagtacctcatttcagtattcaccaaatatttattaaacaactactatatgctattctaggcactagggatatagcagtggccacaataaacacaactttactgctcaatgaccttatatttttaatagataatcttggttggtgaatcgctgagtggcatggagaatattctagaattgtgagagtaggaaaagattttatggtctaggcaggcaaagggagagcgctccaaaaaaagaaaaaaaattaggagacttacgggtctctgggcttctcattcctgaaagatttcaaa

SEQ ID NO: 175282 - DNA, 399 bp, Homo sapiens
ctagacgatcccgtttattgagtggcatgtgacttggtatctctcctgaaaatgagctgtcctctgtgaatttcctggtggccatgtctagctccgtcacactggctagtcagtcctttcaatccttagaatcaggtcacagtttcacttcagagatctcttccattacaaccaggctgggtagggttgaagggtagctttttgttttcgtttttgttttttttggtagagacggggcttcattattttctctaggctgatcttgaactctcgagctcaagtgatctacctgcctcagactcccaaagtgttgggattattacaggtgtgtgcccacacgctgggcctaagggtacctttttatgtctgcccagggcttggcacagtctcactggcctt

SEQ ID NO: 175283 - DNA, 579 bp, Homo sapiens
actacccattcatctgtcatatattgtttttccttctatactcagttttttgaggatttttatcatgaagggattttgaattttatcaaatgttttttccaccatcaatcaatcgaaatgatcatttggttgttgtccttcattctgttgatatgatgtattacattaattgatttgtgtatcctgaaccatccttgcatccctaggataaatcccacttggtcatgatgaatgatctttttaatttgttgttgaatttggtttgctagtatttttgttgaggatttctccactactattcatcagtgacattggcctacagttctgtgttgtgtgtgtgtgtgcgcgcgtgtgtgtgtgtttaatgcatctttgtctgattttggtatcagggtaacactggccttgtagaatgaatttggaagtatgccctcctcctctattttttggaatagtttcagtaagattggcattagttcttctttaaatgtttcgtagaattcagtagtgaagccatatccaggctttcctttgcttggagagtttttattacagctttgatctcattccttgttactg

SEQ ID NO: 175284 - DNA, 404 bp, Homo sapiens
tctatgtttatatgcacatatacacggagttaacctagatatacacaaaacgaatatacacacagatatacaaagatacatataacaataagattataggagaaacagattataggagaaaccaaaatgttaacagtgtttatctgtgaatggtaaaattatgggtaacttttctttccatttatccatgttttccttatctcttacaacatgattatattactttacattaaaaagtgtttaatttcagaaatatagttataaagttgtgtaataacatggaaatgtgcttaagctgtaaaattaaatgaaaagtaaaagcgggatataaagggtacctgcattatgatcacaactatataaaaacaaagtatgtggcaaaagctgaaagtgaatatggaaaa

SEQ ID NO: 175285 - DNA, 462 bp, Homo sapiens
taccggcgaggggtgctatgatgcctctatgttttcatctgcagggatgatttgcaattgtatggttagaatttcatttttgagagccttcctattcctcttgaagcatcttcccttttgggtttcaggtcatgcatatattttctttgaacatttaaaaatcagttcttttaaactatgaagttcaaacctgactatcatcagcctctttttccatgctttattccaagttctcaatatttctgcttcatcagcagagcatctccacccgtctggtttctgccctccctctagttgatcagaattggatccaaagttgcagtttgctcaactttctgtgagattaaactatcagcaaggaaaaagtgtattagagatcctagtttcagttgagacttacagcagatatctaggtatttgataacgccctcattatttctatctttcctcgtcattttgtga

SEQ ID NO: 175286 - DNA, 310 bp, Homo sapiens
tctctctgtcttaaggtcaactgatttgggatttgaattaacgtctgcacagtccctgcaaatagtacctacattcgtgtttgattaactaggggaaggtatgtgtatcccaggggccaggaatcttaggaggaatcttagaattctgactaccaaaacaggaaatagaaattaagccatgaaaaatggttgttatttacagcttgtatacccagaaaacccaagatgataagctaaaaaattatttgatgcagtatagataagtcagtaactggactagatacttaccatcagtaaccattcaggcaat

SEQ ID NO: 175287 - DNA, 334 bp, Homo sapiens
ccccaacacaagaaattactctaagaaaaaagcagacatttaagagaagggttacttttcataaagccatgtaagggtggcatttgaaagttactattgaaggaagttaccaattatttccatatatatctctaaacattgacgtttacagcctttgaggcaaccatcctttactataagatataaaatagacggccagacatggtggctcacacctgtaattccagcactttgggaggccaaggcaggtggatcacctgaggtcaggagttcgagaccagcctggccaacatggtgaaaccccatctctactaaaaatacaaaaattagctgg

SEQ ID NO: 175288 - DNA, 230 bp, Homo sapiens
gtgacaggcgctcctggctcctctgggagttgcaacagcacagggaatgctgagtggagcaggaggacagagggccccagcagagcaggaggacaggcagccaccgtgagaagggatgggtggggcaaggtggccctgagggagggctgttagggaacatctggctcaggatggaaagtgtcaggccctgccttcacccctgagatcacacacacaacatcaccattgca

SEQ ID NO: 175289 - DNA, 541 bp, Homo sapiens
tccacctatctgtcatccaacagacattaacatccacccatttaacaaaactatgtgttttaggttctcagatttctgagacaagacaaaaattcctccctgcaaggagctctgagtcttgaaaggatggatattcgtgaattcaccgtaaaagagcatggtaaatgctttgctctaaggatgagcaaaatgctgcaaaagcacagcataagtggaggccttggtgcccagaacaataaggcaatttgatttccaggagaagagaagctcagtccacaggtatagattctattctctggggcttcttaaaatctgccagtctatggctcagtttcctaggaagagacccctaggcttcctttatcccacttgctttggtgcatctctgcaaagcccaaccatctgagcaagttagggagaacactagcatgaaggaggtgctcttaaagaagtaagtggcaaacaggaaatttgtgcctcaaacagatctctgactaggtcatgctataaatgttgtattccaggggtgcacctggaagga

SEQ ID NO: 175290 - DNA, 516 bp, Homo sapiens
ccaggccctgctgatcagaacggctatgtgaagcaggaggcagcaaacaggccccaggctcaaataggcacttcgtagtggtctagttttgcccgactagttacccttaaccttgattaaggtacttagttttaccaaaaaaatcatcagaaatactctggctgccatggaatgtaacatgtcctcattacgagtttcacgtggggaaggccctgaagtgaggagaggcccagcctcttcgtgccacttttacctgctgtccctaggtcaacaccccggacacaaagagtcccccattcagtcgctcccttgtgagctggactctgaaggtcctctcccagaggagggcaaggccttaccgttacatctcactctccatgcaaacagaccgtgagatagtcatctgtttgcctgagagtatgtggtgtgtgagggtcttctgatatttcaggcagccctctcctactctccacgctgcctctggaggtcaggagaaaactatgtggcttccctaac

SEQ ID NO: 175291 - DNA, 135 bp, Homo sapiens
aagcaggtgacttcatctctctcttcattttatgattaaattgccaataaaaaaatcatctcataggactgttctcgagattacgcaacatactttgcaatgcagagatcagaatgccacactccacactcatgt

SEQ ID NO: 175292 - DNA, 511 bp, Homo sapiens
tgaggcaggaggatcacttgagcccaggaattcgaggttgcagtgagctatgatcaagccactgcactccaggctggatgtcaaagcaagatcccatcttttaaaaaaataacttttagaaaaatgaaataaaatacgtgaaaaatgtattataagctcactttattagatttgacaaatataaaatgctcaaagtctctacacagttattctcagtttccttacttcttcgcttgtcacagcttggtaacagaggattctggaccaatactggtccatggcctacactttgaatagcagtgcactagatgacagtttttagggttgctggagcagaactgtggacatctgtgagtctgcgataccgagcacaggaaactgaagccaggagggagtcaagaataaattaacaagtttaaatagggaacaaatactttgtaagaggcaatgatcctaaaatacatctctgcacatttgaaaatgcatcatttatggctttattttatagttt

SEQ ID NO: 175293 - DNA, 386 bp, Homo sapiens
gttacatcacagcgcatgacgtgcttcaccatcactgcacttactacaccgtattgcagtcattcttctgttgccccaattagactatgaattcccttcaaaggcaggtaaaattttatcgttatccacagtacctggcacagtgctgattacatgaggtacttagtatctatcaaatgaatgaattaatgtttttgacttctacaataccttttgagattgactcctacttccactgctactctcaaagttcaggccctttattctgtctctatcccctcacatgtccttctacctctagcttattaacccacctaatggtacccaaattatttctaaagcacagttctgatcatgtcctgcttaccgtcagaaactactattgc

SEQ ID NO: 175294 - DNA, 621 bp, Homo sapiens
ttaaatcaaaggagcagctagcccttctccctctaagacaggtgctgggagtcaaggtatggatgcctcctgaataactggggcctatgacagtgcccctcactttcttattctctgacttgctctttgttggctaaaaggccgagtgtgatgacaaaaagttcaagtgtgaacactacatttatgtttacatgtgtgtatatgtgtatttgtctttattgccatgttttggggcaaggttgtacccttgagtttccaaatctagaagaaaaggtacaacattttgttcactattaccagtttcaaaatcatttgatatatctataaaatttcttttcaggctgggtgcggtggctcacacctgtaatcccagcactttgggaggccaaggcaggcggatcacaaggtcaggagttcgagaccaacctggccaatatggtgaaaccctgtctctactaaaaagtacaaaaattagccgggcctggtggagggcacctgtaatcccagctacttgggaggctgaggcaggagaatcgcttgaacccgggaggcggaggttgtagtgagtcaagatcatgacactgcagtccagcctgggcaacagagcgagactccatctca

SEQ ID NO: 175295 - DNA, 338 bp, Homo sapiens
ctgagggacgcccctttcctggggttgcatgtgtcctttagctaagccgcctgggccacattctcgatgggtttttcttttctgcctgttagtgtctgtgaagttgatcaatggaagggccacgtccacaagatcctggtttcatcgtgacatcccagacccaccagtgcttccacatctgcccaacagtcctcctgtcggggaggtagaggaaggcggattggaaccttactagagccaatttaactcaatgttaatttagttattaaatgttaataaacgttaggacattatttttaatatcaatacatagctaaattagagaagatagtataaaa

SEQ ID NO: 175296 - DNA, 396 bp, Homo sapiens
ttgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttcccttta

SEQ ID NO: 175297 - DNA, 267 bp, Homo sapiens
gcatttacccttatagtttcagagagtcctgagctcaaatccaaagatcttgccagcacagaccttcctgtttgttggtattaaagaaaggaagtgcatggtggctcaagggcattctagtggttagttttgtgcttagcctgcttatggggtgcaggctcccaggcttggaatcacaagcaggtctcagcctcctgggaagtaaatggaagactgtcaggtattcttttaacccaacaggtttaagcagctgagttgtatttcagt

SEQ ID NO: 175298 - DNA, 134 bp, Homo sapiens
cactcggtacctgcatgcttggatcttggagggagtggtatttgtttttgtttgtttgtttgttttgagacggagtctcggagtctcgctctgtttgttttgagacggagtctcgctctgtaaccccaggctgg

SEQ ID NO: 175299 - DNA, 251 bp, Homo sapiens
atattatctcccaccagtcagaataactattattaaaaagtcaaaaacaatggatgctggcaaaggtgtggagaaaaagaaatgcttatctttgtatttttaaaaccatgatttccttcctctaatcttaatattttaagtgaagagttcacatttctgtcaaaatccatcatatgtcgaactttgcaataaaatttctacttctccaccactacccttaataatcaaatcaaaaataaggctaaacttgt

SEQ ID NO: 175300 - DNA, 348 bp, Homo sapiens
ccttccacccacattagaatgtaagctccgggaaagcaaaaaattttatcttcttagttcaattctaaggttgaatcctaaggaactggcccacaaaataacaatttcgtatgggtcaacctaccacacccccagcacctaagagcaacccttggcacacggtagcactcaggcagttagtgagtaatcaacttatctatatatggaatactacaaatactatatgatacagcctttatacactttactagcctgggtaagaaatttaccatcagctggtcagatttgtgatatcatctctgtaggtcttcctaatcctatgcggagccaaatatagacggatatgca

SEQ ID NO: 175301 - DNA, 408 bp, Homo sapiens
ggcatgggatgaaaagggcagaaagccagtccctgggctcagtggctcaacatgcctgagactcacaccatggggcaagccactcgatcgatcgcccaaggaaagcttctgcacagacttggacctgaaaccccacttgcccagccactagcttccttcttgcattagcaacacggaagaggcccctctactctcggcaggactaggaaaatgaaacaagtcaacctacttgaagcatgcagcacatatcccatagacctaacaattggtactagatcctactgttgaaaaaaatctgccttcccaggctgcaatgagggccaggcgtgagtgatgtgtgtgcaaagggcatcctctcctccatcacccatgtctcttcaccgagccagagtcaagctccacagggcc

SEQ ID NO: 175302 - DNA, 451 bp, Homo sapiens
ttttccctgctccagtctggaaaacttcctgtagctggccccagagctttatagaatggctggctgggatggcacagtcttgaggctatgaagaataaacttcttaatgtgtcagcagctccggaggctccattaacactagttctaacagctggtggatacttgctggttctagctggcaggtggaagtctgaggaggctgctggttattgctggctcttcctgaccaggtccagatgcttttcttgtatttttagggacttctaggcccctgactccatacaaggaatgtggaactgaggcatatttccccgagtgaaagagcatgatgttttcattttatgtgatggaatagagtcatggaacctggtcagacatcaagccacctgtatcaccatggggattgtgcttcagaaggaaagtggaggatagggtaggtgggtttcacctg

SEQ ID NO: 175303 - DNA, 169 bp, Homo sapiens
atgtcattttctgtcacactcaagtcacaaaatatttaaccacttatttttttatctctggaggaataatccaaaagattgtactggtaaagccagaacaatttccaattatgctaattatttgtataatacttagttggctttatctgtggtttgttggcttattttc

SEQ ID NO: 175304 - DNA, 122 bp, Homo sapiens
aatacataatgctggtttcacagaaacctaacactctaggaagtgggagtcaccctgcctgacggtggcagagccgagagcaggcctgggtctgtcgcctccaggtcccagttaccatctta

SEQ ID NO: 175305 - DNA, 393 bp, Homo sapiens
agaatctgcagagcaagaatatgtgcaggagttaggcgtatataaggttgagaaaatgagacacttcaagaccaaatgagcgttgtgaattctaaaccgatggagagttgtcatttcagaactcttgcttgaggctttttgctcaaattgctgctccatttttgcctcctggttgtgtatctctctcaccttggtgaggtacctggcatgtggtaaccagtatcttaacatcttaagatgattctgaagatgagatcgtttcaaaaagctagagtcagcagggtgcagtggctcaagcctgtaatcccagtactttgggaggccgaggcaagagaatcgcttgagcccaggagtttgagaccagcctgagcaacatagggagacctcatctct

SEQ ID NO: 175306 - DNA, 431 bp, Homo sapiens
agggactgcgggttgacgggggggaggttgtgcagtggggtgtagcagtttaaagcgctgtggcgcgttcttccgggaggaggtggtgcaggcagcgtgagagcttgtgaagcagaggctttgagaccctagcaggacaattgggagtcccaggattcaaggtggaagatgcgtttctggtcccttgggagaggactgtgaaccgagagtgggagaaaaattggacaacaggagcatcataggagggggtgcctgccctgaaggcacattcctcagagcagccccactgcctgggccaaaggtttggacctgctgccaccagccacagcacatgctagagtccacagccccactagacacccagaatgccactggcagccactgagctggccaacctgcctgtcaaaactcactgccagctcttgtccttc

SEQ ID NO: 175307 - DNA, 365 bp, Homo sapiens
aggtgactaagccttgtgggtcctagccctgtaaatatataaaatgtaatgaacagataacatagggctcacaataaatgctgagtaagaagaaatatcaggaattcctgaacctagttttatccaaagggaatcttttcatgtctctccaaatacattattttggagttaaatataaaaaagtttgtagctcacacatataatgagccaacactttgggaggccaaggcaggactgcttgaggccaggagttcgaaaccagcctcggcaacatagtgagatgctgtctctacaaaaaaaattttttttttaattagctgggcatgattgcatatgcctgtagtcccagctacttggaaggttgc

SEQ ID NO: 175308 - DNA, 138 bp, Homo sapiens
gaatgagatgtccaagtgtttgaaacaatgctctgaacacacttcatacttctgaggaagagctttgaacaaaggagtaaacaagtagaatgctgagaaaaatagggagacgacagtggcacatgacacctagttttt

SEQ ID NO: 175309 - DNA, 624 bp, Homo sapiens
gactctccaaaaggactgatggttgctctgaaatagccagagagctgggacacaggacgagcaaagcttctcttggggtctcattggacctgggccatctcccccaacatagtcccacagcctggccccagggtggtaccctgatgatttttcagagttgtgtggtgttggtagttggcaggggcagctcttagcgctggaggtgggaggctgggaatgaatgacttgagccaagatcggctcctccccactcctcatggtggagatcccagtgtgagggacctgcagctgaagtctatccatacaggcagagagactgagaggtgattctcagatgagtgtgggctggtcacttgcaggtcttcctaaagcccgtgctggcgtttctgattcagcagatctgtggggggcaggggcttcttcactcttaatcagttcccagctgatgttgatgccgctggttcagatgccatactctgagaacccatgcgctcaggtcacagggcacctggctgcttgtgagtttcctgtggtctctgggctggcacagctagttgtagccgatatcctatcagttaattttaacttggagtcttttagagaacagagtcctgttctgacggt

SEQ ID NO: 175310 - DNA, 194 bp, Homo sapiens
ggaccgcatgcacttttcttcatgcgtgcgcgcatctctcttcacgggcgcctgcgctcagccaccgtgcccaacctcacttgctttcttatccttacactcccccagtcccagagaaactgccacatacaccacaaaaaccaaacatcccccaatgaccttagccctggataactgaagaaaagagtgcttgg

SEQ ID NO: 175311 - DNA, 380 bp, Homo sapiens
gggagcaggagtggaggctggacatttcaggctagagccatgtgaatttcacggattttgcagaatacaactatgactattacaatatctgatggagaggcaggtgagtgacagactccagagaatctaagtctcagcaagggcaaagagagaattcgtaaacttccaggtagaaaggggaagagaggaggctgggggactttgggatacaggaagaaaccatcactgtaatgatgctgtattacgccactaatgctcatacttctacagaataacattttgcaatccctccttgtctggctgcatttgatataaatgactcttacacccccaaaataatcctttcttttacatagctccgtatggtcctgcagagtcct

SEQ ID NO: 175312 - DNA, 1349 bp, Homo sapiens
tttcctcaggaagagtcgctcccttttgcaaacgccagccacagaggtttatttttctccctgagagaaggaagagtgaaggctgagactgagacagaaggacagaaggagaagacttagaagccagtgagcccggaaccacgagacgcgctctgaggacacggggcctcggggaaaccgggcacgggcaggggttggtcttggcttccccacaacattgccgcgagctcgggtgccatctccactcgcaggctggcctgtcctctgcagccacgagctcaggcaccgtctccattcataggccagcctgttctctgcagcctgaggtccctgtggtgccaacatccagatgctgagataattctgccagggtgttggctgatcggtggttggtggttggctgttccgtgagttctgcattgatcttgctggctgagcgtccaatgcggaggggcaggtgctgttagggtctccactcccatccctctccccaggactcatcacccactgcaaccgtaagctgctaggggctcacagccgtgagtctttgggacgggtggtcccacctggcatgtagctcaggctcctagccccaggaccctgccgctgctcccctcccgcccacatcttggcttagccgtcttccctggctgccagccccttcccctggtcttagttggcttgagccactaaactgaaatagcacaccctgaggccttcaacagcagacctgatttctcaccatctggaggctggaggtccaggatccaggcccccaaggctgctttctcccccactcccccacccaccttccaggacacgcagactccaccctcttgctgccctgtctcagggctgtccctctgggcaagcaggcccctggcatccccgtgtgtcctctcctcctgttcttataaggacaccagtcatactggatctgggcccaccctagtgacctcatttaccttaatcacctctgaaagaccttgtctcaaaaacagccacattctggggcactgagggttagggctttaacatgggaatttgagggatgcaattcaccccataaaacccagaccattcccccagtaaatcactttcacaagagctcttctctcaggctttgcttctgggggatcccccttgagatggatccatctagcttcctgcttctcaaagaacagaggggagagctctggtgcgaagggaacgggtggcctcggggacctgcggataagctgctggcactgccaggggacaggctgagctgaaagccaggaggagggcggcgaggcccggggccggacctcattcttctgagtgttataaaatctggctttgctcagaaa

SEQ ID NO: 175313 - DNA, 2336 bp, Homo sapiens
  misc_feature (1710)..(1710): n is a, c, g, or t
tttcctcaggaagagtcgctcccttttgcaaacgccagccacagaggtttatttttctccctgagagaaggaagagtgaaggctgagactgagacagaaggacagaaggagaagacttagaagccagtgagcccggaaccacgagacgcgctctgaggacacggggcctcggggaaaccgggcacgggcaggggttggtcttggcttccccacaacattgccgcgagctcgggtgccatctccactcgcaggctggcctgtcctctgcagccacgagctcaggcaccgtctccattcataggccagcctgttctctgcagcctgaggtccctgtggtgccaacatccagatgctgagataattctgccagggtgttggctgatcggtggttggtggttggctgttccgtgagttctgcattgatcttgctggctgagcgtccaatgcggaggggcaggtgctgttagggtctccactcccatccctctccccaggactcatcacccactgcaaccgtaagctgctaggggctcacagccgtgagtctttgggacgggtggtcccacctggcatgtagctcaggctcctagccccaggaccctgccgctgctcccctcccgcccacatcttggcttagccgtcttccctggctgccagccccttcccctggtcttagttggcttgagccactaaactgaaatagcacaccctgaggccttcaacagcagacctgatttctcaccatctggaggctggaggtccaggatccaggcccccaaggctgctttctcccccactcccccacccaccttccaggacacgcagactccaccctcttgctgccctgtctcagggctgtccctctgggcaagcaggcccctggcatccccgtgtgtcctctcctcctgttcttataaggacaccagtcatactggatctgggcccaccctagtgacctcatttaccttaatcacctctgaaagaccttgtctcaaaaacagccacattctggggcactgagggttagggctttaacatgggaatttgagggatgcaattcaccccataaaacccagaccattcccccagtaaatcactttcacaagagctcttctctcaggctttgcttctgggggatcccccttgagatggatccatctagcttcctgcttctcaaagaacagaggggagagctctggtgcgaagggaacgggtggcctcggggacctgcggataagctgctggcactgccaggggacaggctgagctgaaagccaggaggagggcggcgaggcccggggccggacctcattcttctgagtgttataaaatctggctttgctcagaaaaaaaaaaaaaaaaaaaaaaaaaaaaaaaaaaaaaaaaaaaaaaaaaggggggggggcaaaaaatccccgggggaggggcgcaagcgatggagaggatagaccagggtttttttggacaaaaggggcgccccatatagggggtgcgcggaatataatataaggccaaggagccgggagcggcggagggtaaacaccacacgtgctgtgcggggggggagacaagtcggtgtagttgggcgacactttggggtgagaagaagaccccacatttggtgggcggggagcgacacaattgggaagcaacaacaatccactacagaagacatttttaaccgccccgagagaggaaacacaatcaacnttaaggagtgttaacagggggggtaaacacaagagaggattatagagaggcgggcgggtggagaaaagaatatggggatcgcgggaggggttatttgcatgttgggagaaacatttttactacgcagggggttttgtgtgtgaaataaacaaggttgtgattagaagcaaggtaacagaacgtagtataaagagaataatgacgtagtctgagggatatgaaagtagaacagtcagataagcgatatagtagaaaaaaagtgtaggtatgaaggagataaagtcaaactaaataactcagtaggaaacagaacaagcacataaaggatagacaggtacataagaaaataaggttgaggaagaaaaatagaatcaagagaaaaaagaaaaaagtaaatacagtataatcaataaagaagtttaaaataagagagagaggggtaaaagacacagatgtatgagagcaataggatcataagataagataaagagaatgagagagaagaagagatagagaaagagagataaagagaatactgagagacgtgagaatgaaaaggaagtgaagaaaagacataaaagaaacggaaaaagaaaaaagagagagaattataaagttggtattgt

SEQ ID NO: 175314 - DNA, 1355 bp, Homo sapiens
  misc_feature (1305)..(1305): n is a, c, g, or t
  misc_feature (1307)..(1308): n is a, c, g, or t
  misc_feature (1331)..(1331): n is a, c, g, or t
tttcctcaggaagagtcgctcccttttgcaaacgccagccacagaggtttatttttctccctgagagaaggaagagtgaaggctgagactgagacagaaggacagaaggagaagacttagaagccagtgagcccggaaccacgagacgcgctctgaggacacggggcctcggggaaaccgggcacgggcaggggttggtcttggcttccccacaacattgccgcgagctcgggtgccatctccactcgcaggctggcctgtcctctgcagccacgagctcaggcaccgtctccattcataggccagcctgttctctgcagcctgaggtccctgtggtgccaacatccagatgctgagataattctgccagggtgttggctgatcggtggttggtggttggctgttccgtgagttctgcattgatcttgctggctgagcgtccaatgcggaggggcaggtgctgttagggtctccactcccatccctctccccaggactcatcacccactgcaaccgtaagctgctaggggctcacagccgtgagtctttgggacgggtggtcccacctggcatgtagctcaggctcctagccccaggaccctgccgctgctcccctcccgcccacatcttggcttagccgtcttccctggctgccagccccttcccctggtcttagttggcttgagccactaaactgaaatagcacaccctgaggccttcaacagcagacctgatttctcaccatctggaggctggaggtccaggatccaggcccccaaggctgctttctcccccactcccccacccaccttccaggacacgcagactccaccctcttgctgccctgtctcagggctgtccctctgggcaagcaggcccctggcatccccgtgtgtcctctcctcctgttcttataaggacaccagtcatactggatctgggcccaccctagtgacctcatttaccttaatcacctctgaaagaccttgtctcaaaaacagccacattctggggcactgagggttagggctttaacatgggaatttgagggatgcaattcaccccataaaacccagaccattcccccagtaaatcactttcacaagagctcttctctcaggctttgcttctgggggatcccccttgagatggatccatctagcttcctgcttctcaaagaacagaggggagagctctggtgcgaagggaacgggtggcctcggggacctgcggataagctgctggcactgccaggggacaggctgagctgaaagccaggaggagggcggcgaggccccgtgggcncnnggattacaacaccttcggtgctngagtagtttattaattctgcaccc

SEQ ID NO: 175315 - DNA, 928 bp, Homo sapiens
agtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaactcgcaaaacaccctttgtgaagcctccagagatgaacaggccttcttgggaaaggacaaaaaaattcctggaaaaagaagtccaagaagcaacaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgacgttgagcagttggattccaagagcacttcccctttgccttcatcagatagcagaatcctatttccaggacgaggactatgacgaaagcactgacattcactcaggctacgaac

SEQ ID NO: 175316 - DNA, 312 bp, Homo sapiens
acggggacgggcatgagcatctgaccagcagtgacagtgcgatgggaaagccccaagtgtctgagcaggacagtctcaataataatgaaagctgcacattgagctgcgaggtggctgcaggtgagaactcgcaaaacaccctttgtgaagcctccagagatgaacaggccttcttgggaaaggacaaaaaaattcctggaaaaagaagtccaagaagcaacaaaagggactgctaagaagataccaccaggtattgtttaaaatagtatttatcctcttctttaattaattaaaaatgaacctccttccctc

SEQ ID NO: 175317 - DNA, 828 bp, Homo sapiens
aagcaggctggtccgccccgggttatgggctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaactcgcaaaacaccctttgtgaagcctccagagatgaacaggccttcttgggaaaggacaaaaaaattcctggaaaaagaagtccaagaagcaacaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgacgttgagcagttggattccaagagcacttcccctttgccttcatcagatagcagaatcctatttccaggacgaggactatgacgaaagcactgacattcactcaggctacgaac

SEQ ID NO: 175318 - DNA, 411 bp, Homo sapiens
aattcaattgagctgctctgcaataaggatgaaaggataaaattagaaccaattaaagttacttgatgaaacatctcataagcaccatggaaaattccatgttaagtgatggggtgacctgacatgtgaagtcttgctgtctcatccccagtgcagagaaaaaaaatgggctggagctctgaggcctgcgaggtcggtggccagctttgagggtagggacacagtaggaccctacgagaaaggagaggtcagcaaaagtggatgggggagtctcttttgggtatctcctcctgtgctttgatatttttcccagaggttgctggggcttatctttggggtgcatcaccaaaaatatccttcctagaagatagagtgatggataagacacccgagagtcagaagggggttctc

SEQ ID NO: 175319 - DNA, 116 bp, Homo sapiens
gaatcagaggcgttgagcttggaaggtaggttggagtcagattacacagagccttgaatgccaaggtaataaacagcatagattcggttctccatgagagtcactgatagttttgg

SEQ ID NO: 175320 - DNA, 560 bp, Homo sapiens
ttagtaccacccgttccacaaattaggtaactaaggcttgaagagacaatgcaatgcatattgggcttgtgacctggcttctgggcatcggtttcaggtactaaatctaatgaagggagacttgacagaccacaggaagaagcacagagtaaaagggcagaagcacggacataacaagagctttcttgggaactaaacctccaatgacatagagaaatacttcaaaatgttgctttcttttgctggcagtaaaattgagagctctcattagcttaaatgaaaaatgtgactaccaaacacatctttaacaggaaaacagttttcttgattgctgaatttcctccctaacagagttgaaatagaaaaatgaatgtgtttgaacttaatggtgtcagttgtttcctaagaaagggactgatgctacagcaagacaaacagccctaaattacttctgacccaataaatacgcgcttcttgactcttcacgtgttgctcatgacataatactattctagttcttccacttctctgattgtcctcacttgttgcctcttcctctt

SEQ ID NO: 175321 - DNA, 466 bp, Homo sapiens
ggcttctgcttctgccctcaccaagacctccctcaccaacctgtctcttaaaaaacaggcaaattattgattatagttcagtgggctaaatcctgtggtagaaacattcatgcatagggtggtgcatccacatcagtcttaggtgggaggagggtcatggaaggcagatttttggttgcacttgaactgaactttgaaggatgattaggagtaagctgggtgggggaagggaagaacctaccaggcagaaggactggcataagtaaaggctagtttgtaagaagtataaagcgttgaggtaaaatgcagttcagtatttattttttaaaattaattccactcaacgctttatacttcctcccaggttggcaggggactgggctgaaccggtagacactgggaggaagtaaaaggaggggctgagccaaccccacgagacctggtttggcctggctggctagccagg

SEQ ID NO: 175322 - DNA, 520 bp, Homo sapiens
ctcaggtgggaggattgcttgagctcaggtgtctgagactacagtgagctaggctctcctcactgcactccagcctggaagatagagcaagaccctgtctcttaaaaaacaggcaaattattgattatagttcagtgggctaaatcctgtggtagaaacattcatgcatagggtggtgcatccacatcagtcttaggtgggaggagggtcatggaaggcagatttttggttgcacttgaactgaactttgaaggatgattaggagtaagctgggtgggggaagggaagaacctaccaggcagaaggactggcataagtaaaggctagtttgtaagaagtataaagcgttgaggtaaaatgcagttcagtatttattttttaaaattaattccactcaacgctttatacttcctcccaggttggcaggggactgggctgaaccggtagacactgggaggaagtaaaaggaggggctgagccaaccccacgagacctggtttggcctggctggctagccagg

SEQ ID NO: 175323 - DNA, 247 bp, Homo sapiens
ttatccatgattgcatcatcaaactgaagcctgagacagaacattctgtgaggtggccttgttcactgcagaggagctgactcacacagttttgtctgggaagttgcaacctgtgccaggagtagccagcctgggagtaacaaagaggcttttctactgcaggttttcctagagctcctctccctccctcccctggccaaaggtgagctctgcagggagggtccggctctaggggactttgctcctg

SEQ ID NO: 175324 - DNA, 393 bp, Homo sapiens
ggatctttcccaactcataaatgtccagaagaaaacagaatatattttcctgattagttatactcattcttttctatatttgcatcttcccccagttaagaatgaaaagcaagacagggcaaacgtttacctagtttaccttggtgcttcctacagcagaattaagataaaacatgccataaaactgatggaatcataaggaaatggaaatcataatgaaatgaacgttgactttgaaaccctgggagagcattacaatgaaaagattgtttaatgaggcatttagaggcgaggaaaatgaccaccttcctttcccctgtccccctccccaccaagggccctgctccagtaactggttgctcagctgcctctaaggatgggtgttgggcttcg

SEQ ID NO: 175325 - DNA, 448 bp, Homo sapiens
agtcactgcatattgtctaaagtaaagaagtaagtagaagaatacacatattgtctagccttgatactcaaatgtgtcgtctgcagaccagaaggattgacatcacttgttagaaaagccaaatcttggcaaaaccactgaaatggaatctgcattttaacaagatccatacatattttataaacacattaaagtttgaataccacgtttctgtaatagtgattctcagtctttgctgtgcattattagagtcatatggacagcttaaaacattattttaagaagagcaaagcccagtccttaccttaagaaattatgctttaaatgggatggagcccagaaatcagcctttttttttttttttatggtttctgaggtgattctaatatgcagtcatggttaagaacctgtgatctagaataatagtggtaagtgaccaatagaatga

SEQ ID NO: 175326 - DNA, 155 bp, Homo sapiens
gtttttcctaattagttttaatattttgactggaataggttaacattttatctgagaacttatggaagtaaaagattcttatatcctttctcattaattttaatggtttctgttctttgtttttcactaatgaacaggatctctgtcgaagtttg

SEQ ID NO: 175327 - DNA, 391 bp, Homo sapiens
actcagatgaggcgccaagaagaacttctgatgggagcaagatggacttcatcccatctgccatattatacaagtaagtgcaacgcgaatacaagaaagctgggatcattgagggctctcctacagtctacctaccactctctatattctggctctcaatgattcatgttgctctctcatgcaatatatcctcatccccttctgaggaccccaaaacaatacaacccaaagcagtccacagattcaaggcaatccctttcaaaataccaatggcattcttcacagaaatagaatattatcctaaaatttatatggaaccataaaagacccagagtagccaaagctgtcctgatgggagcaagacgcatcttgctcccatcagctgggtaag

SEQ ID NO: 175328 - DNA, 1051 bp, Homo sapiens
  misc_feature (39)..(39): n is a, c, g, or t
gccgtcccaacaactcatccaataccaggcacactcatncaccaggcatcaatctcaactccatccaacaccaggagtgacacactgccactcagggccgccaaaacaagcacgaagcaaagacgggacgaaaaagtagagcggctagtagctcccctaaagagagtttggaccttggtatggaaaccctaaaaggaaagccagaattggtatgtaacctgcggccccactacacagtgccagccccacactccctcccagagagccggcacacacctcacagtgggaactctgccagggctgtttcctgtggatgtcagagggaagataggttcttggtgctgccaggatattcctgcaagccctaattacctgccggacagtgttgctggagggtgttggaggcttgccacgagcacacgacctgtctgaagctgctgtggggacaggcagggccaggactcggggccctgaatgcatgcctgggggacgagtgtgcctggtgttggatgaagttgagattggatgcctggtggatgagcgtgcctggtgttggataagttgagattgggtgagcatgccttgtgttggatgagttgagattggatgagcgtgcttggtgttggatgaagttgagattggatgcctggtggatcagtgtgtctggtgttggatggagttgagattggatgcctggtggatgagtgtgcctggtattggatgaagttgagattggatgcctggtggatgagtatgtctggtgttggatgaagttgagattggatgcctggtcaatgagtgtgcctggcgttggatgagttgagattggatgcctggtggatgagcgtgtctggtgttggatgagttgagattggatgcctggtggatgagtgtgtctggtgttggatgaagttgagattggtttggatgaagttgagattggatgcctggtggacgagtgtgtctggtgttggatgaagttgagattggtgttggatgaagttgagattggatgcctggtggatgaccgtgcctggtgttggataaagtt

SEQ ID NO: 175329 - DNA, 267 bp, Homo sapiens
ctttagctcggtaccctttctctctgaagtggagtgaaggaaggagaaccagaagctaaagcgtgtctggtgttggatgagttgagattggatgcctggtggatgagtgtgtctggtgttggatgaagttgagattggtttggatgaagttgagattggatgcctggtggacgagtgtgtctggtgttggatgaagttgagattggtgttggatgaagttgagattggatgcctggtggatgaccgtgcctggtgttggataaagtt

SEQ ID NO: 175330 - DNA, 311 bp, Homo sapiens
tatgtctggtgttggatgaagttgagattggatgcctggtcaatgagtgtgcctggcgttggatgagttgagattggatgcctggtggatgagcgtgtctggtgttggatgagttgagattggatgcctggtggatgagtgtgtctggtgttggatgaagttgagattggtttggatgaagttgagattggatgcctggtggacgagtgtgtctggtgttggatgaagttgaggttggatgcctggtggatgagtgtgtctggtgttggatgaagttgagattggtgttggatgaagttgagattggatgc

SEQ ID NO: 175331 - DNA, 416 bp, Homo sapiens
  misc_feature (39)..(39): n is a, c, g, or t
  misc_feature (347)..(347): n is a, c, g, or t
gccgtcccaacaactcatccaataccaggcacactcatncaccaggcatcaatctcaactccatccaacaccaggagtgacacactgccactcagggccgccaaaacaagcacgaagcaaagacgggacgaaaaagtagagcggctagtagctcccctaaagagagtttggagtccagacggtctgctcagtatggacaggtcacagtggacgaagttgttgtgcacacgccgaagtccagaccgactggtttcccttcctttttaccaatctctaataagtcaaccagggtatcagggtagggtgtgtggtgtttgtgtgtggtttgtgtattgtgtatatggttngtgtgcatgtaatgtttgtggcatgtggtataaatggcatgtggggtgtgtgggcgttcggcgtgtgca

SEQ ID NO: 175332 - DNA, 197 bp, Homo sapiens
ataagggaggctgtgcatgtgtggggacagggagtaaatgagaactctctgtaccctctgctcagttttactgtgaacctaaaattgcactaaacaaataaagtatatttaagaaaacggtcacggccacttgaattgcagtaataaacatacagagacttggttaacgggtcacagagtattgaatctgacaaaca

SEQ ID NO: 175333 - DNA, 345 bp, Homo sapiens
ccaagggtaagtgctaacttgtctgatcaactggcataattccatatctcattctaaagtgattcattcagggataggcagagataagtcaatcagtgtatggcatttccctggtcgtagggattggttcaggaatgagcataacctattgggccaataagatatgtggtttgctagcaacttccaggaaagaagaaagttcttactcttttaagagagcttacaaaagcaattctcttagtgcctcgacccagaaaaggaggttgttggtagcatgctgtgaatacaaaggtaagccaggcttgggttgaagctgacataccaaaagacttatgggaaagatga

SEQ ID NO: 175334 - DNA, 739 bp, Homo sapiens
atcaggatttccctctgcgttttccagcagttgccattaccccaaacgtgtcctagtgttcttcaagtcaatacaactgtagtctccacatgatgcagagtgaggagttcctcaggctatgaactataaaaataggaaactcacccagtgctatttcttctaagtattcactcctctgtaggatcaacctgcttttggttgttttctattactttcagttagttaatttttaaatattttgtccagagtttgtaatttcatatgttggcaggttggtctgaaagaacttcttgaccatcacttgaagtggaaccctctccaattgggtagtattctttttctacttcctatgattactgagtagggatttgttcctgattatttttaaaactaggtgagtagaaatttttaacatgttctatctatgaaaaaccttaattataaacatttagtaaatgtttaccaaattagcaattcagtgtttcctagttggtgtcctactaggaaggaaaaagaaaatgaaaagaagaagagaggaaagaacaaaaatgcttaacaacttttagaattccctccaaatttgtcatcaatagggtttttactgaatacattcttttaaaattagcactctctaatcttgatgaatttgtattttcataaaaatctgtattttcatatttccattcatttgcactgtgtttctcttcgggaaagctgttaacctttcttcatatttacc

SEQ ID NO: 175335 - DNA, 107 bp, Homo sapiens
tcccctgcagccgcggatgggggagcccgggggcggagcggggcgcggggggcggagcgggggaggcgcgaacccggggacccccgcgctggacaaacccgcggccg

SEQ ID NO: 175336 - DNA, 211 bp, Homo sapiens
atgagtgctgacaggtctggcactttcctttctattacccctggggctctatgagtagagggggcaaaagagaggaattcagttggatctttttgctccaggacttctcagataggcaaccagaattagaagaaagacactactggcataatcaacaagaaagaaaaccctggtctagaactaatgggatttttaattttatttttgcatg

SEQ ID NO: 175337 - DNA, 194 bp, Homo sapiens
catttaagtagataaactaggtgtggagttcacaaactggcttcttcagctatctctcactaactcccaggcagcatcttttctaaaactcctttctttagtttaaaaatcaaattaaattaaaatgcccttatatgttcactggttagaatattttagtcttttcacagaaagagatgagtatgaaaccactt

SEQ ID NO: 175338 - DNA, 373 bp, Homo sapiens
ttctagaggaagagaattactaagaggggatgagcaatctcaagtcctttctctagcacctctacattagctcttacttctgttcatttcccaccactatgttacatatgttacagcctgctataggaagagctgcaaaacttgtttagcaatggaagatcaagtaggtcaggttggtggtgcaccttattttcccatatcacaggacaaagataacaggttttttttttcccccacagcactgctttacttaggtctcttttccttgccccaagatttatcctaaattaggaaaggatatctatgaccttgatttcagacttaccatattattttatctgtcatatattagtcccactgagggaaagagggc

SEQ ID NO: 175339 - DNA, 372 bp, Homo sapiens
tgaaatcctgccaacatttcaacaacatggatggacctggaagacattatgctaagtgaaataagccagacacagaaagaaaaataatgcatgatcctcagctctatgggtaatctaaaaaggatgaactcatagaaacagagagtacaaagctggttgacccagtctcgaagtggggaaaatgggaagatgttcaatgagtatatacttccagtcctgaaatgaattaagttttggggatctaatgcatagcatcatggctatagttaatcataatgctctatatcaggggtatccaatcttttggcttccctgggccacagtggaagaattgtcttgggccacgcataaaatacactaacactaatggta

SEQ ID NO: 175340 - DNA, 350 bp, Homo sapiens
atatatatatatcactatatatttattacatattgcattatgtataatatataatacatattatatataatatgatgtattttatagaattgttatttttatgaaaaatcccattgaaatttgataggaattgcattgattctgtagatcactttgggtagtatggacattttaatattattaattcttccaatccatgaacatgggatattattttattctttttgtgtccacaataaaccagaatttctttatttatctatagacacctaggttttttctgtatattggctgttgtaaataatgctacaagaaacataaaagtgttaatatctcttctatgtactgat

SEQ ID NO: 175341 - DNA, 377 bp, Homo sapiens
caccccccccactaccattacaataacaattagatttcaacatgagtttttggaagagacaaacattcaaatcatagcaaactgcaagcacaagagtatggatgaatttcatagacaatattgagtgaaagaaaccaaacaacaaaaggataatattgtatgattctttttaataaaattcaatataagcaaaacacatcatgatattagaagttaattaagatagtggtatctttggtaggggaacaggaagtgactggaagcaggaacatagaggagcttctaggatgctactaatgttctgtttttgatctggattctaattatatgtgtttctttgtgaaaagtaattaagatagtgtatctttgtatgcttc

SEQ ID NO: 175342 - DNA, 333 bp, Homo sapiens
caggagttcaagaccagcctggccaatacggtgaaaccccatctctactaaaaatacaaaaattagctaggcatggtggcgcacgcctataatcccagctactcgggaggctgaggcaggagaattgcttgagcccggggtggggggtggaagttgcagtgaacagagatcgcatcactgcactccagcctgggcaacaagagtgagactcagtctcaaacaaaaaaaatgaataaaataaataaatatgtattttctcctctgtagcacagaaacatttactatcaacatcttagcattttggggagcgggaaatgagataatgtctgacaa

SEQ ID NO: 175343 - DNA, 427 bp, Homo sapiens
agcctcatttaacagcaactacctcactcctagatttctgcaataacctcctaggattactcctcaaaagagcagccaaggtagtaatctttttttaaaaactttttattttgagataattatagattcacaggaagttgcaaagacagtgcagagaggtcccgtgtacccttcgcccagtttccgccaatggttaaatcttatataattatagaacgatatcaaaacccagaatttgacatgggtacaatgcgtatgtatagttctatgtcactttatcacatgtgtagatttgtggaacaacaactgcaattactacaatagcaattacaactattcggactcagtcattactgagtactctcacatatatgcctgcatgtgtaaacggatcttgcctttcccctgttcaattttttgtatcaaa

SEQ ID NO: 175344 - DNA, 279 bp, Homo sapiens
ctgcagctaaaccatagcctgacaaatatggacaggaccaggaataaagtgcagaatgactttccacttcaggacatgtctccgggaggtagggaaaaaaggaggaaaaagaagcagctacttagtgtcaggcagagaagtagatgaagggcacagccagaaacaaactgaaatccatctgaccacaaaaaacactctctcttctcaccatgctgcctgacttgacccgcacagactcactgcttccacccatggaggagcctggccttcatttgtgta

SEQ ID NO: 175345 - DNA, 397 bp, Homo sapiens
  misc_feature (1)..(1): n is a, c, g, or t
  misc_feature (387)..(387): n is a, c, g, or t
ncttatgttctgacccaccctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgggtcagaacataaggtggatcntctagagcga

SEQ ID NO: 175346 - DNA, 549 bp, Homo sapiens
tcaataagtggctagctgctgcttttattattatattgtttgagaaaaacaggtgatgaacaaaggtacctttgatagcacctgtatacaatgcactggctggagaggagtgagactgacaacaagactggcagatgttgctgggcgacaggcccatgaggggttattaggagtttctcttctctttggatctgtctgtggaaatggtcaaagaccatggacaaatactgagaaaaaacagcccaggtagaatgcgaaacttcttaggagaacctcaggttatattgtgattgcatccgttacctgctgttcttggtggaatagaactgaatggtggctatgctgaccatgtgatctttccctcctaggttctcctcagtgaactggcagtaccagtgtgggcttacctgtgagcacaaggccgaccttctccctatcagtgcatccgtccagtttattaaaattcctgcacagtctcagccccatggggtatatccaccctcaagtgtgcagcagggaatacagcagacagcccctcctcgctcgata

SEQ ID NO: 175347 - DNA, 2431 bp, Homo sapiens
cgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatt

SEQ ID NO: 175348 - DNA, 1913 bp, Homo sapiens
cgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcgcgaacgtgttatccccccccc

SEQ ID NO: 175349 - DNA, 1422 bp, Homo sapiens
gtagcaagaggataatctttttcttttatagctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcctttttttttttttttttttttgaggcggggtctcactctgtcacccaggctggagtgcagtgcacaatctcggctcactgcaatctctgcctcccaagcaatcctcccacctcagcctctggtgtagctgggaccacagatgctccaccatgcctggctgtatttttggtaaagatggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatt

SEQ ID NO: 175350 - DNA, 1383 bp, Homo sapiens
tcaataagtggctagctgctgcttttattattatattgtttgagaaaaacaggtgatgaacaaaggtacctttgatagcacctgtatacaatgcactggctggagaggagtgagactgacaacaagactggcagatgttgctgggcgacaggcccatgaggggttattaggagtttctcttctctttggatctgtctgtggaaatggtcaaagaccatggacaaatactgagaaaaaacagcccaggtagaatgcgaaacttcttaggagaacctcaggttatattgtgattgcatccgttacctgctgttcttggtggaatagaactgaatggtggctatgctgaccatgtgatctttccctcctaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcctttttttttttttttttttttgaggcggggtctcactctgtcacccaggctggagtgcagtgcacaatctcggctcactgcaatctctgcctcccaagcaatcctcccacctcagcctctggtgtagctgggaccacagatgctccaccatgcctggctgtatttttggtaaagatggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatt

SEQ ID NO: 175351 - DNA, 346 bp, Homo sapiens
ggcacctttgttcagctttgaaaggattagactaacagtgatctcagtttttgaaaactggcaactttatttctacttactgttttctgtttttcacggaaaactgaagttaatctttacttttgtttagcaaaaagtagcaagaggataatctttttcttttatagctggaaggggtctgtgtacatcagcaactttcaaacccattttatttggagaaaatgtactctctggatgcctgttagaagtcgggattaatgaaaattgtactcagctcaggtgagtgtttcattgatgaatatatcggcaatgtgaatggtttgcctagaattaattcactacatga

SEQ ID NO: 175352 - DNA, 222 bp, Homo sapiens
ttcgaaagcttcgcctatgtgttttctttccttgtgcatgactcttgtattatttgcagagttagggcttgctatgctggaggaaacaggctcacgttcctttgttgtgtttgtctaggttaccaacttggcaagcctgtccgagctctaaatatcaacaggatgaataatgtcacgactttacatctttggcaatcgggtaatccggtttggtcattatga

SEQ ID NO: 175353 - DNA, 2897 bp, Homo sapiens
cgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcctttttttttttttttttttttgaggcggggtctcactctgtcacccaggctggagtgcagtgcacaatctcggctcactgcaatctctgcctcccaagcaatcctcccacctcagcctctggtgtagctgggaccacagatgctccaccatgcctggctgtatttttggtaaagatggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatt

SEQ ID NO: 175354 - DNA, 2530 bp, Homo sapiens
cgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcttgaacctgagaggcggaggttgcagtgagccaagatcgcgccattgcactccagcctgggggacaaagagtgagacttaggtctcaaaaaaaaaaggcacaacaacacccggggatataagttcattatcccaccttcttgggtttcaccccgattttccctgaatttaaagccttgtactaaggacctgggaattcccgggcataagggggcc

SEQ ID NO: 175355 - DNA, 2146 bp, Homo sapiens
cgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaagctcaaccagaacgtaagtatttccaaggaatatttgttggtgagatgta

SEQ ID NO: 175356 - DNA, 848 bp, Homo sapiens
cgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagcactttgggaggccaagatgggaggatcactcgagcccaggagtttgagaccagcatggacaacatagtgagaccctgtctttacagaaaatatgaacgttacctgagcatgatggtgcacacctgtggtcccagctacttgagaggctgaggtgggaggatcacttgagccctgggaggttgaggctgcagtgagctgtgattgtgccatttcacacttcagcctgggcagcagagtgagaccctgtctcaaaaaaaaatcaataaagtgc

SEQ ID NO: 175357 - DNA, 901 bp, Homo sapiens
gccgcctaccagggcgactttaccattgaggtgccgccctccacccagcggctggtggtgacttttgtggaccccagcggtgagttcatggacgctgtccgggtcttgccttttgatcctcgaggtgccggcgtgtaccacgaggtcaaggccatgcggaagaaagccccggtcattttacataccagccagagcaacacgatccccctgggcgagctggaagatgaggcgcccctgggcgagctggtcctgccttctggcgctttccgcagagccgacggcaaaccctactcggggcctgtggaggcccgggtgacgttcgtggacccccgagacctcacctcggcggcgtctgcccccagtgacctgcgcttcgtggacagcgacggcgagctggctccactgcgcacctacggcatgttctccgtggacctccgtgcgcccggctccgcggagcagctgcaggtggggccggtggccgtgcgggtggccgccagccagatccacatgccaggccacgtggaggccctcaagctgtggtcgctgaaccccgagaccggcttgtgggaggaggagagcggcttccggcgcgaggggtcctcgggcccccgggtgcgccgggaggagcgcgtcttcctggtgggcaacgtggagatccgggagcggcgcctgttcaatctggacgtgcctgagcgccgccgctgcttcgtgaaggtgcgcgcctacgccaacgacaagttcaccccagcgagcaggtgagggcgtggtggtcccgctgcacatctggggcgcccggttttccccaccctgggcctgggcgcttgtcgagtcacggccccagggctgcctccgtttgcctctcgctagctccgctgtccccggtgcggctgccatcctctcc

SEQ ID NO: 175358 - DNA, 529 bp, Homo sapiens
agcctgaagctttttttaaatgaagatttattcaacaaatgtctattgagccacttatttgtgccacaagctgtttcagataaggaggataaagcaatgaacagacaaattccattcctccttgagtttacaattattgttatctagatttaacgagaacatttttcaatgggaatgacggtgactaagagggggtgaatgggcctgtgtcttgtaactagatggcattgctaggcaccgtggactcagggggctctctctgagattggtatagtgtatgggaaagaaaatctgtatccttgaatattttttcccagctctcttactatcctattatcttaggttatgttgcatgtattctatattgtatattatgcataatatatttataatttctgtctcagtaatgaagtgatttcagaggaggtaagaatgaatcctttgctaataagttattactttccttgaaaatccaaatgacaagaggattattcactttgcaaaaggattatttatttttataatgttt

SEQ ID NO: 175359 - DNA, 223 bp, Homo sapiens
caggcattctttctgcccaacccaacacactcaactcatgcctgcctcaggagctttgcacctgctgatccttttctttagaatatggcttggataggtcaaattcggcttgcaatttgtttctgcacagccctcgagtggagagaatgtttgcacatttaaagggttataatgaaaaggctgggagtgatggctcacgcctgtaacaccagcactttgggag

SEQ ID NO: 175360 - DNA, 305 bp, Homo sapiens
ttcccaataaaccgaacgagtacaagcctcagcatggaagcacagctttctagaagctggaaaatcaggctcatcacaaaagctcgagcacagttaatttcctctgacatttcctcctgtggttagtcttggagccagcaggtggccggaggcgccccattctttcccataaatggacggtctctaaggaatcaagtcaggccctcatctccaaaccctcatcccatttttccctggcctgcacgtggccagctgtgccccgcgcctcgtaggcctgtccctggctgtgccccgcgcctcatagg

SEQ ID NO: 175361 - DNA, 596 bp, Homo sapiens
cagtagaatgggcattaaaatgtctacatcttaatccctggaacctgtgaatatattaagttataagtggaactaaggttgctaattggttgaatttaaatggggagattatcctggattatccaggtgtgcccaatgtagttacaagagtaactacattgttagtatgtagaatactacatactaacatgaagagagaggtggaagaatctgtgtcagagtgacgcaatgtgtgagactcaacctgacatcactggctttgaaaatggaaggaggccagaaaccaaggaatggtgacaacctctagaagctgaaaaagaggtaaaaaaaattcttttctagacacttcagaaagaaccacaactctgccaacaccttgattttagtgactgcaaacccatttagaacttctgacctccagaatgacaaaataataagtttgtcttgtttttagccactaactgtggtgatttgttgcagcagcaataggtatgttacagtatgaaagctatattcctctgaatgaatattgctcattgaagacttacggattataggttcttcctccagtatattattttttcctgcttcctcct

SEQ ID NO: 175362 - DNA, 288 bp, Homo sapiens
acggattcagtctttttaccattaagcattgtgttggttccaagttttttgtagatgaaaagtttcctcactagtttgaggaagttcctttctattaagtttgttgagtatttttaacatgaaaggctgctagattttttttaactgctctcactctgtgaataattggtattaattcttttttttaatttattttttattttcatttttgagatggagtcttgctctgtcacccaggctggagtgcagtggtgtgatctcgactcgaatacagcagtctctacctcc

SEQ ID NO: 175363 - DNA, 384 bp, Homo sapiens
aatgtgattgttcggcttgtggatcgggtgtcagaaaatctcttgggctgcgttacccaagagtgagacctcagcagttccttgtgccgtttaagtgtttgtgttcactttagttatcatctgatcatatgccagctggtaataggattgtagtggctttgcccaacaatggagtcctaaaagagctgagaaaacctgacagatttggtgagtggcagaatccttagatgtctcatttaatgctgggtgatttagtgcatccatgtggaggagtgttttcaagtccacatcagagcagagcaattgtggaaagacatcagagccttccctgaatgagatggcatgagtgggcaaaggcagttattgcaaacaagctcagaaatc

SEQ ID NO: 175364 - DNA, 356 bp, Homo sapiens
cagcaagctgagggagtctccttgtgcccacttctaatttctgagtgaagtaggaggccactccattggttgtgagtaaagaggacggcagcagaacagcgatgattgggaggggagagttgggccattgagggtggagaaatgtgcagtagccatcgtggagagtgagaggtgaccaaattactgggcagcatttcaggtttcattcgtggtgggtaattggggctctgtaggcctgccaacctgccctgttgtcagaggtctgcttaggcggagacaggtgaaaaggggacgctagtacaatctaagtttgggattttgccagaagttaagactaaaggtcagagagagtccag

SEQ ID NO: 175365 - DNA, 302 bp, Homo sapiens
gggcaagagggatctgtcgtcagccgtctggatgagaacatggcttcactccttactaactgtccaaccggggcaagttacttgatctccccaagcacctgcctcctcccctggatgatgggataatgagcagcttcctcttagggctgtggtgagcacgagatgagactatctgtggtgagcgccatgtaccgtgtcttacaccatagaaatgttcttattctacgactccctcaccttgaaccaaaggaaaatgcagaaattctcttagatcttataaagaacttacgttacaaaactta

SEQ ID NO: 175366 - DNA, 328 bp, Homo sapiens
ccaccgcacccagccaaaaacctttttcttatatgagttggagggatgatatatgatggaagggaggggagaggacaagtgataaacacctggagggttgagggatacaggggacaacacagctgtggacttagcgtgtttggaaaagccaggcagtttgaccctgctgtgtgaggacgaaggcatggaggaggaatgtcaggaacaagagatgatcaccaggtgtcagaacttggaagatttagagcaaaggacaataggaaaaaggactcacggagttactattcacaatgccagtaagagacacgaccgtcacccttctctattt

SEQ ID NO: 175367 - DNA, 385 bp, Homo sapiens
tagataattgccttgtcatgaatatccaaaattgggggtgataatacatttagaaaccagtttctgctgacaagcatgtatcagctcacttttggataacccatccacagctacttattttgaagagtgctggatagtggtgaccacacatactctctgttgggtaatgtgttttaccttaaacatttgtgtttttgcctcaccgtggtgttgcccctcgggtccctggtttgttggtttctctaggctgtggggtattggcatgtcttacatacggctgttttctggatatgttagaccatctgatgcatcatctgtgaatgaagttgaatgtgttttttttttttggagacagagtctcactctgttgcccaggctggagtac

SEQ ID NO: 175368 - DNA, 340 bp, Homo sapiens
ctaattagcaatcaaacctatcgattctactcatgtcagcttccactacaaaacctcctaaatggtctccctgcctttgctaataccaatctttcccaatcttatcaactccagtgactttttctaaaatataatgggatcatgtctctcatactttacagcctgtaagatgaagtccaactaccttaacaaagcacacagggccatcaaaaactaaaccttatcctggggcctagcacataacagatgctcaataaaggctaggtcaacaaatgaatttatctctggtttaggaaagaatgaagccatatgggcattacagcaaacctcttagttcacc

SEQ ID NO: 175369 - DNA, 837 bp, Homo sapiens
cgtggtggcgcacgcgtgtagtcccagctacttgggaggctgaggcagaagaatcccttgaacccaggaggcggaggttgcagtaagccaagattgtcactgcactccagcctgggcgaaagaggaagactccatctcaaaaaaaagaaaaaagaaatttcatggttatgcaactcttatttatgatcagaaaaatggacattttgtgatttaactctgtaacatgtttcatgtagtaaaaatataataaaactattaatcatctagcttgggagagataggagaaagacattactgtcactagtcaaattatatatcttttactatccaccaaaaatctcttctgatttctggttagaaggcatactattaattgataagaaaataaaactgaaggcctctaacatatcacagggtaataagaatatagggaaagttagttcaatagtttaaattaaagcacacttcttacagtatagaactagtcgggcttttatgccttgttttagttcttactcttcctttaactctttttctgtgtgatgtaatttacattaatgcttaagagtgaactttttaagtgtgggtaaaaacgaaataattacttacaaagtttaattcttccatttcctttgagagaggaaagttatggaaaagcagctcttatctaaagcaaagagcccacagattgatttcattggccctggatgtatttaatggatttttactatgcacataatttccagaagcattgttatttatttattaattataaatttagtgtaaccatttcatagggttacacagaactacccagttgtgcatgtctgatgtaat

SEQ ID NO: 175370 - DNA, 484 bp, Homo sapiens
atgaatgattacaacaaatattcccaatagtatttggataccaatatcatctttacattttacttatagataatgaaacttaggcttagtgagttttccagattaccctaggtgaaaagataataattgtcagagtcagaagtagagtccaacttctctcccttcaaatttcaggctcttagcaaagtgacaatacttgaaagcaataagcagttggtttataacatctaaagcatctgagctacaaaataatctatgatccatcctgtcatttataccagatcatgaatataaatctcgctgaaagaacagcaagattatggggtgaaaaaaatatgtttttgaggaaaaaatacaacatacaaatcttcatcgaaattctagactgcttactagtttgtttgttttaaggttactatgtcattgtgtatttagccacattcttcaatttcctttttacatttccaaacactcaaagaaacta

SEQ ID NO: 175371 - DNA, 892 bp, Homo sapiens
actccccggctcactcctcactcccctgctcactcctcactccccagccctctctgccatgcctgctcactcctcagtcttcagtcattactcgtcacttctatcagggagggtctccctgatccacctgtccacagcgtggcatgctttctaaaagcgctctgcgatttccttcacagcaccgtcacccgtgtagccatgcctgtgtgtgactgatctcatgtctctcccaccacacttcaacggccaagagggcaaggcttgtggcagccttgcacagtgggatatacttggaccctcctcggcaccagcacacgggacaggtcaacgtctgataagagaatcagccacttcctggtacaccccctaacacaccccaggctgtggacgcgaggtccaccccaggcacagccacttcccctcagtccaccatgggggttccaccgtctttcaagacagagccctaacctcaccctccctgacaccttgctcccttcaattactctcacatcctctgtgatccccccaaaaagctgactcttcctaaaccactatctcagtttcacataatgtcatgcacatggtctgttttttctactagatttattttctttcattttattttgacacagtcttgctctgtcacccaagctggagtataatggtcccatcacagctcactatagcctcaaactcgtgacctcctgcgatcctccagcttcagcctctcaagtagctgggactacaggcacgcaccaccatgcccagctaattttttaattttttgtagagatttggtctcactatgttggccagactggtctcaaactcctggcctcaagcaatcctcctgcttcagcctcccattttggattacaggtatgagacccca

SEQ ID NO: 175372 - DNA, 585 bp, Homo sapiens
cattgagggaaatgtggcttctgttgtttctggcaaggatagatatgtatgtctggaagccaatcttagctcttgctttacaatctcttatgatgtcttcttttttttttttttttcaagaaagaaaaccttagagagcattaaagaaaaggttctaggctgttgtcctttgctatacttggttttgatgccctaaggttgatgcgtccatttgctgcagagcgattgaattacatctttatccataggcagagcaggaggccatacactgaaaaacgccgactgatgcacttaaggtatttgtggcaatctcatcggctgttgtggagcctgcacagatttcctgtgacatagaaaactcttcttgtttagatgcgctgtgctcagtttcattttctaaaaggttatgtatctgcagtcaggtgatagattagcaaggaggcaagtgggagaagaatagcccttttcatgtcttaaggcacatttgaaagtaagtggatctgagagacagtctaattctgggagactaagtttgtttgaatttttttttatggtccttatttgtctgcacaaaagttgtgctta

SEQ ID NO: 175373 - DNA, 675 bp, Homo sapiens
gactggggtattgtggtcccccggtgagaacgtcggtggctggcttcaggcacctttggcctgcccccgcctgtctgtcaggcctccgttactcaggtgtgttgttcactcattgatggagcaaacacttaacagacgttgcatctgtgccagcctctgagctagttgttgccctccctcccagaagctcccaggctagtgaagagcaaagaccagcaaaggggagctggcgatggaggctggggcagcaggatgttgaaggccattgggagccttggctctgtccagagaactggggagcccatccaccaagctcgcccctgaagcacagcgcaagtttccggatggaggaacagaggagtcgacatccaaagcaggcggagtgggagagcagcctggtgtctgcagggagcagggaaaggcaagggactttcatctccaagatgatgaggcctctgggtttctgtgaccacctcgactaccaccaacagagccctctgggcctgccagactctaccacccactggaacccactcccctttcccctctcaggcagccagagactccatctgtccctgcacacctgcccttgagggcctctcctcaggcttcccagagtgtgtccagcccctgcctggcctgaccctgaccttgcagctatgagatttgccttcc

SEQ ID NO: 175374 - DNA, 586 bp, Homo sapiens
gaggtaggggttcaacttgattctttttcatgtggatctcagttgtcctagcacaatttgatgaaaagacccttcgttgtttattgaattgtcctagcgctcattgaaaatcagtcaaccatctggactcacagttctgttccattaatccatatatctattcatatgccagtaccacatagtcttgattgctgtggctttgtagttagttttgaaattagaaagtgggattcctccaactttgtatttttcaagattattttggctattcatcaggataaatgaatgggtgtagggcagtttaatggtatttcctaacatcctgccagggctaaattagagattggagagttttctttcacatgagacactgataatttttttttttttttaagacggagtttcactcttgttgcccaggctggagtgcaatggcgtgatctcagctcactgcaacctccgcctctcgggttcaagcgactctcccgcctcagcctccctagtagctgggatcacaggcatgtgccaccatgcctggctaattttgtatttttagtggagacggggtttctccatgttttggtta

SEQ ID NO: 175375 - DNA, 395 bp, Homo sapiens
ttgagagtgtcaactgcccaaaggtaagggagctggactattggctgcaggaaggagagttacataaattactgggcagctccaattgctcaagggcaaaccgcagttacaggtagcagaaatgagctgttagcagcaaggaaggtagcctctgggcgatgggcactctgagcaggtcaaaaagaccttgaaagagtgctgacagcatctgctactgctccccaaatgtaatcctatctcattccatagcacatccttggaaagaacccattggaacgcaggggacttttgggtgggggtgggtagaagtgacaaaaattaaaaaaccaagaagtttagagtccctttctcaccaccctccatttcttgagaagaataaggtcttatttgatgat

SEQ ID NO: 175376 - DNA, 380 bp, Homo sapiens
tggcttaaataagagaaattaattttctcacaattctggagatggaaagagcaaggtgtcagcagggttggtttcttcagaggcctctcttcttgtcttgtaaatggccgtcttcctgtgtcttcacatggtcttccctttgtgtctctctgtgtctaaatttccttaccttaaaaagatgctaattggaatgggacctcaatttaaaagaaaagaaaaagaaaaaggacgctggtcatattggattggggcccactctagtgacttcacttttacttatttacctgtttaaaggcccatttccaaatacagtcacatactgagatactgtggttagaactttaacatgacttttggagtgacacaactcagcccagaac

SEQ ID NO: 175377 - DNA, 509 bp, Homo sapiens
catgagccaccacacccagccagatatttgttaaattataataaacaatagctctacaaacttcattttgtacatactgggcttctaaaatgaaatgatttcagataacaatttgaaacttatatagggcctcaggacattcttgataaaacctcagaattgaaaatgcaatcaggtattatgtgtaattaaagtcaggctattttaacttgcctcattaatttggagtttataactatattgacaatatctgcagaaaggatttgtttagcatattaatggtttagacaaggtccaaataatgcacacctacaacaaacttttaagcacttaaaataattttagaacctccttttgcatgaaaacaatttgctaaaataaattttatgtctatttgtaaatttggatctcatatgctctctacttagaaatattccaagatcctcttactaaagatatagtcgtgcaccacataatgacgtttcggtcagcggcagaccacatataca

SEQ ID NO: 175378 - DNA, 393 bp, Homo sapiens
ctcctgggttctcgccattctcctgcctcagcttcccgagtagctgggactacaggcgcccgtatacgtggaatatttctaaggaattcataagaataagaagctgacacattggttgccactagggaagagaactgagtagctgaggataaggttagaggtagaaaggggactctttactgaagagtcacttgctcagggtccatactcatcattctggtctcttagtattatcctcttttaagttaatatcacttgtcaacttctttcaacacttttttgcagatgaattcaaaatacctacatttaatcttatcagccttctactttcagctgtctattaaacaactctgcgtaggttccatgagccaaccccttaaatctacttaaaga

SEQ ID NO: 175379 - DNA, 376 bp, Homo sapiens
gatagaattgtttcaagggctgtggtcagaggtgtctaagtgctgaaaaaataagtttgatgagttaaagcagagggcttccagagtggggtccataggatcaatcaatagccttcaggaggttggtgagtccccagaaataacatgcaatattttgcatgcatttttttggggagagtctgtgttaaaactagattcttaaaggggtagagaccatgctgaagtaaagctactcctgccagctatctccaagtgcctattttacaggagcccatgagctctagctcaatttatttctcccctttcttcccagtcaccatccccttccctagtgggcacctactacttcatccctcttcatcctgcttcatcccct

SEQ ID NO: 175380 - DNA, 288 bp, Homo sapiens
tatgttgttcacatcagcatagtgcaagtttcttggagtaagtctagattcattttatttattacaaagttttcaaacatacatttcatgttatggctgcatctgttaataaatttttatttaatgaattttgtttgttgcttcaaaaatgaggaaaagcaataaagtttagcaagaaggaaataaggcaaagggaggtgtttagagttgcagtcccttaatatcgcagattgtttactggtaagtggtggggaggggttggtgggaggttttgtggaagatcatacc

SEQ ID NO: 175381 - DNA, 346 bp, Homo sapiens
tcagaaatataacatacacatctcctaagaacgactttatatccatacagtagaatattattcagtcttaaaaggaaatgaaatcctggccgggcacggtggcttatgcctataatcccaatactttgggaggccaaggcagatgggtcacctgtggtcaggagttcgagaccagcctggccaacatggtgaaaccctgtctctactaaaaatacaaaaagtagctgggcatggtagcagatggcggtaatcccagctactagggaggctgaggcaggagaatcacttgaatttgggaggcagaggttgcagtgagccaagatcgggccactgcattccaccccgg

SEQ ID NO: 175382 - DNA, 298 bp, Homo sapiens
taaaaatagctatttttttaaaaattggtgagaagaatgacattgttttacatttttgcagatctctttaatgtctgacttcataaaggatagctgaattctcatatctgcatatgtctgttacaatatactgtttgggttaaagtatatgaagaaaatctggttttacgtagatatataaaaaaagattttttaatagtcagttcagacaattttgcatattcttcttttgataccgtactagatcttaatacttggtagttttaaggttagttgcggccaggcgcgatggctgatg

SEQ ID NO: 175383 - DNA, 383 bp, Homo sapiens
tcaacctttaaatatgatcaaacttcaggcttcctgaagatgagattccagcaaaaatttatttgttgtattatctgtgttcattttagtagaagcaaagaattattaattttatggctgttctaccctgaatattcactaagaaggaagagattttctgaattcatcagctgtaatggcaaaaccaaaaagaaaacaataagactcacgtgttgctcatgaacacaatgacagaacaccacacaccagttctgctgctacaggtaatctatataaaaaatgtaaacttactgatactcattgaatttgagattaaggatagagagattaaggatagagagattaagggtagagagattaaggatagagagattaaggataga

SEQ ID NO: 175384 - DNA, 150 bp, Homo sapiens
tgatatgagtacatattgccttcaggatatattctcaatacatttctccattcattgtcatccacatctgtgcctctaggattcttccaaatccctcctgttattgaccaagaacttccatgggctcgtttatcatacttgagcggacag

SEQ ID NO: 175385 - DNA, 861 bp, Homo sapiens
ctgtgattctaggattgaaaaagaggaaatgattccaaagcaggacatttctgaagaattggaatcccagagagcaaaatcagaagatcatgtaaggaatatttttaaggaaactgaagagatgagtaaaactgagggaaagttagagaattgctggagaaaatatgcagtagaaggagttaagaactcattctcccagaagagcaatttcagagaaattaccatgaggtatgtgaaaaccctctctagagagaatggccagaagttcaatgctgttggagaaaactgcattacagactcaaatcctgccaaacatcttagagggtctagagaggagagtctccatccaagtgtgtcaagtgtagaaaacttgcaacaacatgaggacctcattaacctccagagtttccaattaggagaaagagcctatcagacagatgtgttagtgaaagtgcccagacagagctcagttcttagtgagaatcagaggatgaataatccagagagatggtttgagagtactgggcgtggaaaaacttacaatcagaacagagcttttaaccagcaccagagatttcatagtggagagaagacctatgagcacaatgaatgtggaaaagctttcagttggccctctatcctcagtaaacatcagagaatccacactggtaagaaactctacacatgtgaggattgtggcaaatctttcagtgttcactcatactttattcagcattgtaaaattcacactagagaaaaaccctatgagtgtattaaatgtgggaaagcttttagtacacattcatcttatgttcaacatctaaaaattcatacaggagagaaacatcatgagtgtaatca

SEQ ID NO: 175386 - DNA, 325 bp, Homo sapiens
ttgtaataataaaaacaaaaaaagaaagcctattgaaccagaaatccaatgtgcttcagattaagcagcaaaatctttagaagctggatcataatatcaatcagtctttgccacttcctctgcaaacgaagtccaccagttattcctggaataatgctttcaattaaaaatcagcaattactcatggttgttttatttattttttggtggaagtacaggtgaaagtaatcagaactaccttcggtcctgcaaatagctgaacttcaatcgaaaaattaattaaaacaaccatgactaatgtgctgaaactaaatgtgcggaaggg

SEQ ID NO: 175387 - DNA, 335 bp, Homo sapiens
ttcccgacttcgttggcagctcattttggttatatatagctcagaaataaacacaaatatcaaaaataaacacaaataaaaatatcttaggccaaaccaccaaatgtacttagagaagataattgtacaaaatggtgaaatcctcactttctcctgagatagtctgggttttaccaaaagtcttaactgaaaccactgttttctgttatcacctttgtttccttttcccattcatttattccctaatgtattcatttattcaaccatctgttgattagatacttactgtctattatatgccaagcatatttttttgggcttaaatacctcctttt

SEQ ID NO: 175388 - DNA, 747 bp, Homo sapiens
ggacctgggttgacgtggctttgcgggttctggggtcttgccgaaatgcggtacacctctcggccctgcgaggaccggagagcaggacagtgccacagcccttaggggggtccaggccagctggtcgaaagtgaggatcttgccccctcattcatctctttattcttcagccttaggatcttataattattgtccttatttccaaaccaggctactgtccccccacccaaaaaaaataaataaaaaataaaaataaaccaatgttggcaaggctatggagtaaagggaacgcttaggaacgcttatgcgctgttggtgggaatgtaaacgagttcacccactgtggggcacactttgtagatttctcaaagaactgagaaagcaactagcatttgacccagcaatcccactgctgggtgtatacccaaaggaaaataaatcgttcaacggcactgcgcccgtatgttcattaccgcactatctgcaatagcaaagacacagaatcaacccaagtgctcatcaatggtgacttggataaagaaatgtggtgtatatatactacggaatactacgcagccgtgaaaaggagggaaatcatgtcctttgcagccacatgagtgcagctggaaaccattatcctaagggaactagtgcaaaaacagaaaaccaaataccacatgttctcacttaaaagtgggagctaaacattgggtacacatggtcataaaaatgtgaacaagagacact

SEQ ID NO: 175389 - DNA, 616 bp, Homo sapiens
tgtcgtggtggcattccccgggacaagttctctgggcccagctgagctctcaccacgggggatagaaagtggggccggccagcactctgaggccatctccagtctcttctgttgtcaaatttcgctcttttcctcctgcacgcgaggtggaaataccaaaggcattgggcatccagagaccttgattgagttcgctttgccctttcacctgtgtgagaccttaaatgggtgcttgccctcctataacctatttcttcatctgcagtgtagcctgacagtatgtacttctcagcgtagttgtgagaggtaaacaaaacgaatgcatttctgaaagccatgaacctctacacaagttcatttgtggaattcctttaagataccccctgaaggccgggcgcggtggctcatacctgtaatcccagcactttgggaggccgaggcaggcatatcacctgaggtcaagagttccagaccagcatggcaaaatcccatctctactaaaaatacaaaaattagccgcgcgtggtggcaggtgcctgtaatcctagctactcaggaggctgaggcaggagaattgcttgaacctgggaggcgaaggttgcagtgagctgagatc

SEQ ID NO: 175390 - DNA, 411 bp, Homo sapiens
ttttattatgaacattttgaaatgtattcagaaatagcatttagtaaaccaccatgtacccatcactcaagaaagctttaaatcaatgaaaacctgaagccctttttaaaaacacgactttatttatttatttatttaatttttatagacagggtctcactctgttgcccagactggagtgcagtggcacagtcatagcttactgtaaccttgaactcctggcctcaagcaatcttcctgccttggcctcccaaagcactgggattacaagtgtaagccaccatgcccagccctattttatagtattttatagcttgccctttaaacatgagcatgatatctagagtaatagtggagtgatactagttgctttcagagctgagtatcaatttgtttagatgctgcaagaca

SEQ ID NO: 175391 - DNA, 464 bp, Homo sapiens
aacatataaccataatgatcacatttgggacatttatcattgttatagtactgttatttaatatgcagttcatattagatattcaagtttcttcagttgtcccaataatgacttctgtagctatctttttaattttaactaatctaatctatgcttactcagtgtgtttggttatctctttaatccaaaagaattctttagcctattttgttttgtacaacattggcaattttgatgttgctgttttgtagaatgtccttttttttttttttgagatagggtgtcgctttgtcatccaggctggggtgcggtgcagtgatctcagctcactgtaaccttcagctcacttgacttcctggggtcaagtgattcttgtgcctcaccctcccaagtagctgggagtactaggcacgcaccaccatagctggctaatttttgtatttttagtagagatggagttttgc

SEQ ID NO: 175392 - DNA, 467 bp, Homo sapiens
cacacacacacacacatttggcttatcttttatttagggtgatatcaccactctctttgttagtattatgtgaaatgatattgagaaaggacctgaaatctaataatccataaagttctagttatgttgaccattctatagcttcagctatcaacattatgggtgacttatggttatatattcttttcatgaaggctcttctgaatgcaaatgtaatatttaaagttgttcatcagacttgtctaactaggcatcctaccgaagtgtcatgcaggttgaatgtcccttattcaaaatgcttgggagcagaagtgtttcagatttcagatgttttcagattttgcaatatttgtattatattagttgagcatcctaaatccaaaaatatgaaatttgaaatggaacatgagcattttctttgattgtcaagttaacactcaaaaagtttcagattttagaacattggg

SEQ ID NO: 175393 - DNA, 401 bp, Homo sapiens
tcttaatctatttctagagggacaaccctcccttctagaactactctgtattctagaggaaaagaattctcaacagtgcaatctacaacactatcatccaggacctaactgaagtttttataatatgagtttccacaaccatgaaaaacaggaaaagaatacccaacatatacttttgaactctgctgaatcttattctctcatatagcgttattattaatcaacaaaatgtaaaacaacaaagaaatgaacaaaaaaaaacactggcgatgaagcatacaaatatttcctccctatacttctgcccccaccccatccagcaaagtaaggaaaggcctacaccaagatcacagaacagtcattatagtaatctaatccttatatctttgaaattagataat

SEQ ID NO: 175394 - DNA, 326 bp, Homo sapiens
gtagaagcagccattctttgtgtgtggggagggacctccgccaagttttcttagatggaaaggtgttggctttttcttatcatggggagatggtggagtagaggggggagtgtggtgggggtgtgatattctaccctaaaatatttttcaaaaatatactggcaactaaatctggccatgtttgtgggattgggtggagttttccttaaagtgatagggcagggcacactttatctcaaggttttaactggagttgacacttgggaagacattctcttgggtaatacatgctgcagagaccactcatgggcagcctgattcagaga

SEQ ID NO: 175395 - DNA, 498 bp, Homo sapiens
aaccacagcctgatgagaggctgagttacagcacgttatgtttattggctgcaaataaacgtgtccagtactcctaagagcagtgctcactccatccttggctttgccagcctcgtctgcttcccttagattcctgagtgtgacttcctaagatgtatgtgggactctaatgtcaaggttgctgtttttgttgatgttcactttcctacagccttgtggggtgtgctgctaccatggaatctccttggaggggtggcttcggcttcagatccagcatcctggaagttacttggtttagcaaggcattgttgcctggtagatgatctgatatggttgaccacagtctgaaggcatagaaatgctgttttattataaagtccgggccaggaaagaaatagaggatattgataattaggcctctgccctgtgggagctgtttttctatgcattcctaaaatacttgagtgcttgtgaggtgtatagtactgaagtagggga

SEQ ID NO: 175396 - DNA, 418 bp, Homo sapiens
tgaataactcatctaaggccatgcatattaaatagaaaaggcttaagttgaagcactgaagtaatttagaatgaacataaacagcttctgatactaggtgcactgagtgtgacgtgttttgggaacacagcgatctttgtttttgacaagtactacatctgagatgacatctgaataattaatatgtttagcccagatgatatattttcaaaagtaatgtgctactctggatacagattttcaaattacaatcagcacttcttgttgccacctcccattatgtgtctttcatcacctgtttagccagctgtgctgctatgtaggcaaaatcaaacattaaacagatgttccttgaactgaaagtaggaggtgttttcaaacatggctagctacattgattagggatgaaatatatcaa

SEQ ID NO: 175397 - DNA, 726 bp, Homo sapiens
cagaaaattggacagttttaaaaagtggtccagagaaccagcaaatatgaaggcaggctaataaaaatgcatatcactctaacagtttcaaggcagtttcctcgggagactgaggtgggaaggtcgcttgagcccaggagttcaagtcctgcctgggcatcccagtgagaccccacctcttaaaaaaggaaagaaaatggttttttaaatcatttcatttcgtataagattattttgcgaggttggtgcatgacattggagttgcccagcaattggaaaaagacatgagcgtttaatactgggcgttctttctaaggctcttaaagtgaaggcaatcacataaggctatcttgcttcatgggtaattaaggcatttccttctgcagttcccaaatctaatgaagaagaaggaatttctcttttgctgaaatatttcttgtaaggttttcatttcttctcattgctccgactttggaaaaatgttctttttacctctgattttctcttgtaatgtcttcttgaattgtgagtcggggaaaaaagtaaaagattcgctacagattcagacttgcaaaaaaacgcttagaatcttgctgtccgtaaaactgaaacatccagcctcacaaatgtccacatttctctctcatctgtgaaggcccgttgagactgctcagttggtgtctcctctgtccacaggacatggccgtagccgtgtgtggagaaggg

SEQ ID NO: 175398 - DNA, 467 bp, Homo sapiens
gacctgtgtggtgaagcccccagggttctcagtccccctccccccgcaccacaatcccccctcaggcacccagttcacctcccatcagaccagcaggcagagctcaggcctcctgcatggtgctgggtgccctgagcctccttacagatagcagtgaggtgccctggggcctgagggccagcgcgtacagcactccttgctaaagagccttaactgaggtcactcatggaggccacatcgctgcccagatgaggggcagcagcagtggcttcctggaaagtgccagaactcagaggagccggaggtgcggtggctcctgaggacgggcagcgggcgacgggttggacggggtggagtattttttaaggatttttaagtgtttcccacgatttgctgaacatgtcaagtgagaaacagcacatcacgcactccacgcatgaagctaatacagtgaaaatgtaaatgca

SEQ ID NO: 175399 - DNA, 405 bp, Homo sapiens
ggcttgaaacctgaaagaaggcattttaagaaaataaagcaaacaatatttttgactcaaatcacggaataaattatacaaagacgtgtgcccactggagctataaaataagctcaagaaatatttctatcaggtgatggatactagaagtgtgaagaggtgtctctggtcactgaagaaaacagagtgccatctagtggaaacatttcactataatgtattacagtacacactaatttagatttaggttcttttttttcccctcgttacggagacagggtcttgccacattgcccaggctggtcttgaactcctgggctccaggcgatcttcctgactcggcctcccaaagtgtttggattacaggcatgagccaccatgcctggccaagagttaggttcttaa

SEQ ID NO: 175400 - DNA, 252 bp, Homo sapiens
tacctattccacttgtagttcataccatagggaaattatggcaaattttaacatgtacaagaatgacaacaaaattttagaaaccaccaaatatccaccaataaaggtatggaaagtgaactatgacactcatatttccgctagcacagcagttaaaataaatgatctaaatctaaagtatcagcataaagctcaaaaggtaatactgaacacagaaagcaagttgcagaaagatccctataattttttttt

SEQ ID NO: 175401 - DNA, 114 bp, Homo sapiens
gtattttaaccactttcttcctctacagtggatgcttagaaaaaagaactgtatcaagatgtagtataaagactgatcaaaatacaattctttgttcaaacaagatccttacag

SEQ ID NO: 175402 - DNA, 166 bp, Homo sapiens
agatgaataaggtgaagggacttgcatgcctgatattgactcattgtaaagtgctatattgttagtgatatacaaaaacagataaatgaagcagactagcgagccctgaaatcaatagatgcatagatggaaatttgtattttaggacaattgattatccatgtgg

SEQ ID NO: 175403 - DNA, 535 bp, Homo sapiens
atgatggtgtcagcaccatcagtataaatagcaatacagagggaggaagcacatgtcttatgaaaacagccttgaccttacagacgctttgaaagggtcttgaggacctcaagggtccgcactttgaaaggtactatgatagttaaaaggctgtgtatgagagtggctgcaggtagggagaatgtcctaatttaggtaggttatgtagggaaagtcttgttgagaaggtgacattgaaaatgagtcttgaatgatagaaggcaagtttagtctctgatgcaatccatatcatctgcttgactaaatgagtgattttcaaccaggggcaattttgccctgaaggggacacttgtaatgtcaggagacattacaggttgtaacactaggggaatactactactggcatctagttagtacaggctagagatgctgttaaacagggaatgaatagctccccacaacaaagggttatctagccaaaaaaatgttaacaatgctgagattgagaactcctgccctaaaccagcattgaaca

SEQ ID NO: 175404 - DNA, 510 bp, Homo sapiens
aaaatgagtcatgtgaggtaacttccaggctcactgcaatgggtacggtggggtgtatcagattataaagtgggggtgccctcctcacccccaggcttggcctatacccccctctccatcaagtggcctctctgtgtctgtcctttggggtgaggacactgtaggccatgagaaatgggcagttggggggtcagaggccaagggttagggaggcagggcttggggagagtgtgggaccatcagaagagaaggaagtttacaaaaccacattttgtgtggagatggaggctggaggcccggccctgggacttggtctggggtttcttgaggaagatctgagggtccaagggaggaaggatgccctggccttctggccttctctggctgatcctgccttcttgctgcctaggacaggagagtaatgtcctagaatggtccctgggaggccagttaggaaaccctttgctgcttctgtctctagctcttgtcaataaagacggtgacacctga

SEQ ID NO: 175405 - DNA, 303 bp, Homo sapiens
tgagctaagaagtagtggtataactgggattactgcaattgttctgagttgaagaaacttctaaaatgtgtagtgtgaaatttggcttgctgaaatcatggccagagaggtgcattttaaaacaaaaccaatagggaaatcttaaatccaaaattgccttacacatgttaaactagtttaaaataaaattttgtcaaaaggaataaaattgtgaaattgtcaaagttttgttatgtgatatcatctaatgtttgtagagatttttaaaatgtaatggtcacaattttgcaaacaatatataga

SEQ ID NO: 175406 - DNA, 256 bp, Homo sapiens
tcagtttttttaatgcagtggtttttcttgatatgtatcttacattgaacacacattttgttttggttttaaaagctgaggaccagttataagaaaaagatttggaagaatatatgaaaaggctgagctagtttcccccactccctggagtagaaaataaataaaatttccaacttagatgtaggactaataaggggaaagcaaaaggtccttgtgatggagtcttcctaaatagcaatgctctgacttgtctaag

SEQ ID NO: 175407 - DNA, 348 bp, Homo sapiens
tgttaatcaccttagccatgactactacaaaaaataaagtatttttatttaaaaatgtttacagattgtgtaatagacaacagtactttggtatttgaaagttattgcctttcccctcctaattttatatactctttgcaaatatagttaacccttgaacaatgcagaggttggggcaccagcccctgtgtggtcaaaaattcaagtataacttttaattccctcaaaacttaactactaatagcttactgttggccggaagccttaccagtaatgtaaacagttcacacttattttgtacattatttgtattatatactgtattcttgcaataaaggtaagttagag

SEQ ID NO: 175408 - DNA, 123 bp, Homo sapiens
gtcatctgagtgcaccttttcagtctcctccagcgacccctttcgttccactgccactgaaagctttctacacagtcctctgccattctcactctacatctcttctctgggccatgtgagcca

SEQ ID NO: 175409 - DNA, 116 bp, Homo sapiens
tcctgaaattgctgattcaatttctcctaataaaataggaacaataattagctaataagaaatcaacaattaaagctatgagagaattaagtgagatcatgtaagcaaagtacatg

SEQ ID NO: 175410 - DNA, 323 bp, Homo sapiens
ctgcttctgcaattacaaagctaacctgaatcatcctggtgggcagctgattacatggaaacacactacacttagaattacgttcacgtttgggtggcactcctattaacaatttccctgaagaaatcaagtgcaatgctcaacctgtgaccctgaataagatgttatcttctcccatagcagatgctaatttttgattttttattctggtagacaaaatgctttcattttctaattctctattttctgtgaccaataaaaggatatgctttccaaggtcttttttaaagtatcagacactaaaggtatacctcagacacaga

SEQ ID NO: 175411 - DNA, 654 bp, Homo sapiens
ctggggtgatggtgacgtcctgtatattcacagggcttgggttatgcaagtgtctgattttccgaaaactaagagaatgtacacttaagatgtgttcattccattgtatttgccctccctcaattaaaaaagaaacataaaatattgaaccctaggtaacgatctgcttgcagaaatgtttaggagtgatgggaactgaggactgtaatctaatttgagagcatcccaaaaataacactgaccgatggacgaacagagcgagagggatggataaaaggatagacagccagatagacacagttgatttctgtcattctctgcagttctataaagtcaacgaaaacactgaattagcaatatagaactatccctcctaggggaaatacagagttaggttcctaggaaactgtttacattttcatcaactgatcaagacataaccttgtttttttgtgagtttctgtttaaaggcaccttatttaatagacatggttgattcactaacattgaactcttagccaacagcactataactataagcttatctgacatgttttctccataaggcacatacagcattcttgcccttaggaatgctagatagcatttcagcactatggttgggggccatgtcaaccactgaaatcaccaaca

SEQ ID NO: 175412 - DNA, 608 bp, Homo sapiens
tcttctttcttcttcttcttcttagaaactgttttgctggtctaggacctcaatggtcactgcttatattttttatagagttttaatagtgaaagggtatttgtgaagttggtcttgagctgtggccaatctggtgtgctttgtatgtcattctctatggttgtcaggaaattttgctgtaggcctctatcttgttttatgttttcaggagcatgacctgtaaccacgtggcaatgttctgttttggtctctgccattttacaatggtagcccaggtttaatcctggcttagggaataagtcccttctggtttcctatcagcatgtaaattttgccatttgcagattctcttccccttcacaaactgccttaattttttgtttttccactgagcacctggtaagttacctttgataaagtttgaaagccagaaatactggctacttggcactgctagagtcaggtaataaggaatttaaaaggattttcttaaagagtgctcaacttaattaaaagtggatatccaaattataggtatatttaaaaaacctttatgtttttctcttctgggatcttgttttgctggggaaaggtttttttctcagcca

SEQ ID NO: 175413 - DNA, 271 bp, Homo sapiens
ctggcttaagcagttctcccacctcagccttcccagtagctgggactacaggcacgcacccaccatgcctggctaattttttgtatttttagtagagacagggtttcaccatgttggccaggttgtttctcaaactccttatcttaagtgatacgcccgttgcagcctcccaaagtgctgggattacaggcatgagccactgcacccggcctcaatattttaaatatttaaaaatatatttttataaaccatttttatcttaatatggcag

SEQ ID NO: 175414 - DNA, 365 bp, Homo sapiens
caggtgcacacctatgtggcctttttgaatcagtattggttagtgaaattctaaggcatcctttcccactctcaccctccatcccccaaatttatcatttttaaaagaaaacacaagacattagagccaacattgccaatgttgtattataatcctaaatatgatccataaattagaggataaagcgttgtgaaaattttgcatgggaagtagtattactgtagaaaatataggactgttgttttattttatgttgaatttgttctaaatggttctattcaagtatttaatatgtgataagtcttttattttctagtttaagcattttgtcactgtagtattgttttgcagaagaattgctcaga

SEQ ID NO: 175415 - DNA, 511 bp, Homo sapiens
ctgctcagctgcctttcagtcgttgctcttcccctccaccacacaccattccaaaccttgtcactttgagctttcacatctagccctttcagcagacaccttgcccctacatcaagaaactcacagcttacagtcttccagcttccctccctgcatctagaactgcctccacttaaaatcacccttgcctctttccctctaggctccaaaggaaaagtgtatatctgtacatctttctaaggtgtatttcttcattagtgatcttgacttgatcctagattttcccccattgtttctactattctcagtttctttcaactatctttttcctccttggcttataaaaggtatttatctttcacctgctacgaaaccatcctataatcctatatctttgttcactgtgactgttccttcatcttttccatctcagccaagctccttaagagttctctctcctccttttcatatgccccatgcattccttaacctgctgcagcccagcatgcac

SEQ ID NO: 175416 - DNA, 180 bp, Homo sapiens
attgacagaattgacaaacccttagctcaactatgaaaaaacaaaaataacaactatcagaagtgaaagaaaagacattgctaaaaaaagtcaaagtatcataaaagactactatgaacaattatatgccaacaaattggataatctagaagaacagataaacttctagaaacctacaac

SEQ ID NO: 175417 - DNA, 2577 bp, Homo sapiens
  misc_feature (746)..(746): n is a, c, g, or t
  misc_feature (1765)..(1765): n is a, c, g, or t
  misc_feature (2133)..(2133): n is a, c, g, or t
  misc_feature (2345)..(2345): n is a, c, g, or t
tgcttgatgcctggggggaggagctggaaagcctgagaccatttgaaagcattaattgagtacccagggtatatagaccctattctcaggccatgctggaattccaaaggacaagggggctgtctcctgtcttctattagagcatggaccaccttcccccactttcaatttcttctctgtgcccactccccctccccaggccacagctccttcctgggctccgtgaagtacctacagatgcctgatgacctttttagagttggcccaattactcaactgaaacagcttaagcattgcaaattcacacacgcagactctgctagttgtctgagtaagagctagagcgctgggccctggctgtatattggactcacctggagaatgttttaaatgattggaacctgagtcccacccccagagagtatgatttaattggtattggatgcagtggcattttttaaaagctcctctggtgatttaaacatgccacaaagcctgagagcccctgagctggaggatttgggatttttgaattgtttaatgatgagtcgttgggctgaaattgatcaagtgtgatgggatcaagacaggcttagattctatgcacctggtgggctgctatcttgaaacaaaatagtgatgtaaggttttcatatgagtgtgattgtaatggatctacataagagttggtatgagtatagatttgcctggagtaaagtcttcactaaactggcattagttgaggnaagaggtggcaggaagaagtaatcgatatttcttgagtatctgttgcgtgccaggaactgtgcttggaagactatactgatatttcatttattgtttccaaccacatggcaaatgggcattactcctactttacagatgaggaaactgagactcagaaaggataagtgtaattttgcctgagattatacagctattgagttttgggagacaattttctgagggcccctcacatttctgtgtgtcttgcaaagagagacactgactgcctttgtctgaactatccttataaggatgcttgcctggtgaacagctttggaaaatccaatatcttcctctggagcaaagggtaggcatgcttactgtccattataaaagattcctattccttaagctcaggattcctcttttggaacacagtccactctgtgtgagcaggtatcacctagggccctctttgtgctgccttatggagaccatggcttggagaattggcacaaaaccctaatactctggctgctactattgtgtaataaactgtcctttgtctctgatccatgagtctcatgtcttccaccagcatccatgaaaccgtagcaggccagactaacttgttaacttgcaaatggggcaaggtttcagaccccacacagttcttgacaatgtaatctaaatctgttttcctctaaaacctgtgcatttaagagatgggtaagcaagaggagatattaaaacacaacaaaacactctccatcaatgaccactttctctctagatataacagaaattagttccctttctcctttctatgagatacataaacagattcattctgtatcaagagttaaaagaagtacaacacttgggcaccatgaggtgccctctgggttccaggttccatgtgattttcagttctgagctagttcctgttttccctcaaggatgtttcactggatcccatcaactggctctcggccttgataagaaaatctgggtctagcctcgcctcaacacccatacnccactcactctgtggctgttagaagcctattacccccttgacctacttatctttcaaatagaaatgatctttcttcgggtgctaatgctaccggcctgcgtgacccttcatttgtgaccattcctctttgagaccagaattttcaaaagactgattataatcacagtctcattctcaatatttgcaaaaggcctttcctaacacaattctttaaaaccagctaagttaccaggtaagtcaatttcgaaaggatggcttcgtttcagtgctaattagcttctcttctgatggatgagaagtttacatgcaatgatttctagtagcaggttcgtataatttttcaccgctaattattaaaaattattaancataatactcttcaggtgccagaaacttttaaaggtgctttataaagtatcctaaatctactctacaaccctaaaagtgaaatattttcactcaaagaagctgagatttcaaggttgaatatcttgcatgcacagctagtaagtggcagagctggaacccaaggtcacatctgtccagcccccaaagccagacttttctaataaccaactgncccctttttaaaacagctttattgagatataatacacatactctacaattcgcccatttaaaacgtacgattcaatgggtttagtaagtcctcagatatgtgcaaccatcgccacagtcaattttagaacattttcctcacgctcaaaagaaaccctgtagactttagttatcaccctccatcactcctcctccccagccccaaccaactgccttttataaagtctctttct

SEQ ID NO: 175418 - DNA, 573 bp, Homo sapiens
actgtttcccctgatggaaggctctctctgaatttgtaaaagaaaggaaataggcttcttcattgagatcgagagctgaagcatcaagagataaaagcaggttttggaaaacataagaaagagttttctaaaatatgtctgaagatggaagaggctactctgaaggtggcagctccctgtccctgggccttcacgtagtttccactggacaactccacactccagggaggccatggaggagattcaagaactcatgatggggccgggcgcggtggctcacgcctgtaatcccagcactttgggaggccgaggcgggcggatcatgaggtcaggagatcaagaccatcttgggcaatatggtgaaaccccgtctctactaaaaatacaaaaattagctgggcatggtggcacgtgcctgtaatcccagccactcggaaggctgaggcaggagaattgcttgaaccagggagtcagaggttgcagtgagccgagatcgcgccactgcactccagcctgggcgacaagagtgagacaccgtctcaaaaaaaaaaagaaaaaaaaaaaaagaactca

SEQ ID NO: 175419 - DNA, 364 bp, Homo sapiens
tttttagtagagaggggattttgccatgttggcctcaactcatgttgtcttgaactcctggcctcaagtgatcctcccaccttggcctcccaaagtgctgggactacaggcgtgagtcaccatggctagcctaaaatgggcaagtagctttgactgaggaagtggaaatggtctttgaccttttggttgggaagagcagaaatgagagaaatggatagaggtatttaaatgtccagactttaggttttgtttacttgcattattttctaaggccttgagcttggtatgttggagcagaaatgtaggactctagagaattctttcatatttattgctcactgacccaagtgaagctgatgggaaa

SEQ ID NO: 175420 - DNA, 325 bp, Homo sapiens
agtcaggctatggcgagctggcgtttggaatcggaggtgagggacggagtgttcaagagagcaggcggctacacagaggacatcctttgtgtgaggatgttgctgggcattgaatgtccatcagaatagaactgagcaactggccataccctgctgtgaatgaagtcagctgggagaagcatccaggtcagcccggccagcaagagaatctgggccacgcacgtccttggaattttctagtagccgttttttatttcatttcatttcattttgaggatctcgttctgtcacccaggctggtgtccagtgacatgattatgactca

SEQ ID NO: 175421 - DNA, 606 bp, Homo sapiens
ccaagagaacacgcggactgaagtgctgtccacgcggtgttcagatggggctctggaggccatgccatgtgatccctcggtgaggaaaggattccctggccagccatggggaatatgaactcctgaagatgaacaagagctctcagccccctcccccaggcccacccagctgtcctgaggtccccttggaagagaccaaaagagaagaagcaacagggggccagagacccccaggcccccaaccaccatataccacataaaccaactgatgaggaaagaaggtcctaatacaggcacttcccctttcattcttgataaactcagagtccaaacagccctcacagaatgactgcaatgtcagggaactgaaaaagaagagcttactctctcccttcaataagtttcttcccttctctgagcctcagttttctccatctgtaaaagggctgctaaacttccttccagctggaaaccaagatggcggtcttggcaaacctggcacagcaagaaaaattggcctagggcataggcaggaggagttagagagacagccaagtcttcctttgagtcagtcagaaagacaagaaggctttttttttttttttt

SEQ ID NO: 175422 - DNA, 468 bp, Homo sapiens
aatcacacttaaataggacaaggagagcttcaacttcagaataattatcaggataccaatcacacaaatatgattcaacaatcacttaaatatcattcaagaggaattcctggtagtaaaaaaagaaatcccgtaattaactagagcacagcattatcagaaactgattatgtaaaacaatagcttttctttcaggatgtgtgtatgtgtgtgtaacgaagttcacagctaggttacactaatgactcacttaaacatttgaattttctgctatcttaacctttaaatcgactgcaaaagtagctgccaaaagtagcttagtaggaaagcatactactctcaaaagaacttggtatgtccaacttattttactacttaaattttttttgatcactgatatttgaaactaatttttaagtaatgaatgcttactaaatccatgataatattcagcatatacaggttttt

SEQ ID NO: 175423 - DNA, 233 bp, Homo sapiens
cagccccaaacaatgtcaaagagatcccttgagtagttttcaggcgagagatatgttctcatttcaagtcttggagaaaactggatccatgttcacgtggaacttctctcgcggaggtgctatctcattttgcattaaactttaagcaggacagattgctgaagccatgatatttaaggtttgactttttaaaaatctcattactcttaaaataaatgctgccacatcagaga

SEQ ID NO: 175424 - DNA, 217 bp, Homo sapiens
aaaatctgaatatactaaaccacatctacatcttcttttaatctaccaatctcataaccctgtcataaacaaaaatgagggtaggctggctttacttgttcttatgagacaatgctagctccctgagatcaccactctttctaagaatggatgagccaggtcctcactaactgagtcccctgctgcccggccactgcttctcctcatccctgttgcc

SEQ ID NO: 175425 - DNA, 990 bp, Homo sapiens
agggcaggaattgcttgatgagtaacatttatatatacagaagaaaaaaatcataaaaatgtaaacttaaagaagtcttccactgagacatacaaaagcaaatgtatttaatactaagaaaaaaatttccagaaatgctgtccattctgaaatattattaaagagctcctagaataaatgtgataagtgtgtccataaccactacctgaaaatcagatcttagtcaaccttgtaacccaactgggctaatttgaaaatcatcatggccaggtgtggtggctcaccctgtcactgtagcattttgagaggccgaggtgggaggattgcttgaggccagttcaagagcagcctgggcaacatagcaagaccctacctctacaaaaggaagtcataaaaaattatctgagtgtggtggtgcatgtctgcaatcccagctacgtgggaggctgaggtggcaggactgcttgagcataggaggttgaggctgcagtgagctatgattatgcctctgcacctctgcactccagcttagaaaacagagcaagaccctgtctcaaaataatataaaataaaaacccatcatttagaccaggaggcagcgcttgtggagaaggcgttcagctcagagcagcaacagctttcaagcatctaccaacagccaacacagcccctgaatccgtctgcacctgccccgtccctacgcatcctaataaattcacgagtgtcctggtaagccagaacctccgggatccaggcagccagaggacagttcttcccgcacttgtgggtagcaacagccgtcctgctacccaaaaagcccagttcttggagccaagagctgatgcgaccacagcctgcaaagtcttgagcagggacgaagctcatgatggcttctggcctctcttcattcaggagggaaggaacccaggtgcccgaactgccggaatttgccaagaaggagggcagattggtgcacctccagctatttcc

SEQ ID NO: 175426 - DNA, 342 bp, Homo sapiens
ctataatgatgatgaagaacacaccataagggacaggtgtggtggctcgtgtccagtaatcccagcactttggggaggccaaggcaggcagatcacttgagcccaggagtttgagaccagccttggcaacatggcaaaaccccatttgtacaaaacaaatacaaaaagttaactgggtgtggtggcgtgtgcctgtggtccctgataccagggaggctgaggtaggaggatctcttgaacctgggaaatctgaggctgcagtgagccaagatttcgccactgcactcaagcctgggtggcagaatgagaccctgtccctccctccccacaaatgcctgttct

SEQ ID NO: 175427 - DNA, 711 bp, Homo sapiens
cagatgtgatccacttaaaaaggttctgaaaactcaattcagtgaagtgtgtttgggctcagtgcattggacctgtgacttcctgtaatgtttacttaaccccctaacttctaagtggtacctcccccacctccctggaggggaaaaagatacgcaattggttttgcaggattatggagatcaaacaagcatctaacaaagactcttccttccaggtacctctttctctcttccctctcatcatagattaatcacttagttgcaagggaccagtaaattaacagaatggtgaacattttccttttcttgctgcttttgctggatgactagtggtttctgctggaacagagatgaaccatctcaaggttatgaaaattcctgactgtggcaaatgtgaaagagtgtctttttaattcctgggaaatactaagacttcttctctaaggtgcttatttgtaaagtaaaaaggtgaccttaatttccagtgctatgcagtgaacacaatttttgtggaaactagttctaggatttgaaatgaagactatatggtctctgttaatctgtattggtaaacgcactgcactttattgagagttctggtcgttaaccagcggaattactagtattatagaaatttattaaggatggcttattggagttgacttgtaatttcagtcatttctttgtaattacgaggtaaaagatgatttg

SEQ ID NO: 175428 - DNA, 373 bp, Homo sapiens
ctctagaggatctcagagtcatgtatcagaactgactaaaggttgggtggagagcatcttatagaagaggtaggatgtggatgggcttgagtgataagaaggattggatgaacaggaaggaacagtgagggcattcaagttcctctactacctacttatatcttactttccacttctcatctacatgagtcacacagctcagttaagtcaagctccttgttaatctttattttgaacctttcataggaaatgccctcactgttcctccctgttcatccaaatccttcttatcactcaaagcccaatccacatcctacctcttctataagatgctctccaacccaacctttatcagttctgtatacctagcctt

SEQ ID NO: 175429 - DNA, 857 bp, Homo sapiens
  misc_feature (818)..(818): n is a, c, g, or t
aggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtactttctgcagttgaggtatttttttccccaaaaaatgtaacgtgcaaactaaattttttagaacaaagtttttccagttttaagagtgcatattggtgacactatagaaatgagtaggatacacaagtttgtactaactagcatggctatgtatacgcggcaattacttcacgtctctaacaccgtcatggcgagtgncattccatcgccaggcccagccaagagttgtataaacat

SEQ ID NO: 175430 - DNA, 448 bp, Homo sapiens
caattagagtaataatgcctactttgcagggtggtggttgtaaagattagagatgtcaaaaagtgccccacatggagtaggtactggataaatggcagctatttctaatatgagagcttgcacctcccatcctggatcccagccctccaatccaatatttctcaaactaagagcgtgcccacgaatcacccagagagcttgttaacatgcaaatacccatcccactcctcagggtggagcccggacacctgcagattgaacagcttccaagcaggtgattccaatgcaggcagctgggtctgcctcctgggaaaagagctagcccagggcagtcctgcaactgggtccatttcagaagccattcccctacagatggagggtgctggcagggaggtgaggtcttgcctatcccaccaacttgctaccttcacgtgggggtctgtcccgg

SEQ ID NO: 175431 - DNA, 167 bp, Homo sapiens
ctcccaaagtgctgggattacaggcatcagccaccgcgcccggccacctgttttatctgtgttctgaaggagagtgcctggctagggatatgcccacttcccatggctctgagccaatccttgtagctcctgtcatacctattgtagcatataatcccactttacac

SEQ ID NO: 175432 - DNA, 139 bp, Homo sapiens
gtggtggcacacaactgaggtcccagctactcaggaagctgagttgggaggattgcttgaacctgggaggtcgaggctgcagtgagccatgatcacgccattgtactccagtttgggtgacacagcaagaccatgtctc

SEQ ID NO: 175433 - DNA, 585 bp, Homo sapiens
acttgctttccctcacatggatgacctgtaaataattgtgtcttttccttagtgaatgatgacaggtccctatctatcaaattgcactacataaatgagatagaagccattgaatttagaaacagatgaaattaatctaatgattcattgtttttcattttcttgggcttctctcttgaatgtagaacagtttcttttgcagaattgcacagttagatttgaatagttcaaaatatgacctttcttaaagcacatgatcaagtgatgtccagatactttgagaactgcatgaacaattcaattttgatcatgcttatgggtcactagatagtacgacataaagaccgaggtctgggcagggtacattgctcgtatatccatgttttatggctttggcagcagtaagtagaggagagtatctgtgtatgtatgcatatgtgtgtgtacatgtgtgtgagtcctcatccccatgcaatcattctgttacctttctgcttccaatgagttgtctaagtatcctttctcttctgtcttcaactaggacttctttcaaacataaataatgagtagtctctgtctcacaga

SEQ ID NO: 175434 - DNA, 571 bp, Homo sapiens
gatgatattagtgcagctagtcgggtgtaattgcccttgcttaggtgatgtgagtggtagggactgaaacaaactgggaaacacatgcctcttcaaaaggagttagctgcttctcagctgaagctgatgattgccctgcagtaatgcaagtccattgttgcttgatactctgttttgcaaataaaagccagaaatttatatttgtatatgaattttcctgacttttaagtgttggctcaagattttaaaaaaacaatgcacaggccagatttggcctctgggagaccaatatacaacttttaatttagttataactatgctgtgcactgtcatatattgggaacttagcatatagttccttaccacaggaactttttcatatttgacactgaaaagtagaagtttccaaactttctcaatttataacacttatactgtctttaatttttcacggtactcctaagtcaagaaatacctcatagttctctgtattaagtagcaaggtccaaatagctaagtaagttttgttttttttattgtttttgtttttgttttgagaaggagtctcgct

SEQ ID NO: 175435 - DNA, 577 bp, Homo sapiens
aagttatatgctgtatttgtggcctacatggtcagtgatcaaagaaaatttataaaaatattaggaagatgggtaaattattcctttgaaaactttaattgtggtaaaatacacataaaatttaccatgttaaccacttttaagtatacagtttagtggcattaagtacattcacattgttgtggaaccagtccatctccagaactttgtcaccttgcagaactgaaactccatatccattaaacaataactctccattccccctcctccagcccctggaagccaccattctactttctatgtatttgactaccgtaggtacctctcataagtggaattagacaggatttgtccttttgtgactggcatatgtcacttagcataatgtcttcagagttcatccatgttgtagcatgtgtcagaatttcctgcctctttaaggctgaataatagtccattttatatatgtaccacattttgtttatgcattcatttgttgacggatgcttggtttgcttctaccttttggtcattgtgagtaatgctgctataaaaaacatgagtctacaaatatctt

SEQ ID NO: 175436 - DNA, 357 bp, Homo sapiens
agtaagttgataccatgacacccactgccagtcacatatattgcaaataatagttccttgaggaaaggtgccctggataagaaataacctgcctacagacaaaaagtaggagactggaggaacaggtgctaccgctcctttctttctcagttgggccccaataaaaaggcctctgctttaaagagttaaggccagggtttagcactctttcttcaaaggtcaaataaatattttaggtttagcaggccagatgatctctgtcaaaactactcaactctgacactgcagcacaaaaacagctaataaaaacacattaataaattagcttggctgcattctaataaaatcttatttaca

SEQ ID NO: 175437 - DNA, 407 bp, Homo sapiens
gctaagctatgagtatgcaaaggtatacagaatggtataatggacactggagactcacaagtgaaggaggggagagggattaaaaagactacatattgagtacagtgtacactactcaggtgaccagtgcactaaaatctcagacttcaccattatacaactcatccatgtaatcaaaaaccacttgcattccaaaagctattgaaataaaaaatatatattaaaaacatattaattaattagcagtcaggtgcagtagctcatgcctgtaatcccagcactttggaaggctgaggcaggtggattgcttgtcaccagaagttagagaccagcctgggaaataatatgagacaccatctctactaaaagtaaaaattaaaagattagtcaggcatggtgatgtgtac

SEQ ID NO: 175438 - DNA, 212 bp, Homo sapiens
atttcatctgtaatcccagcacctggcacacagatgctcagtaaacacttgctgaatgaataactgaagaaaggaactgacttcagtctggtgactatgacaatcatagaagcaaataattacaatccggaaaacgaagagcaaggagcatgggtaaagcccacagctgcctgggcgcacagaggagtgggcaatggctctcctgcaaggaa

SEQ ID NO: 175439 - DNA, 623 bp, Homo sapiens
gcagaggtgtaggatgggccaagggaactaacaaggaatgggagccacctaaaaggctagcaacaagggcaagcaggtactacccctgggcctcaagggcacaaagtgagggcacatagttacctgaacctggtaagaactggaaccacagagaaggcccccccaccccccaagccagggctggagtcacacagagggaagcagtgactgccacagaagttgcccagaagtgggagagagaaaggaaggaacgcccacgctctcttttctgtcatctcccacaggggagggaggaagtagaaaagggaagaggatgaatcaagaagcacaaataaagaatccccaggacaagtgggaaagtcacgctctccacatgacagcattagcattgtctctaaacatgtctaggcacacgcatgtacacacgcccctcctaccaaaaaagaaggccaactttgtatttttaaaatattatcctggaagcagtgtggtgtagtttaagacacaattatatgtttggtgatatatcctatcagtaaaaaaatttaaaaatcaggcaatccaaaatttgcatatttattaatgtataaattgtatatggcaagcttgtccaaccagtggcc

SEQ ID NO: 175440 - DNA, 162 bp, Homo sapiens
acatacatcagctcacccaatgttgacaactagtagatttatatattttttatgttgcctatccttttttgggtaaggattaacagaatgtataatcacctacattataggtacactactaatcacttgctacttgaaaaaacctaaagctttgaaatcttt

SEQ ID NO: 175441 - DNA, 137 bp, Homo sapiens
agactacatagggagttaggattgaaatatgacaaacgaatctttgtacccttataaattaattctggtcttttaaatttggcatagtcatttttttcctaggatattggtttctaacatggttagcacaaaatgaa

SEQ ID NO: 175442 - DNA, 541 bp, Homo sapiens
acaactttctaagaattactaaggctataaatcaaatggaaatgacacaaaatatttatgtgaacatttgtttacataaacatgcttatgtaaatataaatacatttatagccctagtttggaattccagtgaaatgctagtctctgtactcaagaaatacctcatgggatgaaagcattcattgatttacaaatgaaaatttaacatcagttatcagtctttacgaagagtcagtgttgagaaactcatagttgtatgtgtagaagagtctaagaattacaatctgaatgcagaggtgaaacctgaataaaatcaatcagaacttcaaaatgatcatggaagagagttctttcctattcttagaacctggtatctgagctccccatctatgttccacttactcctcagcaacaccacttggattgcacaagcatttcaaatctaccacttctaaaactggactcccaattcttattcttccaaacctctccaactccagtaactgcatgccctgactttatgctagttacatacttagta

SEQ ID NO: 175443 - DNA, 240 bp, Homo sapiens
ttagttctaattccctcatttaacattcaagaaaaccaaggactgtatcttacctcctcctagttttctgatgaacacatgacgcttactcaattctacttaataatattccaaatccttcataagtctccagattcatccttgttattaaatattcaacagtagtatgttaactctgacaaccaccaggccttgctaaaaggcaaaaatagtaccatttcctatttattcaaagtaata

SEQ ID NO: 175444 - DNA, 385 bp, Homo sapiens
aaatagatcctccaacatgaaggaaaaaataacattttcaacagaaacagaattctgcaccagcagactttcattaaaagaaatacggtttattaaactagacatgttgttaataaaatgtcttatcaaaaaaattattaaactagatattgttattaaataagtgtgatcggttaaaaaaaagacagcaacaacaacaaaaaggactcttcagagtaatataaatgcagaaagaattgaagagtaaaggtacaggataaaaaaaaaaaaagatgggtaaagataaatcaatattgaccacacagaacaattaaatacagtgttgtggtgtttaaaatacgtagaattaaaatgcatgggagcaatcatgcaagaggtgggctgg

SEQ ID NO: 175445 - DNA, 454 bp, Homo sapiens
ccatttccaccacaaatgtaacatgtttcgtttctctacatcctcaccaatacttgttatcatctgtctttttgattctaggcattctggtggatactaaatggtacctcattgtggttgtgatttgctctaataactgaaaatgttaaacatcttcatgtgcttattggcctcaatttatttttgacgcaattcagagaaaggtaaggaagatgcctttcaaccaatggaaaatgccatcccaccaactgcttgctgtcaagctgacttacaaatctctacctgtgcaattgttacagaaccaccttttccatattatgttatttagtgcatggcaaattattcactttacttactactacaaattacaaacatcttcatcgtatgtttccaggaaaggaaaaagctgaagtactcctaattaccaaagtcagagcacctagttgggagggca

SEQ ID NO: 175446 - DNA, 549 bp, Homo sapiens
gtaagcaaaatccatgtgtcacctgggatgctctcggttcaagtaagggaagacccaactcagaacaatgagaaaataaagaaataagttagtataaatactggagatccagaagtagtgtatttccagacaatcagcgaccagtgaacttcactggaacctcatattgtttctgactttctgctctgtcatctgtggatcagatttagctttagagtggttctccttagtatggcaagatgcagcaacatgaagtgttgcatcgagaccaggagaaaaaggagtagaccaattcgggcccttgagcttgtcttaatctgtgttgtgctgctgtaacagattaccacagactgagtaatttataaggcacagaaatttattgtcttatggttttggaggctgggaagtcaaagatggaggggctggcgtctggtgagggctttcttgctctgtccttccatagcgaaaggtggaagagcaaagagagagggcaaaacaaatacacacacacacacacacacacatgcacaaaagagggccaaactagtc

SEQ ID NO: 175447 - DNA, 556 bp, Homo sapiens
ttgacctggagaggtaaagcacctccaccaccactacaatggcaaggttgggttaccccagtattaatgttgggcaagattactgtggaaaggaacattagttggggcaacgtaaactttacttgagcaaatgatgctcccccttactccccacctcctttctttttcttaaaattaactttatcttggaattatttttttaacctagaaataatgaagtgtatataccagaaatgtaaccatctcagaaaaccttcagcttctctaccactgagatatgtggatcacaaagtgaggatcctcatatttatttgcctctaaagagaatagggttaagcagttgctgtcttgtagttaaggaatccttatagcagtcaggcagcatgtgacttaactcactttaccagggctagggttctttatggaggtttgaaggcaagtttacagttagaagcgttcatttctcaggctgtattctgaattcacatatcttttgaccatttcaaaatgctgagagtgacaatgcagactttgggtgttctgaactgcgggtcct

SEQ ID NO: 175448 - DNA, 427 bp, Homo sapiens
atgggtggatatgcaagcttggatttcagcctgaccagccatcgctgggattttataagaaggtttgctggtcacctccaactgtgcttgtggatggctaagctaatgatgtccaggagtcaagatcaggcatacctggatgttacagattctagcatgcattccagatttctaaaagtgattcagttatcaccagcctcactactgaattaaaaaatgctaaaaatccatgttctggggcccctattgaagtctcctcaaatagaatctctagagttgggtccaggagtctgaattttaaatatttaaacagtctcagtctagctgtgttatcttgggcaagttctaaactctctgtgcctccgttttctcatctgtaaagtggaaatacggtccttatttcctaggattattttaaggattaaat

SEQ ID NO: 175449 - DNA, 1041 bp, Homo sapiens
ggctagtagggcggggtgaatcggccgaggcctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacaaagaaaccaagagcaattcctgtgactgtctgaggctgtccaggcaggccagcagccaggatgagttgcctctaactgagttggagtggttcaggggatagtgtcaggctggactctggcggaaagggcggtctgaggtggccaagcccaaccgggttctgccggttgctggcaggaaccctaggtgtccaggcctctttgcgccgggctttaggaggaaactggtccaacgccttgcctcctcgcttactcccggccggcgcctcggg

SEQ ID NO: 175450 - DNA, 2700 bp, Homo sapiens
cctcacccccggtctggcagcagcagaccatcctcatgctgaaggagcagaaccgactcctcacccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctgacaaccagcagttcagatccgggatgctccccagagaagtgctctcaagagcacacatgcggccggcgcagcggctcacacctgtcaccccagcactgtgggaggccgacgcagacggagaggccgggcgcggtggctcacacctgtcatcccagcactgtgggaggcc

SEQ ID NO: 175451 - DNA, 2742 bp, Homo sapiens
  misc_feature (1)..(1): n is a, c, g, or t
naacctaggctaggtacgaggccgggtggttaatcggccgaggcgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatgaaaaaaaa

SEQ ID NO: 175452 - DNA, 2506 bp, Homo sapiens
  misc_feature (1)..(1): n is a, c, g, or t
naacctaggctaggtacgaggccgggtggttaatcggccgaggcgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaaaaacaccaccggcccagattgggggccaagcccggaaagaacacaacagggggggggtaaccgggaccaccaaggccgggttcaacggacggggacccccaaaaaaaaactcgcttcgggga

SEQ ID NO: 175453 - DNA, 546 bp, Homo sapiens
cccggggggggcgggggaaaaaaccttttaaactttttcccggggtttcgaacccaacgcgttccgcccacgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatgaaaaaaaa

SEQ ID NO: 175454 - DNA, 2664 bp, Homo sapiens
  misc_feature (1)..(1): n is a, c, g, or t
naacctaggctaggtacgaggccgggtggttaatcggccgaggcgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcatgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctgacaaccagcagttcagatccgggatgctccccagagaagtgctctcaagagcacacatgcggccggcgcagcggctcacacctgtcaccccagcactgtgggaggccgacgcagacggagaggccgggcgcggtggctcacacctgtcatcccagcactgtgggaggcc

SEQ ID NO: 175455 - DNA, 2707 bp, Homo sapiens
  misc_feature (1)..(1): n is a, c, g, or t
naacctaggctaggtacgaggccgggtggttaatcggccgaggcgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctgacaaccagcagttcagatccgggatgctccccagagaagtgctctcaagagcacacatgcggccggcgcagcggctcacacctgtcaccccagcactgtgggaggccgacgcagacggagaggccgggcgcggtggctcacacctgtcatcccagcactgtgggaggcc

SEQ ID NO: 175456 - DNA, 2408 bp, Homo sapiens
  misc_feature (1)..(1): n is a, c, g, or t
naacctaggctaggtacgaggccgggtggttaatcggccgaggcgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctgacaaccagcagttcagatccgggatgctccccagagaagtgctctcaagagcacacatgcggccggcgcagcggctcacacctgtcaccccagcactgtgggaggccgacgcagacggagaggccgggcgcggtggctcacacctgtcatcccagcactgtgggaggcc

SEQ ID NO: 175457 - DNA, 1194 bp, Homo sapiens
ggcacgaggcctcgtgccgattcggcacgaggcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctgacaaccagcagttcagatccgggatgctccccagagaagtgctctcaagagcacacatgcggccggcgcagcggctcacacctgtcaccccagcactgtgggaggccgacgcagacggagaggccgggcgcggtggctcacacctgtcatcccagcactgtgggaggcc

SEQ ID NO: 175458 - DNA, 688 bp, Homo sapiens
ggcgtggcttattaatatcttacctaaaaccgcatagctagtgagaagtagagctgggattagaacatggctccagccgaatgtggtggctcatgcctgtaatgccaacacttgggatgctgaggcaggtggatcacttgaggtcgggagttcgagaccagggtggccaacatgatgagacccccgtctctactaaaagtacaaaaattagttgggattacaggcgtgcgccaccacacccggctaattttgtacttttagtatagacagggtttctccatgttggtcaggttggtctcgaactcctgagctcaggtgacctgtcagcctcggcctcccagggtgctgggattgcaggcgtgagccaccgcacctggccccaagcacttatttaaaacaggacaaaatataaaaagaaaatagtctcttctgtgaacaaatgtctcccctgacattaagaaagaaacagaactcaccttgactagtatgagtgtgctgccttgaaaaagaaatttcaccacagaagttactaaatatgacaggctctttacctagaatgatggctggttggcaccttgaaataataaggtcctgttttaaaccatacttgataacttggaagagactagatggacaggaccctcctgctggggtatagggcaaatgaactacagtcatggcagagtca

SEQ ID NO: 175459 - DNA, 497 bp, Homo sapiens
caaagttgggaaacagtaatccaagggggaccccagccccagaggaaggggcctggaggcttaggggttacagccgcaggaagatacctctgctggtcccctttggtcatttgcctccagagttagtctcctgctgaccctttgccgcctccaagtctctgcgacactcctcctaatctccccctccactcctcagtgagatggagaagctgagagctgcaacagggtgggactcagtccagctggtgggagccccgataccagccgtgggagggagggctgttcctggctctgctcacggattctggccaactggctggaggagggaaggcggcctcaccctcttccccacaggcccctccttccctgggtcaggggtcctggctgagactataatttattcccgtcataatccagtggttggtttggtgagagctggaaacatgttggttttcccttcccaagtataacaaggcctgtttccgcctccgcggccg

SEQ ID NO: 175460 - DNA, 633 bp, Homo sapiens
ggaggcagaatgtaaggaggagctgctgaaagatgacagttctgaacatggcagcgcaccgcccaacagcaaagagaagatgctcaggagacattgccacttcactggtgacgcgggcattgaagtgcgtatgtcagggccaccatgatcatagccttaaagagttcaacatgctcatcgctgatgcactggatgggcccctggacttctgcgacagctgccatgtgcagcctcctggtgatgaggaggaaggcctcttccagccctccaaggagcaggcttgacagcctgggcacctgcacctgccacagctacctgcatgcctgctgctaaacatcatcaatgagcagtactctcccaactcccagagcagcagctcccgcagctagatcaggctctgccagcacccaagaacttggcaaagcaaccagggtaggggagaaccacgagagaagcattaaatgactttcagagaaagtggtacagccacttgattcctttttttttttttctttctcctctcctgcattttcctccatctccaggtacagtttggggtgtggatgcctctcgccctacaaaggcacaatgttgtggagggctgagaagttggttctgtttctcgttcctcat

SEQ ID NO: 175461 - DNA, 708 bp, Homo sapiens
gaaagagacgggcccaaaataaaagaaaggaggtaccagattccactgaagtcaaatgagaaggtgaatacaggtaagcaggttaaaaggtcagatctctgtgccaggtgagaggagggagggggatctccctggcacagggtgggggcagttaccactccctgtcccctcatgcagaacactggcccagatgaatcaaaggatatttcctgaagacctgaagtgctccagaggaaaaacctctccagtgagtcttctggagattcccccaattaagtggtcaatggccaatcagaccctctaatgcaaaggagggtggataaccaagcctccccacccatggttgcaggcagctctaagtgtcgtgctcttaaacacgagcccagcaccaaggaacccctggacccagggaagcatccagtatgaatgaatccaaaacacacagaaatgaatggccctctgcagggccacagacataaggcaagggaagagaagatacccaacagagaaaccctgtgtgctatgaaaagagaacacagaaaaacaaagagatatttgaaattctaaaatacaactatgaaaataaaattcaggccgggtgcagtggctcaagcctgtaatcccagcactttgggaggccgaggcaggcggaccacgaggtcaggaaatcgagaccatcctggctaacacggtgaaatcccatttcta

SEQ ID NO: 175462 - DNA, 561 bp, Homo sapiens
cctgtctctactgaaaatacaaaaaattagcggggtgtgatgccacgtgcctgtaatccagctacttgtgaggctgaggcaggagaattgcttgtacccgggaggtgaaggttgcagtgagccgagatggtgccactgcactccagcctgggcaacagagcaaggccctgtttcagaaacaaaaaacaaaccccaaaattagctgagcctggtggcgcacgcctgtagtcccaagtagctgggactatggtgcaggagtttgaagtgggaggatcgcctgagcctgggaagctgaggctgcagtaagctgtgatggcaccactgcactccagccagggtgacagagcaagacccgaccctctctcaaaaaataaaaacaaacaaacaatggttataaatacagtgaaagaaaagaacaagaggtttttgagaaactaaagggagttggaagcatcatctggattggattggatatgattcctgaggaaatgatatgtaagccaaaatctgaagagttcggggaaaggatatgctaggcagagggaaacgtagggcaaatgt

SEQ ID NO: 175463 - DNA, 542 bp, Homo sapiens
ttataagggatgccacaactattttgcaaacatgaaagcagaggtaataacaaaacagaaagtacaggaagaacttggccctctacagtattatccagccactgaattaaccacctttgcaagctctgccatatttagcctttatacacacacacacacacacacacacacacacacacaatttatttttgataacacctttttcttgtttattttgtttggataagaaatttttgttaaatcagttgttagcctcttaactgatacagaaaccaaatggaatcagaagtagctaggtaaatggcaaaatcagagaaagggaatttaaatgattcaaatgcttattggcattagaaaaacgtggtcagcagccacatctcatcctttgaatgtgaactgtggaatcgcagtagttgaagctgggagtcacagtaattcttcccacagtggttctcaggctttagcatgtgccacaatcacctgaagttgagttgtgagatttcaggcttctcttctgacatggacctctcaattttctctga

SEQ ID NO: 175464 - DNA, 521 bp, Homo sapiens
aagcgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcagcgtggcgatcttggagagcttgcgcaccgacgggctgtgcgcgtaggggatgacggctcgcagcccgtccagcgcgtcgtttaggtcgtgcatgcgccgccgctcgcgcgcgttgatgctgagccgcagagaccgctgctctcgcggccg

SEQ ID NO: 175465 - DNA, 356 bp, Homo sapiens
tgtgtgtacttttcaaatgggatgtgaacgtataatattggcattcaatccagtatataattatagaatttggaagacttaggacattttagtcagtgaatctatatttagacttttcaaagacatggcacgtaaggacacgtggagaaaatgtcccacacagataacaggatttgtgattttggctttgctgttttatgattagcaaatattgtttgtatagagtgtctgggtgccctaaaaacacatgaaaataggtcaactaaatctcgttttaaagagaaaaccggaagagtgaacaccactctaaaaatagattttggatgtgtttgttttggtgccttgtatatcttaaa

SEQ ID NO: 175466 - DNA, 144 bp, Homo sapiens
ggaacaggtttatttctcagattcggggaatacttgttgagattcttctctctttggccaaatgattttgatatgataatcatgatgccctttcagttgaggtattatttggtagcattttgtttattaaagcaagcatgccat

SEQ ID NO: 175467 - DNA, 303 bp, Homo sapiens
ctcccaaagtgctgggattacaggcgtgagtgcccggccagtttttagaaatttatcagcaacatgggattgccagaaacaaagatgtgcttttcttcaaggcatttgatctttattgccaaattgctcattagaaatggaaacagcttctagcaaggtataatctttaggactatgtaaaattttttaaccaataaaagcttgtgaggtttttgatatttataagtgcagattggtagatatatttcgagtaatatcacctgtcagagtcattatttcattcagggctcttttttttagcaa

SEQ ID NO: 175468 - DNA, 174 bp, Homo sapiens
agttaatattcttactatataaagagcttttgcaaatcaataaacaaaccacagaaaaatggacaaaattcacagagaaggaaataaatggccaagaagcatcgggaagaaatggtctacttcatcaacatctggaggaatgcaaattggagctaagaagggtacaataaaatg

SEQ ID NO: 175469 - DNA, 697 bp, Homo sapiens
  misc_feature (599)..(599): n is a, c, g, or t
gagctcaccggcctcacccaagctcgcagcattgtgccgggaaaggatgttctcggctccggcctttttcctcctctcctggggacagaacatggatcctggaaggcattgaggaccctgtgctcagcccctgcccatcccttccaccacttatctgtcctgtaggcacactgacgcggctttcacaaaatgggaggctctgagaggtgagctcccaggagacaggaccaaggtctgccttcatcctgaagtttgcagggcagaggcccagatcctgcaaaggtgatgtgctcaggaagccacagcggagccccacacgcaccatgtgagtcacgctggtgccacaggcttgaactctgctggacacaaacagcctggggggtgtggaagtgggcattaccgctgtgctggttcttactatggggcagtgtctccaatatccctttcccattcagcaactgtgcaacacctgacttcagaaacagacgtctagagccctgccgtgatggagccaggaccagcttgcctggtggatctgtgccctggggacccgcttgggctctagcacagcatgctgcgtagagtcaagcacacatganggtggccccactgccctgcaaccacagatgcagccccagctcaccattgacatctgtccccagtcagacctctttacgcagcattctagcctctcgtt

SEQ ID NO: 175470 - DNA, 403 bp, Homo sapiens
aaacaaaacaaaaacacattaagatagggtattagattggtcatacaccctattttaatagagatcatgatgatagaaggttagaagggagttaggtggtagaaatggggaagaaatgacctggccagtagatggaagacaagagagtggtcatgtgtgtttagccagatggtacccaaagtagtcagaattttggtcatacatatcctgtcttacaaggctgatagaatatgaagcaaaaatggggcatgagacaagccaatattacctctgtgctaaggagagtgaatatcttcaaaggaagtgcaatgtttttgaggaataagaatatgtggggaaggagagggaagtgtgaagtttaagttgtttggcatagagggggagctcagagggtatgttagaa

SEQ ID NO: 175471 - DNA, 505 bp, Homo sapiens
tacagcatgttacagtactgtaggaaactgtaacacagtgttaagtatttgtgtatctgaacgtatctgcaacacagaaaagaggcagtaaaaataccaccttctatcttatgggaccatcattatataagtggtctattgttgacagaaatcttgttatgtggcacatgcctaaatttaaaaatacaaaaccattcttagttcgtggaccacacaaaagcaggtgtagtttgcagaacactgcgctagtactaactagaaagtatccgcaatgtctcctgtagaaaggtgtcttactcaagctcagggtctaaatgaagaatatcctccctgacttacctacaactcccgtctaacacacctcagctttctgctaacttgttctcgtctctcttctctccctgcacacagctcatgaatggccaatcaacttgacttgaaagtggttaaaatctacctcactctgcaaaactaagtgagtcacatgagaactctgaagagaggc

SEQ ID NO: 175472 - DNA, 467 bp, Homo sapiens
ctgatactgtataagtcgggaaacactctcatcccttgaacatagctctgggtgacatcgtccattcaataccggtcccaggtggtcaccacctgcaggaggagacccagccaccagccctcaccatgtttctgcttggaaccagcaataatcacttaagattgtgagtgacatgtggatgaaatggaaactgctaagatacctggctctttggcctagtttggtctcccagtggggtggtttcaagggtaaggatgtgcctctcccaccgtgggatgagcagaccatcaccgcagagcaatcagccctgcccaagggcagcagcccttctgaaagtggcccttcctgcacacgcccccactttagcaaactcaggcaggagggtgtgaaagggctggaaattcagagtgagcaactggaaggggagacagatggagggacaatttcccaagaggccgacttggggc

SEQ ID NO: 175473 - DNA, 593 bp, Homo sapiens
aagcccagctgattgagtgcaggagacctatttatgcagagaaaaatatagaaaatagagttaatgattacagtgaataggagagtgagagaaggtaagagagttaaagacatacatttcacagaaaaatttttatttttctatgagagccaaaggacttatataatccaaaatgaatgttaaaggtatgataaacagcaaaatgaaagcagacaaacctaggtagaatccaggttactttgacaagtaaaataaactcactgatttccattttttttttgataaaatataactattatatcacgtagttattatgatataactattatatcacatagattaaatacaataagccaaacctttggcatatgacaggtggctaataataagttgttattataggtattgtatagcatttagcactaacagacaatgaatattttctgactttcataagaacattttttgttgttgttcaaacttttattaaggtagatttattctgggtagtttagcttgtacattcactcaaacaaacttcccaaaagacaacattaaaaatgaaaacacatattcttaaaactgttactaca

SEQ ID NO: 175474 - DNA, 371 bp, Homo sapiens
aaccatgtgcaaagccttgcacaggcatccctcccatgaaagccttccttgaccttccctccaaacattgtcaaaatcatggccaagaaactggcatattttatcagtctattatatttgctgattgatatgattgtctccttctttaggctggattctcaaagacaggattcatacatttttcatttatttatatttagtttctggccttctagtacataagcaatgcatttctttgttaggataaacttcctccccaaacacattctcctcacagattttcagtaatttttattgagcttcagggacctcataaaatatgcctctgggtggagttagagggattataaaatgttaaagttggaatacac

SEQ ID NO: 175475 - DNA, 593 bp, Homo sapiens
ggagaatgtattttgacgggttttagcggcattgctggagtgccttatgtttcatgagaactgaaatatattagcattgaatttttctagcagatttctgtcaaatatttagaaggacatatggagtttctttcctaccattgaaaaggagaaaaatacatgaaatcaaggcatttggacaaactttcttgcttgctctggtagtttgatggaagcatttcttaaagccaagacagcatctgtaatacgacacagaggagtgatgagcggactgggagtctggattccacttggaacaggttttcttatagagcacatcctttctcgcttgtggtcattggcagctcagttctaggtgggctctggaagccttagaatgggcacttgtgctggacagatctccagctctgtggtgtggcttggtctttggctttccaaatcaatgcacttattctagttggtgtcagttggtagaggctgcagaatgacctgaggactccctgtcgttagactcctctcttcctgatctgttgttcactggtctgattgtgcactcagattctgtttcaccatcacttcccacagtccactgg

SEQ ID NO: 175476 - DNA, 630 bp, Homo sapiens
ggcactggcacatggagtgtctgtgaggggctgctttctgttgcatagacggagccttcatgctgtatctcacgtggtggaagtggcaagacagctctctggggcctctcttataagggttattactccattcatgaaggtggagccctcaagacctaatcacccccaaaggcttcaccttcagatactgtcacaatggtgattagatttcaatatgtaaattttgtgggagggcgggcacaaacattcagattgtagcaggctctgagggagaagtaggatgcacaggctttgggagcagcaagccagccagtgtaggccagtggagggtttgtaagtgggagttacacaaatcagggcagtggggagatgcagattgtgtagaacctcgcaggccattgtaatggttttagttttcccttgaaataacacaggaagctacagaaggggtgtaaaaggggatgtgagatgatataacctattttgatagcagtgttaagaataaccgaaaagataggatggtaggcagaatatagatcacaaaggcagaaggagaaagaagaaggtgtttccgtaatctgtgacaatgatggtgctggctcgttccaggttggtagcagtggaagtcat

SEQ ID NO: 175477 - DNA, 235 bp, Homo sapiens
aagaacactggctggaaattaggaggtctaggtcctaaggcctggtttttcaaccatttacctatgtgatgttaggaaatccactgtacctcaaggcacctcagattcaggacctataaagtgatagggttgacctagatactataaatcagttcaagtctcctggcccaggctaattagtgggccagtagtgggtttccctgagtgccaagggaacacaaagaagacctgggaa

SEQ ID NO: 175478 - DNA, 426 bp, Homo sapiens
cagctgtgataaactgtggttgaggaaactaataatttctttagaaggaaaaagagcacaggtaaaagctggaaagcagtgagattaggatgagtttagaaaacattctgttcctaaacaagcacactcataataaacagccaagtgcaagacaacaagggacaatgtcctagcaatggtgagcaatgtttaaccttgcttaagctctgggcagagaaaaatggaccctggcactgttctggttattgtgaacaatcacactccacaatgacagcatgtgctcattatatgacagaaaatatgctatggacttcaaatgaagtcagatttaagccacatcacattatcatccccatttaacagttgaattgatgcagagagtttcagtaacaagctcaaagtaatacagctactaagtgtgcttaa

SEQ ID NO: 175479 - DNA, 303 bp, Homo sapiens
ctcctcagagtaggagtagttgaaacacgaacacctcaaaacctgcgaatgacaatagccaggcagctggcagagatcttgttgcggggtatgtgtgagcagagctactggaaccctgtggaggatccaccgtgccagtcacctctggacgatcctctccgcaaaggagcaaacacaaaaacctacactctcactcggagagcacgtttgaaggagcaaacacctaaaatccagtacatttctaggtactgaggaataaaaaactgggaacatggtagaaacacagaaaaatggtgacaatct

SEQ ID NO: 175480 - DNA, 568 bp, Homo sapiens
atactgttttccataatgactgttccattttacattcccaccaatagtgcacaaagattccagtttctcagcatgctcaccaatacttgttattttttgttcttttgatagtggccaacctaacggatgcgaagtggtatctcgttgtggttttaaactgcatttccctaataatgaatgatgttgagcatcttctcattcaatagtcataaacaatagtgcttattgactattcatgtatcttctttggagaaatgcctattcacagccttgacccatttgtcaattgggttatttattgtcttgttgagttgtaggagttcctcaaatattctggatattaactccttataagatatatgatttacaaatatttattctcattccataggttgccttttcactttggtcattgcttcctttgacttgaagaaatttttaactttatatagtcctgtttgtctgcttttgctttagttgcctgtcctgttggtgtcatagtcgataaatcatctctcctttttccttaattagtcagtaaaattttgttaattttgtttatcttttc

SEQ ID NO: 175481 - DNA, 610 bp, Homo sapiens
ctcatctccgacttacccaaaaagcaatattgaagtagagggaacaaattagaaagacctcaatgccattagattagtgtttttcaaccctaagagttggagatgggtcatacatgcctgcgttttcccccatttttatgcatggagaaactagagctcagtgaggccaagtgatttgccagaggttctctagtgctgaggcttggtctgtcctccaaaaccttggcctgtctaccacttccctgccctgcttgtggtcccttgggacccttgagagctctccttcagggctagcgtagtctctggcacattgtacttaagacctcccgcctgctgattcccaggtactttccactatacttcaggaatttaccaagagggtgtatcaatcaggtaaacagaaatcatgccagatattttagcagagaggattgaatagcaggaattggttagacaggtgctggttgacccaaaaagcgaatggggagtactgaagtgatacagaaatagtaacaaaaggttagcagcaagccatcaccctcaaggctggaggagcaaaagaagtaatttggaggaagtaggaccaagaccctgttagtattgttacctc

SEQ ID NO: 175482 - DNA, 399 bp, Homo sapiens
attgtcattatatattttatttctacatgtactgtaatgcttatactacactgtttttatttttgttttgtcaatttttaaaaacaaacttaaataataagaatactattctataaattaacccaatgtattaaccatttcttgtgcccttcattcctttgtgtagattcttattttctttggatatcattttccttctgcctgaatgacttccttgaacatttctcacagtatgagtttgttgctgatgcagccctgcagcatttgtatgtctgaaagtctttatttcaccttcattttggaagacattttcactaggtaaagaattttaggttgacaggtttttagtttttgtgttttctaatacattaaagatgttgctcaaatgtcttcttactt

SEQ ID NO: 175483 - DNA, 229 bp, Homo sapiens
  misc_feature (20)..(20): n is a, c, g, or t
tgacatgatacgactcgagntggtacctgaaattcgtgtccccattattactcccacaaaggtcaatgacatcctaacggttatatccttgtcttagaaatcaccaatctaatttttctgtgatatctaacgctttctcaatactcctttttcccttggcttctaaaatactttcctctcagagctctcctaccacttaagccacttccgtcttttggacacgaatgtt

SEQ ID NO: 175484 - DNA, 324 bp, Homo sapiens
gaaccaattcagtgtaaaaggaaatacttgattactctgttgtataagagcaataaaagctaatttactgttatattactcagtactgaaagctgcaagaggctatctttcagttcattcttcattaattatgctgtatggtggtgatatcagtatgagttttatggaacgctttcaggttgacctctctgagcttgtattttggctcatgtgaatgtctttaccatattttcctcatgattgttgaggggtgaatgaagtgttgaaggcaaaatggactaatcaatcactgtgattcctctgtgaaaactcccatgataaact

SEQ ID NO: 175485 - DNA, 237 bp, Homo sapiens
atagctgctccatgatgtatccgcgagactagtagcagaccaaattacctggaagctcactgtaatccaggtgggaggtatgtgagccttggctggtgatggtggcattcccatgggaacaaagaagaggaagaaactagaacatttttttttttttgagacagggtctcactctgtcacctaggctggggtgcagtggcgcaatcacggctcactgcaacatctacctcgtgggct

SEQ ID NO: 175486 - DNA, 361 bp, Homo sapiens
tgacattttgtgttgaagaaaaatatttttaaaatatacaacaagcttccaaataagcttgtaacagtttacaacaggcttttcatctacaatgctggaaatgagaagactgtggaaaaactctacacgcttcagagggacaagctccgcaatctgaaacttctatagctagataagaaactactcacctctcagatgatagaaacttgcagatatgcaaggatgcagaagatgtattattggccaggcacagtggctcacgcctgtaatcccagcactttgggaggccaaagcaggcggatcacctaaggtcaggagttcgagaccagcctggccaacatggtgaaaccccgtctctact

SEQ ID NO: 175487 - DNA, 943 bp, Homo sapiens
tgcctgaagggtattttttgtagattccaatttctctaagagaccctctgaggttactaaggtgtctagctttctactctggttttcaggattctgagctagaccaagggaagtaacatgttcttcaacaatctctacttcctgtgacaaagtatttctggaaggcatcatttcaacaagaagctcactgctactaccactttgtttagaaatacttcctctgaaatctttaaacgtgcttcccacatttcgtaatccttttgaatcactattctttgctattgatttagaagttcttggttttgagtgaacattttttgttgccattgtacgtgattttttaggaaaaggttgttttgttaagatctgtacaaatcctccacgagcagccagattctgacgacggagatgtgttttgccaagataatgtgcattcaacaagttttcttctgaacactgaaaaccacaaagatcacaggaaaagaccttctgtggcccatgtgcttgtttgatatgcatatgtagtgctgagctgctctctgctttgtggctgcagtgacaacaggtatgttccttaggctgctgcatgtgagactcagcatgtttttccaagtcagagcaagaagaaaacaaatgcccacagatgctgcatttgagaactgtatctacattcccaatggtacaactaacactaatttctttcggggggaaaggagattctctttccagatcaagggaaaccatttcctgagcagatgttttttcagtgtctgttttcagagaaacaacatcaatagtgctaaaattgcaagaaggggagagggcatttgggagacatgtgcctccaactgtgcagtcactcagaaaggtctccttccctgtttcatctaatgcaatacccccttctgtgactgagctctcagaagtttctaatctacaaata

SEQ ID NO: 175488 - DNA, 438 bp, Homo sapiens
agtttggctactctgctgcagagaccacatggaaagtgctacatatggaggtcatgtaaagaggaagaagccctgaaactacatggagaaagagagaaactcagttcagcctcccagtgttccagctgagcccagcctagattgtggaatcatgagcaaactaatgagttaaccaattaggtaaagaagaaataaccaaatggtcccattccagaatgcccacccaagcccttcctctttctttaggatgctgtttctgaaagtctggcctgaagaccacctgtatcagaatgacctggggtgtttatttgaaagaaaaattgtcaatccaaccccagaatttcttgggcaaggcaggataatcagtatctttaacaaaacttttccaattgattcataaggaaaataaagtttaagaacctggttaagggctttctc

SEQ ID NO: 175489 - DNA, 619 bp, Homo sapiens
agaataggtctcgaaattgtatagatctcaaaacaatgatgcacccttgtagcttatattgtctttcctacctagttctgcagaattttattgcattctttttttctcttttagagatggggtctctctgtctccctggctggagtgcaacagaatgagactctgtctccaaaaaaacaaaacaaaacaaaatcctctggaaggttagggcatctatgtttgtaataagctcccaggggattctgattcacatcaaagttggaaagacatcgattttgctgactaaattggtcatcatttttgttcaactatcaccttccattcacctaagcctagatattactcagttctggtaaatactcaataaagatgcagccccactgtgtgttcacataagctcactggaaagactataaatgtgattttaaaaagctctttatgatttgctggtagaaagaaatattctgaaaccatcttttcatgtcattttcttagaggcaacacagtataatggattgattagcatcttacaaactgacaggttaaaagatagttttaaatctttattgataaactgtcatttgactgcaagcattttaaactttaagaatctctgttt

SEQ ID NO: 175490 - DNA, 445 bp, Homo sapiens
aggaacatgaggcctttaaactttcggtatgaggcataagatgaaacaatctgctggacgcggtggctcacgcctgtaatcgcagcacttcgggaggccaaggcaggcggatcacgaggtcaggaaatcgagaccatcctggccaacacgatgaaaccccgtctctactaaaaatacaaaaattagctgggcatggtggcgcatgcctgtagtcccagctactcgggaggctgaggcaggataattgcttgatccagggagttggaggttgcggtgagccgagatcgcacactgcactccagcctggcaagagagtgagactctgtctcaaaaaaaaagatgaaacaatcatcagattttgtacacaggctgaaaggaaggggtggtcattaaatggcgcaacatccatatggcctgagaagagggtctcactcccaccaccgtg

SEQ ID NO: 175491 - DNA, 114 bp, Homo sapiens
tacacctttcccttgtgttcagactctcactaacaataaactcctcagcaagccagctgatggggccctccacagcttggcttcagcaagtgttgctcatgttgtttcctttgc

SEQ ID NO: 175492 - DNA, 270 bp, Homo sapiens
ttcgggtcattgctgccgagttatctaaaacaaatgtttgcagaaggcgttacagataaaaaaacaaagcaaaacctatctatgtcctagagcagtggtctcaatggggacagggagagtgatttgtgtcctccaggggacatttggtatcgtctggagatatttttggttgttctatctggcaggcaggggtggggtgctactggcattttgtgaacagatcctatggtgcacaggatagccccccactcccctgccccaccacacaca

SEQ ID NO: 175493 - DNA, 876 bp, Homo sapiens
cattggccgtggcacgttcagtgaggtccaggatcacatgctgattgggacccaaatggccatcaaaatcatccccaaggctggctcccttggcatcactctccagagagtgataagtattttaaagttactctgtcacttcaatattgtacggttgtatcaagtgattgacacccccaacaccagttatttatttagtaacggagtatgcaagaggaggacacccacgcaaccaatacaccaccatggcctcatgagggaggagaaggcctagaccatgttcaggcagattctgtcggccatgcagtagtgccatagcaaattgcgcagagacctgaacccagaaaacatcatccttgatgaggacggtaacgttaagatcgcagacttcggctttggtaccacattccatgatgggcagaagctgacagccctttgtagcacttaacccctacatggccctggaacgtttcctaggccagggctaccaatgtgccaccatggatattcagagcctcagagtaattttataccacatggtggctggggttctgcccttctgctcatgcagcattagggtcctctcagcaaaaatttaaagtggaagctatttttccccagtctacttttcctgaggtcttaaaagcctcattaaaaaactattaacagtagaccccagggagcagaccacactagaagaagtatgagggacccgtgggtgaacagtggtcaggagttgcctctgacaacatgaagaacaaatcctggaccacctgaatcccaaaacaacccagcttttggtggccatgggattccaggctgagaacctatctgtggcaatcaaagaaaaattattcagttatcccatggccacct

SEQ ID NO: 175494 - DNA, 370 bp, Homo sapiens
ccactcagcggcacgagtcagaggccaggcgtgagtcagggctccccaccccaagcccgcagctcagctcccccaggccctgggaagctctatctgccccacctccatcccgggctgggtgtgagagccgcagtggggctcggaagcacaggcaccggtttcgtcctccgtgagagtggcttccccaaccaccccaggggccactgcgtgtcactgttttcacagatgtggctatgcgagtggggatgcctagcacctccaggctccattagcggccttcccagaccctcacccgtgggtggacaacggccttgagacatagacagcttttagagccacaagctgggtaggggggcacatgggcttggtc

SEQ ID NO: 175495 - DNA, 184 bp, Homo sapiens
cgtgggtgcctagaggatccccgtacgctcagccacttccctcgctgccaagttaggtcttcttccaataatataagatgctagaagacttagatcttgatcttatttctactttaaggttcgatagtccctcttaatgatttcctgtttagcttaatgcttgcgatgagacggggcttcatga

SEQ ID NO: 175496 - DNA, 347 bp, Homo sapiens
ttgtatttttgatagagacagtttcaccatgttgcccaggcttgtctccaactcctgagctaaagcaacccaccggcctctgcctcccaaagtgctgggagccactgccaccactcccagcccccttcctttcttaagcactgttagggattgtgtctagctacctaaagaacatagactgactcttcccttaagccacttccctcgctgccaagttaggtcttcttccaataatataagatgctagaagacttagatcttgatcttatttctactttaaggttcgatagtccctcttaatgatttcctgtttagcttaatgcttgcgatgagacggggcttcatga

SEQ ID NO: 175497 - DNA, 397 bp, Homo sapiens
tcactaactttttagcatggctcccttcatggcatccatcagaagaaagcaaagcaattaaagaagttattcattaatcaaaagcctctatcagtttcctggataaaaaggaggataagcacattaatttaaaaaattaactttatatggaatgaagtccacaggttctcgaaatttaaagagaactaggttatctggaaatgcagataaaaatacaaatattttaagaaatgaaagcagtgttaaagacagattcttatctattgaggctcaaaaagtggcagaggacatgctggtagatgtgcctggctaaagctggacacgaacaggaggtgtttcatcatttgtactaacactatcggtctgctcctcctaagtggtaggacttgggcacaag

SEQ ID NO: 175498 - DNA, 627 bp, Homo sapiens
ggctatttaagggtattgtggacaggggtgtggtgtcctgcgactgagggtgtggaagtatcctaaacagcggggttaactacagatgggggacaggcaggcaaggtgcttccctggaagctgcttgtgttttcatgaaggcattaactttggagtggagggtacggatttaaggacagatttagggacatgcagggagtggagggtacagatttagggacaggcaggcaaggtgcttgcctggaagctgcttgtgttttcatgaaggcattaactgtggagctgggcaggaggtgcgggcctgctccctattcacccagcacaaacttctaagaaacctttggcagcctccctcccctgccactgccacacctgcctgcaggccacacctccccctgagtttcaggcccaagttctgcctggacatcccctcagctaccttgaacacaacaggtctaagtaaatcaggctgggcgtggtggctcacgcctgaaatctcagcactttggtaggctgaggtgggcggatcacgaggtcaggagttcaaggccagcctggccaatgtagtgaaaccccagctctactaaaaatacaaaaattaactaggcatgtggtgggcgcctgtaa

SEQ ID NO: 175499 - DNA, 357 bp, Homo sapiens
aggcctctgaggcactagcagtggaaaggcccctcactcccatattttagacagcgaactgaagctcggaaggcgacgtccacagttggggtcgcttccaggccttgagcctagattcttgggtctaggttgccatggcaccaggagcctggaaaagaaaggctcctcaggcacccgctctggggtccatccggcccatgctcttgcaagggcactgcggtttttgcttgggaaacgggtagcaaacagctaagactcccagaacgtgggaaggaaaacgaggcccagcagaagagcaggagggcggcgctttccggtcgggccccggatttaactgtcttcacctacagaggcccc

SEQ ID NO: 175500 - DNA, 299 bp, Homo sapiens
ataaggcacagagaagaaagtggaaaaaaaggcaaaaaggaaaacagagcaacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctcccagtttctctgcgtggctcagctgggccctctggttcagggactcttcaca

SEQ ID NO: 175501 - DNA, 145 bp, Homo sapiens
gaggctgaaacggaaggtttgcttgagcccaggagtttgaggctattgtgtgctatgatcgtccctgtgaatagccatcgtgctccagcctgggaaacttagcaagaccctgtcctcccccaaacccccagcacaagaacccacg

SEQ ID NO: 175502 - DNA, 271 bp, Homo sapiens
ttaatggttttattgattgatgtttatgctgttcagtgataacctgaaatgttatatcatactaaatgtttctttaaaccagaaaatcttatttatcatgtctgtcctttcaagcttggtgtctataatccagattttaaatctgaaaaacaggcacaaggagcatggcgcctgtactgcagttccagtcaacctggtggtagctcttttgatgccatgtctgtttctgaattgttaggtctttttaatggtttctgcctttccctcttac

SEQ ID NO: 175503 - DNA, 647 bp, Homo sapiens
ataatagatatctattgttagggtataataacataagtctttaataagagtttaagcccctcatgctataaatattataaccatttgctcctccagcacttagaatagcttaaatatttatttattaccgaggaaaacaaaaaagttttgctccataactatcagtgctatttggaccttataaaaatgaagatttcaggccaggcgcaagagttcacgcctattaatcccagcactttgggaggctgggattacaggcatgagacaccgcgcctggcctaaattttattttctaagaaattgattcagaaaatcagactttccaatgattattttaattaaactgatagaataatagtttggcagacatatctattatcatggtcctattccatctggctgtcactttcaaactatcttcatacttaaggtaaagggttattctattcatcaaaaacaataagcattccataaacatctggattaaattgtgctacctttgagggttaataattagtgaataattcacaatgttgtgcctcattataatccacatcagccaagaaaactcagtctgctgtatgaggatagttaaattgtcactagcaaagtactttttaaaatttcagcaaaatctggttagggat

SEQ ID NO: 175504 - DNA, 571 bp, Homo sapiens
tcaagtgattctcctgcctcagcatcccgagtagttgggattacaggcacacgccaccacacctggctaatttttgtattattagtagagacggggttttgccatgttgcccaggctggtcttgaactgctgacttcaggtgatccacccgcctcagcctccccaagtactgggattacaggcatgagacaccgcgcctggcctaaattttattttctaagaaattgattcagaaaatcagactttccaatgattattttaattaaactgatagaataatagtttggcagacatatctattatcatggtcctattccatctggctgtcactttcaaactatcttcatacttaaggtaaagggttattctattcatcaaaaacaataagcattccataaacatctggattaaattgtgctacctttgagggttaataattagtgaataattcacaatgttgtgcctcattataatccacatcagccaagaaaactcagtctgctgtatgaggatagttaaattgtcactagcaaagtactttttaaaatttcagcaaaatctggttagggat

SEQ ID NO: 175505 - DNA, 947 bp, Homo sapiens
  misc_feature (222)..(222): n is a, c, g, or t
  misc_feature (482)..(482): n is a, c, g, or t
  misc_feature (569)..(569): n is a, c, g, or t
agaaggcaaagggagcagacagctggcaagctctgtcccaatatgcttccctgaaagaggcgaggaaatttcagaagatgcaatgcctgaatggctcactttgcaggaaaacagaagaaccaaggctggactgtactgccgcaatctcggctcactgcaacctccctgccagattctcctgcctcagcctgccgagtgcctgggattgcaggcgcccgccgncacgcctgactggttttgtattttttggtggagacggggtttcgcggtgttggctgggctggtctcagctcctgacctcgagtgatctgcccgcctcggcctcccgaggtgccgggattgcagacgggagtctcgcttactcagtgctcaatgttgcccaggttggagtgcagtggcgtgatctcggctcgctaaaacctccacctcccagccacctgccttggcctcccaaagtgctgagattgcagcctctgcctggntgcaccccgtctaggaagtgaggagcatctctgcctggtgctattgtctgggatgtgaggagcccctctgcccggtgcccagtctgngaagtgaggagcgcctcttcccggcgcatcccgtctaggaagtgaggaacattctctgcctggtccgcccatcatctggggatgcgagggagcccctctgctgggtgcccagtctgggaagtgagggagcgcctcttccccgggccatcatccgtctaggaagtgaggaacgtctctgctggcagcccatcatctgggattgtgggggagcgccccggccgggagggctgtcgggggatgggagctttctaaccggcaacacccgtgttggagtgaggacgcccccgcggggcacccctctgggagtgaggagcctctccgggccccattgggggggcgttcacggcgccccgggacgaatcccggtcccaggtgaac

SEQ ID NO: 175506 - DNA, 224 bp, Homo sapiens
acatttatggtattaatgattttgtcatctcatggttttaaatatcatctctatgatgtctcccaactgtatatctctagctaaagtctgaagtctgactcttgaactccatttctttttttgcttgtttgtttttttgagatggagtctcgtccaggctggactgcagtggcacgatcttggctcactgcaacctccgtctccggggttcaagtgattctcct

SEQ ID NO: 175507 - DNA, 451 bp, Homo sapiens
cctccggacacgcctgcaggggctacgaatgcaaattccccccgagacgcccctgagcctccgacctccagaccccaattcggttcgaacggtccctcagcccgaaacacggttggatcacaaccggccgatgtcccggcccatcttcccagttcccctggctcgccgcacggaactcccaggggctgcgccggcgggcgagccgagggtgagaagttgggcgaggctccagaagtgaaggggcagctccggctcagactgtgtacacacgacctttgaaaagtaaacgcccgcggggctgggcgaccttgggtgggacgcgctcgggtcagcctcgcaggcgggtgtgcacgctccggttaagttgaggtgcagagaggcgacccgggcgtcgcgccctcgccccccgcccccgaggacagtgacgcgcgtggggaggacggcgcggccg

SEQ ID NO: 175508 - DNA, 509 bp, Homo sapiens
acactccagcctgggcgacagagcaagactctgtctcaaaaaaacaaaaacaaaaccaaaaacaaaacaaacaaaaactcatattgcacatgctgtgttctagcttttttgtaagtgaactcgtttaatcttaacagtcacttaaagtccatttctcgagatgtccttcaccatgctttttctagtttatccctgcccctgagtgagcaaggctttgtgtgagaccttgttgaactgaattcgaggcaaggacttggccattgagttgtgtttatcaggtctcatccacttctaaatatgttacatttcagaccaaggaggaagtgtgtcttcagagacggtggtgcgcggtattcccctcgagtgagtgtgatacgtgaacgcacgcttatcgatcccttgtaaggagaggtcattcactttacaatgctacccaagagacaagcccttcaaatacagatgttggagtagagacggcagagtggaggtaaggcaggattgatctcaga

SEQ ID NO: 175509 - DNA, 219 bp, Homo sapiens
ggtgctcctacaaaacgctagagccaggaagagagatgccagcggtctcctgagttaataccgtattctaacgaagatctgtttcacacttttcaaagcttcagttcacagattccagaagaattttgcatacaactagaacatacttatcttttctcagtggcccgtcactataacattaaataagatcttaattgtaaaacacacttaagtgataca

SEQ ID NO: 175510 - DNA, 168 bp, Homo sapiens
ttatttttcttgtcttactgcatcgcccgtcatcacagtacctccatgtactgagactttatatgtgtcagttacatatagattgcctctaagtcacacaacaactctatgaagaaggtactattaggtaccgtattgtataaagacgaaaatgtagcacagaggggg

SEQ ID NO: 175511 - DNA, 354 bp, Homo sapiens
atattcaaatgtgtttgcatatttctaaactgatcatacatcaaaattagagccatattgtttcttttacagtgaaactgtttatataggaaatattgtaccaaacattccctgcttccaccctgagttgtgactgattacagagtgagataaaagcacttacatacacaaacacgagaaaagtctataggcatgcaagaaatcaaaagaaggtgtgatttttaacacaaacactattatcaaccaaaaataaagaagaaggaaaaagaaagattgctggagtttatgcgaattctgagaaagcaaaaagcatagacttacacactgatagattgaaaattagaggttgggtta

SEQ ID NO: 175512 - DNA, 157 bp, Homo sapiens
gcattatccttcagtatgtggaggtatgtgcaacaaagaaatggcagatatttcatctcactcttccctaaggacaagattcatgtgtaattcatctttctattcccctacagtgcctagcactttaatggcacctggtactttttcacatggtaga

SEQ ID NO: 175513 - DNA, 312 bp, Homo sapiens
aaaatagctaagaatttcacagaataagaaaacacatgtacatcaagcaggatacattaaaaaaaaaattcctcctagatatattatgagaaactaaagaatatcaaaattgaagagtttaaaggaagttacagagaaagacatatttcctaccatggaacaccatttagctgatagaaatctcttaacaggaaaaatggaaccaaaactgcagaatgctatcttccaagtgctgagagaatcatcagttacaagtgtgtaccgactgaagccactatgtttaccaccagctgctctacacacactagagga

SEQ ID NO: 175514 - DNA, 141 bp, Homo sapiens
tagttcttgaaaagcaataagcatctggaagtctgtactaaggaatgctatcttccaagtgctgagagaatcatcagttacaagtgtgtaccgactgaagccactatgtttaccaccagctgctctacacacactagagga

SEQ ID NO: 175515 - DNA, 2423 bp, Homo sapiens
gttcagtattcaaagaatgtcttaagattatgataattaaagaagtcccaggacgagacaaaatgaatcaaagattttgtatgcaagtccacaaagtctgtcagacatattgtaaataatttaccattgattttattttcaacaatgttaatgtattgacatttagcatatatctgttagatagatattctatcacaatgttttattccttgcaccagccctttactattttctaacaaaaaaaaaaaaacacaatttcagggcataaacaagaagtgtttatttttccgtagtacatctttgggttgactagagattggctgttctaagatgtgctcatgcaggcttgactctaaactatgcatttagagtcattttgttctggtctggtctacacgtaggttattcttttgaaagcagtactctgtcttaagcatgttcttctcttagtggagtttggagatgctaatatcgacaggtggaggcagaatgctccttaaagtctaaactagaattgccacactgtcttcctaaggttcataagccaaaggaaatctcatggcaatttccaacattagtgggacaagagattatactactcccaaggaagtggaggtggggaaaggaatgattatttctgtatcataatctaccatagtccttaagtgactgcctcttgctacttcccaatgttttactaatcacattgacttttaaaaaatagattccctaggaattcaagaaaaatacttattttctaaataaatcacagcaagacagacacaattgtctcactacccccaatatcctaacacactaacaaatacgtgtataatcatacacacacaaacactacaacatacacccctctatgatgttattaatgttatacagataaatagatgtaatatttctgtggattgtgctgcggctgtcctaaatcattgcacagaattataggtaactgcaattcatagggcttataatgttaatcattctaggaagtaattagctgaatgccttctgtacatttgctaggctaccagctcagcgacatgtattccatctgaaggacactcttttgaaatacattatgctcccagtgtggttgtaatattatcatcttattatcaccaattcccttgcatggtggctttgctgagcagctgtttcacagacaagccaatttcttttaagtattgctctatcagactctgaaaccagttctaccagaagggttcttggtaatgaatgttaatgagcagacaagtatcctttctctgacagaggctcactaatcctttgagtaagtatgggtgaattacaggagaaattttatttaagttaaattgatctgctactaagtagagaaaacttattttcttattttaatgaaaatcaagaaaaaatatttaatggggatgtaaattacagctccctggaaacatttttgtcttctgactggagaacacagtagctcagtagactggttcaactgcatagtgtgcttaacactagcaaactcatgatctccagtgaggcctgatcttcagtgggacagtgggaaatggagtagaaaccactcactctctctgggatttggtaccagcagattctttatgttccttagtgataagtaatagggataaaaaattattctttcttcttccactgagccagtgtaagagttcctttttttttccaaaacaaataagatagtaaagccataagaacagcacttgtatgctttttgtattctaagaatatgagaaaaataatttcagtgaacctttatctgaaaggatataaccatgtcctgatggaatactgcgatgggcaggtagaagggaatgagatgggccaggcgcagtggcttacgcctgtaatcccagcactttaggaggccgaggctggcagatcagaaggccaggagttcaagaccagcctggcccgcatggtgaaaccccgtctctactaaaaaaaatacaaaaaattagctgggcacgggggcatgcgcctgtaatcccagctactcgggaggctgaggcaggagaatcgcttgtacccaggaggcagaggttgcagtgagctgagattgtgccattgcactccagcctgggtgacaaagcgagactccatctcaaaaaaaaaaaaaaaaaaaaaggagaggaatgagatgggcagaaagatgatcattgttgaagctggttgatgagtctttagggagttcatagactattctgggttgtgtatagtttctgaatttccataataaagagattaaaagagagagagaaagagagttggccagcacagtgcctcgtgcctgtaatcccacactttgggatgctgaggtgggcggatcacctgaggtcaggagtttgagaccagcctggacaacatggtaaaactccgtctctact

SEQ ID NO: 175516 - DNA, 1373 bp, Homo sapiens
ctaagacccctaccacacacctcaaagtaacttgaaatacattatgctcccagtgtggttgtaatattatcatcttattatcaccaattcccttgcatggtggctttgctgagcagctgtttcacagacaagccaatttcttttaagtattgctctatcagactctgaaaccagttctaccagaagggttcttggtaatgaatgttaatgagcagacaagtatcctttctctgacagaggctcactaatcctttgagtaagtatgggtgaattacaggagaaattttatttaagttaaattgatctgctactaagtagagaaaacttattttcttattttaatgaaaatcaagaaaaaatatttaatggggatgtaaattacagctccctggaaacatttttgtcttctgactggagaacacagtagctcagtagactggttcaactgcatagtgtgcttaacactagcaaactcatgatctccagtgaggcctgatcttcagtgggacagtgggaaatggagtagaaaccactcactctctctgggatttggtaccagcagattctttatgttccttagtgataagtaatagggataaaaaattattctttcttcttccactgagccagtgtaagagttcctttttttttccaaaacaaataagatagtaaagccataagaacagcacttgtatgctttttgtattctaagaatatgagaaaaataatttcagtgaacctttatctgaaaggatataaccatgtcctgatggaatactgcgatgggcaggtagaagggaatgagatgggccaggcgcagtggcttacgcctgtaatcccagcactttaggaggccgaggctggcagatcagaaggccaggagttcaagaccagcctggcccgcatggtgaaaccccgtctctactaaaaaaaatacaaaaaattagctgggcacgggggcatgcgcctgtaatcccagctactcgggaggctgaggcaggagaatcgcttgtacccaggaggcagaggttgcagtgagctgagattgtgccattgcactccagcctgggtgacaaagcgagactccatctcaaaaaaaaaaaaaaaaaaaaaggagaggaatgagatgggcagaaagatgatcattgttgaagctggttgatgagtctttagggagttcatagactattctgggttgtgtatagtttctgaatttccataataaagagattaaaagagagagagaaagagagttggccagcacagtgcctcgtgcctgtaatcccacactttgggatgctgaggtgggcggatcacctgaggtcaggagtttgagaccagcctggacaacatggtaaaactccgtctctact

SEQ ID NO: 175517 - DNA, 115 bp, Homo sapiens
cactctcctggttttcttttccttttgactcatctcagtttctttcttttcctcgccctcactctttcctctcgtacccagggttctttccaaagtatctttgtcctccacacca

SEQ ID NO: 175518 - DNA, 406 bp, Homo sapiens
gattttttttagaaaagaaactttctataaatttatgcatatattatgcagacattcaattatatctgtaggaaataagcaaactatggaatttttagataaaaagctatactctagtttcagtaggccttcttaattaccactcattaaattttcattaatttcaatcctagaaatgtgaaaataacaaaaaaattttactgtctaaaatttctttggtttctcagttttcaattatttttcaaagtacttttaccatcaaaatgtctcttacaccagtcagaatggcgattattaaaaagtcaaaaaacaaaagatgttggagaggatgcagagaaaaggaaagcttataacactgttcatgagagtgtaaattagtaaacctctatggaaaacattatgaaga

SEQ ID NO: 175519 - DNA, 313 bp, Homo sapiens
gtgtttgactgcttggttctggataacaaaggcatgtccttataaggcaaagtggcttcactaagtatggtcctccagaggaaggcaggtcccccctccatggtgcgttcaatatatgggagagaattttgtgttcattcctttgacatgctaatataagtatgttttctgataggtactacttaataaatataatagctaatacttattgaattattattatatatgctaccaaagtatttcacttggagggaatattgggataactggaattgatttcttctaatgtaatggtccaaggcagattttacat

SEQ ID NO: 175520 - DNA, 233 bp, Homo sapiens
gccaggctggtctcaaactcttgacctcgtgatccgcctgcctcggcctcccaaagtgctgggattacaggcgtgagccaccgcgcctggccctgtcacctttcaacacactacatgttttactacacatcttgtttcttgtctgtctcctgtacttgattgtcagctctgccagcacaatagctgttgtcttttttttttttttttttttttttggagagatgggggtgggt

SEQ ID NO: 175521 - DNA, 398 bp, Homo sapiens
ctaccatcaccaccacgatcaccaccaccaacaacaaaaaccaggaaattaatcaaaccaaccaaccacccaccacaaccacaaaacaaatgtagaaagctaacgcaatcaaatgacaaattggaacatgaacaagccataaatctgatcaagtgttaataggtcgatgaataaagacagttcagtagaggattggtgaaataacccctggaacatccagtactatggaaaattaccatttaaaaaataacaatgtagactgttatttattggcatgtacatgtgcctgtgatatattaattaattaatagaaagttacagtatgcccctatgctgtgtgggagcaaaagcatgtggatgcttgtatgagtgtttgtgtgtgtgtgtgtgtgtgtaaa

SEQ ID NO: 175522 - DNA, 323 bp, Homo sapiens
tacagaaggaggtgcttttgaaatagagacaatagcttaataaccacacaggtgataagttgagcaatgttctaatgtttcttcttcttgagtaacatgtacattttaattgctttacttctgattaaatagcaatataaatattttcagacttgggcagggatactaaggactagaaaagaaatgaacatattttgagggctaaggaaattacctaaacttcaaatatcaggtgactgaattttcctctaagcaatagcattcaatcttcactgcacattggaatcatctgagaagcctaaaaactacaaatacctttgtcc

SEQ ID NO: 175523 - DNA, 562 bp, Homo sapiens
aaaaactttttgtagagacaggggtcttgctattgtgcccaggctggtcttgaactcctgaactcaagtgatcctcctgcgttttcctcccaaattgctgtggttacagatatgaaccaccccacctggcttgaaaatggttttaatggccttacttggagttctccaacaatgggctcataacagttattcctgggctcaccatggtggtagggcctggcctatcctctgtccctgtgttccgtgtgagcccagtactcccagagtcagagcttatctcatccttaggtcacttcctgcccaatgtgaagtatagtggagacgttggctcatggagctgagccctcagtggccccccatgtttgctgttttgtgtctttgcctggagccctgctgcttcctcttccacctgccccacaatctgctgatggctgcagaacatcaggctctctccgaaccctagtcagtggtttccttagtttggtaaccctcagtctttggctactttgtgcatccttgacctcatccacctattaaatccacatcagagctatttcccacc

SEQ ID NO: 175524 - DNA, 506 bp, Homo sapiens
aaaaactttttgtagagacaggggtcttgctattgtgcccaggctggtcttgaactcctgaactcaagtgatcctcctgcgttttcctcccaaattgctgtggttacagatatgaaccaccccacctggcttgaaaatggttttaatggccttacttggagttctccaacaatgggctcataacagttattcctgggctcaccatggtggtagggcctggcctatcctctgtccctgtgttccgtgtgagcccagtactcccagagtcagagcttatctcatccttaggtcacttcctgcccaatgtgaagtatagtggagacgttggctcatggagctgagccctcagtggccccccatgtttgctgttttgtgtctttgcctggagccctgttacaccgtataccgctaggaccacgattacgtaatggagctcgaataacccaggcatagtttgctaagccaagcaagtgtgtgttcagtaatgtcgagaccggtcgaatttt

SEQ ID NO: 175525 - DNA, 688 bp, Homo sapiens
gaaatagtagtactttaaaaattaacatggtttagaagatatgttttatagatacaaaatggtagttatacagaggtatatctgaagaggtctttgaatgtacttagacaagaaatagattttgttttattaataagagatgaagtagtttctgcttagatcaaaactatacttttcaaggatgaaagcaaatacaaaacttcttcagaataacaaatagcaaatttgttaaaggttctggtattaatcatgggtttcatctcaccaaatgatctggaggccggttgatatttgtatttctaatgctgatatttttaaggtataatttctcacggttagaaacataggttagaaatgttaatatccaagttaatgtaactggcatcctccaaataacagagtgctttggatcagaagtaatttgtgaaatctagcttttttcttttacctgttttcagaacaagttcctttgagtgcttctcttggcttacaagtgaagtttcattttagattgaatgggttctgttacaaagtcaggggaagaggtattactgaatttgtgagaatattttaagttgggaattactctttttatacaaaagacgatgatgattaggttcagaagcttgcctattataacctgctttgactcatagttgaagttccatattattcaaaaaagtttatg

SEQ ID NO: 175526 - DNA, 897 bp, Homo sapiens
gtaggggagggggaagacgtgattcctgtcctgctgaaggcgcggggttgatgacaaacggagttctagctagtaaactctgaagtgaagtgccaactgtggaagaggtcaacagcatgtgggaccctgaccttcaggtgtcactcccagggagtgttcccttttgtgtctgctgtgtggagttggtgggggatttacaaccctcctcctccagttgtctagccctgtggtctgagacaagatacttgcctttcctgagcctcagaggaggaatggcttacattcacagggagtgttctatgaggcaggcgcgcgctgcgtgcagttgtttacatgcagtgcctcattaatcctcataacgaaccagtgaagtaggtgcccactgtgatttgcacttttgcagctgagcagactgagtctgagatgggttaagtattaaaggctagtgcactgcttgccttccttagtgacagccactaactgagctcaggccagggccttccaggcagccctttggctccaggcagcaacgtctggctgtggctttgtgtttagaaggctaaagctgttatggggacagatgccaaggcctcgcctaaccttatcacccccaacatgagcacctctaggtccgatccgcccttgccgaggctggagatggccctgtggggcctgccaggcctcaggatcaaggagttctagagcgcagggcaagaggaggaggggcagctgagtctctgagagagagctgctgtcttgtgccaaattttatagctggacatggaaaggcatggacagtcatagcctggcagaagatagccaagctagtcagtgtcacagcccaagccacagagtaaggagggagcctcacacagagggctgtagtctggaagcctg

SEQ ID NO: 175527 - DNA, 354 bp, Homo sapiens
ttcttcctgcatgtgaggcacagagattttaagatgagcaggtgtgagatgcatggatttgaatagcatagaggtatctggagagcattgtgttggtattctgaataccctcagatcccagggggataacagctcattatgcctggggtagaacttacctgggctgtggaagaagaggggattcttcaaaaagggctcaacctctgaactggcaaaacagtgagttttgactcaaaggcaccagagtactaatacatgacatcctctcctggggtgatccaatgtggctggagttggatgaggtggggaggctggggatgggaatgggaatgggattgggatagcaggacgggg

SEQ ID NO: 175528 - DNA, 265 bp, Homo sapiens
ccgtgaagaggtcgagcaatccagcgacctgcccgaggccatgcggctcctgacagtgaatctcctcacttctgattgcagagcccacaacatctttacccctcccagcagggacgccacagcagcagggatgccacagctgcttcaggtcaggatgcagggtttctctgatgcactctgcaggggcccagagagatgattcccttcttttcctaggtcactgcccctttgtttacagctcctgcctcctctcttcaccggccat

SEQ ID NO: 175529 - DNA, 886 bp, Homo sapiens
gagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcac

SEQ ID NO: 175530 - DNA, 254 bp, Homo sapiens
catgcggaataaccagtgggaagttgaagaaatcccaggcccctgcttggtcttgcttcagagctgctttgtaactggtgacagagcacgtcgccaccttctttcatggagggctgtcatgtttagattattgttgataaaccgttttgagattttgaaatatacaaagctgccagcttggaaagtaacagtcattgctatggacatgattggctttgggggcatcaagccctcccagttcgctgtgtctaccc

SEQ ID NO: 175531 - DNA, 619 bp, Homo sapiens
aaacaaaaacagaggtagggaagaggtgggagagggcatcctacctgccttttggtccttgactcaatatctggaaaattgagactcctgtatgtgattatgacgattctgagcatcagcattagtactgtccaacctatgaattttagacaggtaagaataggaagtaaagtaatagaagcagttgtggggctccttcctcctaaagaagggcttcaaatgttttcctttcagctggtgtggtctgatgtaagaattgttagccaggaccctgaacacatagctagggtgaaggtcattattgttttctctttatctgattgtaggctctccacacacatcatggtactctggccacctgccttatgttttatgtgtttattataaaaggtctttttttcccttgagcattatcttagctcccaacttcaacataactttcaacacctttctctgttatttttgcaattaacagatatatttataccagattagtccttcttcttttacagaaacaacttcccactttagatgtttcatacatacagccacttatatttttacatagtttatctacagcatttctagaggcacagtcactgctaaatgagtagaagaa

SEQ ID NO: 175532 - DNA, 554 bp, Homo sapiens
aaatccgaaccatcttagagagcaatcttttcaagtacaaggtcttccctcccacttttgtttgtaagtccagaaaatacagtccacatttaatgatcctaatgtacagagtggaagcaagcagatggattgttaagactgctgcaacagttcggctgcccctcacgagtccaggacccactaacaggcctctggcctggcatggggcacaccaaccagcaggcaaaaggcctgacttctagtcctggctctgccactggcatgcttgcaggcaaggtggcctggggaagttgcttcccctctgtgaggatggacaggggttcctgtggccacttctggctgactgcgggtcacctgctccccctctggaggaggctccctgctctcctggtggagaagagaagagggctgcaagatgcattgcccagagagccaccggaaagaagactagaacctgcctcccagacaccagctgggtgaacctccatttcccgtctagggaagccggccaaactggttaacccttaccatgtcttctcactggagcctgaggg

SEQ ID NO: 175533 - DNA, 497 bp, Homo sapiens
taaaaagcatctaaagtaaaagtgaaatgtgtgaccaagaatattaaaataataaatgtcattttgtaacaactatcagaaaacttgaaaagtatttcagttcatattttgaagctgataaatatcagctctgtggttaagtttgtcttaaaactcaaatacccaattttatttacacagatagccaaagtcatctgttagcctgaaacatatctgaacagtacctgaagtcatccttttgagagccctttacctgtactatccaagatatgtacctcatcacaatttagaggatattcagaaatggaaattccatagtttataatacaaaaaagaattagcactcaaaatatgtatgcaaggaaatattaataaaggcagtaactgataacatgtacatacccaagggataatatatttcaatgaaaggagggagggatagctttcaaactctcacagtgtcacccactctgcttatgtgctaaactttgttgaca

SEQ ID NO: 175534 - DNA, 506 bp, Homo sapiens
gcttatgcaatgtcatgtatacctatagcatggtacatggaacagtcctcatattaatgacctgagataaatcaagaaaaagctttaatagctcttgtcttacactggataatctctattatccaactgggtaagtgaggtgatgaaagtgatttttgtgacttgcataccagttatacaaattcattcagatcgttttgttttgttctgttgtcacatttttcctttgataatccagaatggctgtcttgattctagaataagccaataaacttgtgactcaggattttaaaaatctggtggacttatgccgtaagggagcattttcctttaacatttgtttcgacatagtttgccctggcgttgttcagtttttttggagtaccactaatttctcccatacctatgagcaggtagtatgaattttccattctgggagagactctattgtagctaaactgcctgtattcaaggatgccttacctcattttattctttgctgtgta

SEQ ID NO: 175535 - DNA, 732 bp, Homo sapiens
agcaactttcagttaacgcgtccctcttgccccatgcttgtcctgccacacaaatgtgaaaatgcaacgttacaaagatctgtgcctcagacaccatttgaacacagagaaactcgtgggcttatgtgactacacttttcaggttacggaatttctttaaggtgtactcttgagtttaatatacttattaataacttatcattacagagaaaaaattaccagaagtacagggtgtttttaacggactttcttctcttgcacattgctgggcatggcgtgtactgtgacagggcggagtgatgggctgagaatgtgtgtgtgtctccaacagttcccaaacgtctacattttcaagaaaaaggcaatctacatcatctggaaaattgtaacttagtaattaattaggataatttccctaggttctctgtgctgcatgagaccacagcgtattcattaaagaggaaagctgaatattggcggaaaacagggttgtaaatttgtaacaagttgttctatcagaaaatgaaatgcaattttctgtcctctctgagcttttaccacatagctcttagcaatgggtgttttttctgtcattccactcaattctcactcgagtaaacctccaagcaataagaatgttgtctttcctgtttagactagactgactacctttccaggacagtccattaagttgatttccaatggtgaagggtcagacacgcctcccctggg

SEQ ID NO: 175536 - DNA, 393 bp, Homo sapiens
tatctccatgggagtcggttctgtcgtccccatatcattggctgaaattctgagaagtaaagtaatttgcgtaaggtcacccaacttgtaataagtaaactgaggttcaagcccacctttgtctggttccatagctacactgtgtgagtgagaaacgtgaaaacacctcacagactcagcttgggcagtgttttctgcaacagattttgtctggggaacttggacaatgccaatattcattcatagagtttctttgcccattccagcaaattatcattttctgctttctcgctcagttatttgtatacttagctgatggactcaacttcacacatttcccacaccctacttagcagagtacagaaatccatttgctctctcccagctggttcc

SEQ ID NO: 175537 - DNA, 279 bp, Homo sapiens
gatttgccatgtagcatgtatcaaaagttaattccttttttatggctgaatattccattgtgtgaataaatcacatttggtttctccattcttctgttgatggacacttgggtagttcctacttttgggttgttgtgaattgtgctgccatgaacaagtctgtctgagtccttgttcagttcttgtggggctacgcctaggaagagaattgctgggctgtatggtaagtctaggtttaactttgtgcggaacccagatgttttccaacaggcagctgca

SEQ ID NO: 175538 - DNA, 461 bp, Homo sapiens
gaagtggtacgaggcagccacccccacgccatccacacccgctggtgatcggattccacctctgctacttcttacccctgatacttaaggcagttcaatttcatctgagaaacattcattaggcacctattgtatgccaggtcccctttgtccccgcagggacgagtgggtgacaactcacaagctagtgggggcagtggaaatggccccggggggctgcagttcctctgggtcctctgagaaaggagaaagaggatttaacccactggggggttgctgggaatgggaccaggaaagcctcctgaatcccttaagaccaacgattctcaacctgaggaacaagttcaaaaataaagaaaaatggcatccaattcccaggttcccccgcagcgtatgaaagctccgtactgagtttccaacaagaactcaccacctccccctccccagcggaggagtgcagg

SEQ ID NO: 175539 - DNA, 691 bp, Homo sapiens
agtaaacaggccacagggccaatcttaggaagcacaaggagatccagacacctcttctgacaagggttgaggaagggagaagagatggccgtaaacactggtgaccggatggaccctcatcccctaagtgaaggcagaaccagtcctctgcactgctgggacagaggggacagaacctatggagggctctctcagagccactgtggccgccagccacttgcagcctgtgccctggaaagctgaagtccacccaggtgcctgctggccagctccaaggccaagctctccctggaactcagcagtttgcaaatctcagcgtgatccgagtcagctgcagcgcttcttaaaatagattgctgggcccagcccctgagtttcaatttagtggtctggggggaggtctggggacatacagtcccggtggattcccaagtgatgctgctgctgatgatctgggaccacaccttgagaaaccctgctttcattcatctgcccagagggtattctacaggtcataagtcgatgggatccaggtttagaaccgacctccaggaatgcacacgggattcgagtctcagcctggtagcacgtttgagtcacctggagatttctgtacaaatgatacccatgcctgggtctcactttcagaaatttgaacacagtttgtctggggatgagcccagggatatat

SEQ ID NO: 175540 - DNA, 266 bp, Homo sapiens
aatcatttttagagtacagtataaaaataaaatgcagaaagcaattatagttggttaaaagttggggccaggaaagcaggaaagccaattatagttggttacatagttgggtccaggaaagcttccattgcttctactttcttatggaaagatagtggtgtaacactcctggtccttctcttacttgtccacttacataatacttccaaatgggagaaataataactcaccggtcttgtgagtttgagagcaagagctcagcaagc

SEQ ID NO: 175541 - DNA, 469 bp, Homo sapiens
caggggctgtgtccctccacactgcagtgcccactggtagctgctcctaggctcctgtcctcactggaccccaggaatatcacttcctccccctgccctttcagcccctggggtggttaagagctctgacactactccgctctgggagccccagcaacctgttgctccatgggcactgcctatacccccgtaagctgccattgcatgacagggtctttctatgaggctcctgtgcgaattctgctcccccctggggccttggcccatctcccgtggcactggggaagggttcgttagtgctcatctttgacatactcggggagcccagagctgatgtccccttccagaacctgggagggcagtgctctttcagagggactcagaggggtggaaacacatggctctgacactcaagcccgccctgaggggccttatctcacctatgcatgtcagcttcctcatctgtaca

SEQ ID NO: 175542 - DNA, 591 bp, Homo sapiens
tgttccaggatactgaaaccgtcacttcccatctcatctgaagatgaaccatataaccatcaacacggcatcgttcctttggttacttttatagatgaacacatattccttccagtccttgtgatagaaaagggtaattttaaatggcattgaaactcaagtattaaataaaaaatatctttctatacaacagcagacagtaagtatgtcctggcaatttctcaaagattttagttcacaggtttgagaaaaattccattagctttaattatttatcagcagtcaatttagattactgttcttgacctatttttacagtgtataggccacccagcaatgaaataaatgaatagtctttttctacaatggctgattttctgaaataaaagaaatctggtttaaaggaggaatgaaaccccaaacatgtaattaccacaatatataacccgccacgctgcttttgtagtcggataaaatgcacatctttgtgagttttttggttattaaataagattatcttgaaagggataaactcactcctgctataatttcttcccatttaaatgtctttgtgccatttaaaacacgttc

SEQ ID NO: 175543 - DNA, 451 bp, Homo sapiens
ttacaggtcgcccaacaccatgcccggctaattttttttgtatttttagtagagacagggtttcaccatgttggccaggctggtcttgaactcctgacctcaagtgatctgcctgcctcggcctcccaaagtactgggattacaggcatgagccaccgcgcctggccagtttttgactttttggagagatggggtttcaccatgttgtccatactggtctcaaattcttgggcttaagcagtctgcctgccttggcctcccaaagtgctgggattacaggcgtgagccaccacatctggccttttttccccccccttttttaatccccagcagaatctggctgaagaattcagaatttgaaattttgcatagaaatgcatatactagctacttccattgattaataagacttggtatgtgttggggataacatcacggatcctctaggtcg

SEQ ID NO: 175544 - DNA, 727 bp, Homo sapiens
ggtctggaactcctgacctcaggtgatctgcccaccttggcctcccattgtgctgggattacaggtgtgagccacagtgcttggccaggagtgttttgacttatataagtttttttaaaaatgtagccaaacttaccaacttttatgacttctcttttcaatattcattgaaaacactatcaatgtaataatgatatgctgcattttcttttaaagttataaaatgctgcttttcatatttatcttttaaaattatctagaatttatcttggcatatagactgaagtagggatctcattttatctttccccatgtagacagccagttgtatcagcaccctgtattgaataatccagattttcctcactgatttgtgatgccattctgtcaaataccaagttcctggtgtgaataggtctattttttccttatttatttataggggtactttgtgttttctgaatgctaattctttgccactgatatatattgtgaatgtcttatctcactttgaatttcttatgaatagcagctcaattaaaattatcagtcttttatagtttctgttttatgtttcatatttgtgaatttcctttttactctaagaacataaagattttctcctatatagtctcttaaatgtttcataagttatgtctttaagcctcctcaaattgatttttttggtatggtgtgaggtagaatctgtagtaatttgtattatttg

SEQ ID NO: 175545 - DNA, 366 bp, Homo sapiens
ggttggggaaaatagaccaaatagggcatggataacaaccatgagcatttgtacagccctctacagtttccagatggccttcctgtgatcttcccatctaccccagaaagcaaaggaggcaagggtactcacttcccccattacaggagggaaaccttaacttacagaggcaaaaggccaagaagatggtatttgaatccaaacttcagcccagttcttccttcaccctagctctggtgtccctggatattagaaacaaatgccctagccttcccaggtttcataatgatgggaccctggccacttttatgatctggggaaaccactggaaattactggaaagccaagggagatggggtgaatgtg

SEQ ID NO: 175546 - DNA, 379 bp, Homo sapiens
caagaaaggagtaggcaccaatgaaaatgaggtcttttattcttcagagttctgttaccttagtctttagtatctgcagcaaagttatttattcacattcttcctatttttatatctagctagctagctagctatccatctgaagggcgttgtgtttaaagtgaaaggagaagccagttgcaatagtttacacttataatccctgtgttttgagagactgtctctaataaaaataaaaaataaagtggaaaagtcatgtattaatgagcctgatttctgcaactgattatgcaaatacaatattttaaatatccgcctgtcattacttgggtaagttatctgattcttggaaaagaaatgaaatctctcaactgggaga

SEQ ID NO: 175547 - DNA, 224 bp, Homo sapiens
tcaatcgagccctcactggttggtgcacataaacactaatatcaaatgatggttttgtcatgtgatccaccccccagcacatacaaatatagaacatgaccataaaaagtaacgaaccatgccctctgctaagtaatttatgacagcagatccagactggaatgccagctggaattaccttctccttgccttcaattttcacatatacagctttgtacagatga

SEQ ID NO: 175548 - DNA, 183 bp, Homo sapiens
caagcatactttaatttttaattcatcagttaagctgtctttgagttaccatgatattgggcatacctcattattttttacaccaaatgcattttaaaaaggaaaaaggacactgttttatcttctttcttgctgctttaatgaggatggagggataagttacaggctggcacattaaatgta

SEQ ID NO: 175549 - DNA, 863 bp, Homo sapiens
ggatgttggtgacccacagacctcagaaggccaagcctttcttctgacttccctgtggcctcacaggaacctcagaagcaacaggttccaaacctgacttctgtggcacccagtagagaagagaggccctgctgctctcgtccccagaggggagtgagaggaagaggcccctcagagtcaggtaaggagggaccaggcgacgtacatgcaaaccacttgtccactagtgcggctgccaagcccccagggtctggaggaccctgcaacaggcaagtccaaagctccctggcctccctcaggtccacactgagtgctcaggaagaaagtgccaaaagctgggagtgggggcagggagctgacggacactccctcgagaacgcccctctcacagatatgctgggattttgttcccaaagtctggaggcccagcaggggagctgggacagtgggcgggaggcaagcccccaaaggctgaggaagaggctgcaagacaccccgggcgcaaggcgaggggctggaatggagagcaaaggaagcctccagtggccaaaaaggacggcagtccggctgaagaacggagaaatcatgcagcccccaaagccagtggcttggctgcgacacacaggctgatgtccagaatcactgtgctcaaagctcagaccccaccgaagccatgccctgatgccaccctcagggcgtctgaaggcctaactacagctgcagagaagtccagagctagctcaactaccgggaaggacaactctgttcccactctggcaacctcacagtggaaggcacgtgcccctctgtggaactaaacgttgtttgcttcagcctcgattgttcttttatatgaactgtct

SEQ ID NO: 175550 - DNA, 641 bp, Homo sapiens
tggtagaaaaattatttgtatataactttaaaaggagtagaagggctttttgcagagttattacgtttgaagtatactttatttcttgaaaaaattacagattttttgtaaataatgatgtaattcaactctcaaaatatttcctactgtttctttattccagttgtattcacatgtgaaagcatgtgatcagttattgctgcattaaaaacatgagtcttttttattaggtggccattatttatgatcttttctatgaaagagtaaggacattaaaatgtaagatgcatgatgaaaaattaagtgaagaggctctttatggttaatttatattgaataatgcattaggtaggtgttcagagtaatattttgcgttgtgagaacatttttaattttatttaaaattaaatgaaaataaattagtatattattgtactaattgtacttttgtataataaaatccagtgtatttttaaaatgttaggttatgtgtggttaatattttaatccaatatttttaacatgttaaatactattgtgcattcaatgaagtgttattatgccacgaactttaacctgttccactttacttaaaggtatagatgaaagataataacaataaggggccaggcgtagtggtt

SEQ ID NO: 175551 - DNA, 483 bp, Homo sapiens
aacagaggtcttgctttgttgcccaggctggtctcgaacttctgggctcaagcaatcctcctacctcagtctcccaaagtgctgggattataggcatgagccaccatacccatccacttctgtctacttctgataatctcacgaaagagaaggtaattaggcaattatcacgttttagcctttaaaatattttaaatttactttcctctccatttctattgccctaatccaatttaatcagacttagaacttgtctgcatctaaaatgcaaaaatcttcactaattgcccttctgtgatgtatcatatcgaacagaccaaatcacttggcacttgattatatacgtgctaaattcttctcacttgatcttaagtttcctgtaggcagaaaccatgacatatttcaatgcacaccttctgttagttccagctagcatgcagcctatgaatgacactgtaatagtaccattctaacacatggtta

SEQ ID NO: 175552 - DNA, 388 bp, Homo sapiens
tcttacccttgcacatattggcagagtctctatactaaccatggcaatccctatggagtgtttttggtatttgtattgcatggtttttctggccatgccttgtagttggacactttgtgggtggtttccagattttcaccatcatagatgctgtcactcagtgttatctgttctcaggtgagggtggggatcttttcttccttgcgttgggtgagcttctgagtgagcttctgtcatctttagatgaagtctcagaacaagtgggaatgtggatgtggcctatcaaaagagatcacgtgaagctgggcgctgtggcttatgcctataatcccagccctttgagaccaggggttcaaagccagcctgggcagcatagcaagatcctata

SEQ ID NO: 175553 - DNA, 491 bp, Homo sapiens
aggcgtaacaagcaagcttatgtaatacttgaggactaatgtgttcttgtttcaaaagcatgatgatagcaattaaaagcgaaaaaaagaagacagtgtcaagttaacccaaagtatctaatgaataacaaaatgtaatctcagcaattccccactgtaaaaaaaaaatactaagcataagatgacagcttagcaaataaacctttagtttttaccacagaaaactgtgcaatgtctgctccaagtaggtttcatggtatcagtggaaaccaagattgatccaagactggtgaaattactataaatgggtttggagagaaaacagatcacttccaaataagtcatgtatacagagccttctgtaatatgggatggcaactaaggcacacagaccaaatctagcccattgtctggttttgtaccatccatgagctaagaatggtttctgttttaaaaaatttttttttatcaaaaaaatacttcattagagg

SEQ ID NO: 175554 - DNA, 552 bp, Homo sapiens
tgacacccttgtcatttctcaagtccccaggactctagagtggccacagtcttctctccacctttcagcatcttcctatgcttctttgttatatgaagtccagggattttgagtcctaagagggtagagagaaatggggctgctccaccttggtaagacagtaaatctctggcccattcccatttcttcatctttcttttctatcttgcagtttctacttttcctttcctgactcccactggtctggttggattactattcatttcatttttgcttctgtgaatttgaaagttctagtgcttactttcctcttcctggcagtagtgatcagtcccatattttactactatttcttacagactactttctccacaaagaccctcttatccttcaatcttccaattaagacaagacctgtagaataatttccctgtccccatcttccatttggcaaatatttgagcacctactatgtaccaggtgaagaaaagataacacaagaagcaaaataacattcctacctatgaagcttatagtctactggggaacaga

SEQ ID NO: 175555 - DNA, 218 bp, Homo sapiens
accgaggtacgaaccaccagctcatctgcaccaccactcatctgctaaccagtgcctggccttcagctgggctgccttccaactagattctcttagggctcccagagtggggggttttagccctcaccttatgggcagagaagcagggacttgcccagggcacactgccagtgaaggtgcagctgggattcagatccacgtctgactcccaaagtggg

SEQ ID NO: 175556 - DNA, 583 bp, Homo sapiens
gaaatatgcagtcatcaaatgttatgtgacagttcaaaattgcttgcttcctaggttttcactggaaattagggttactaagtcttaaaattctaataacataattaaaactactgtaaatgataagaaaaacaattctgcatagaaagtatacaaggaaagtaagttgttataaggtatgaggttttttttgtagagggaaaataactttgtctagtttagaggttatcaaaaggttgtttcaaaatgaaagaaggaaagatgggggaaaactgaatggacatgaagttgggaagaaagagagcaagagggatcctatagggtcaaactgactaaaatggaatacatttattataacggtttttaaaatgagtcttaatatcaaaagtacactgatgcaaaactagaatttagtcttctcttctaacaacaagggtgttttgtagtcttaataagagatagtgaaattttttttccaccttttgagtgatctgccttaaaaaaaagaggattctgtgttttatcaaaataatttcctgtgcttcatgttttcattattaggtctttgattacttaagaaaac

SEQ ID NO: 175557 - DNA, 1197 bp, Homo sapiens
cgcctgccttagcctcccaaagtgcggagattgcagcctctgcccggccgccaccccgtctgggaagtgaggagcgtctctgcctggccgtccatcgtctgggatgtgaggagcccctctgcccggctgcccagtctgggaagtgaggagcgcctcttcccggccgccatcccatctaggaagtgaggagcgtctctgcccggccgcccatcgtctgagatgtggggagcgtctctgccccgctgccccgtctgggatgtgaggagcacctctgcccggccgccaccccatctgggaggtgaggagcgtctctgcccggctgccccgtctgagaatctacaggtgtaaccagcagctccgaagagacagtaaccatcaagaacaggccataatgaagatggcggttttgtcaaaagaaaagggggaagtgtgaggaaaagaaaaagagatcagattgttactgtgtctatctaggaaaaggaagacaaaagaaactccattttgatctgtactaagaaaaattgttctgctttgagatgctgttaatctgtaactcttgtcccaaccctgtgctcgcaaaaacatgtgctgtattgactcaaggtttaagggagggctgtgcaggatgtgctttgttaaaaatgtgtttgcaggcagtatattggtgaaagtcatcgccattctccattctctgttaaccagggacacaatgcactgtggaagtctgcagggacccctgcccaagaaagcctgggtattgtccaggtttcccccgactgagacagcctgagatatggcctcatgggaagggaaagaacttacagccccccagccctacacccgtaaagggtctgtgctaaggaggattagtgaaagaggaaggcctctatgcggttgagataagagcgtggcatctgtctcctgcacgtccctgggattggatgtctcagcataaaaccgaccatatattctattctgagacaggagaaaaccaccttatggctggaggtgagacatcatggcggcaatactgctctgttactctttactgcactgagttgtttatgtaagcttaaacataaatctagcgattgtgcacatccaggcacagcaccttttcttaaacttatttatgacagagtctttgctcacatgttcctctgctgaccctctccccaccttcaccctatagccccg

SEQ ID NO: 175558 - DNA, 358 bp, Homo sapiens
ttctgataatctggcctttaggaagtccatgggggtttataggctgagggcagtgcgtgggaatgttggtgtccccagtttgagcctaccccagacatttttttctttttccaacttttgccaaatgcataagtgaaaactgatatctcattattttaatcttgctatttttgaaactcaatctattttcatatgtttcttggccactcgcacctcctccttgacaatattgatattttaagttgtttacaaaactgaaaccaccatcaattaaaaaaaatgtagatagacaactgagaaaatattaagggcaaataatgttcattgttgagaacttcattatatcaaatgctgtgac

SEQ ID NO: 175559 - DNA, 850 bp, Homo sapiens
gggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaaaaaaaaaaaaaaaaaaaaaaattttgcgggcccgcgaccaaaaagttttaaaccctccgtgtggggcgccggacccgatgtaaggaacatgaccaagacggccgcgaggaaaccgcgcgacaaaagggcgtgctttcccaaaaaagcgggggccgcggttcgcaacaccgaaggcttcggcgctcggtccacggcagcactactcccgccgcctcgcgcacacgcacacaccaaacgacaaccaggagccacaacagagcacaccacaggagcacacc

SEQ ID NO: 175560 - DNA, 168 bp, Homo sapiens
cattcttctcccagaccttagctgggctgtgtcctcacttcctttagatggttgctcggttgctcaagagtcctctgactgcatagtacggagaggagggctcctgtgctgagtgtcttttttttgcctctctgcattcacttttcaccttcctccaccctgctttgt

SEQ ID NO: 175561 - DNA, 1751 bp, Homo sapiens
tgcagaagtcagcccgttctcccctctctgagagtgttactgtgcttaataagtctcttgctgctttgctacatgtgtgtgtgtcacttccaattctttgttagacaccaagaacctgggacttcacaacaccagccggtaacaaagatctctgtaagacacaaaagttggatgacagtcgttttgattcttggactttactagagactccaaagacgcatctgaggagaaaagctctgggtccctgggatgactgtgccactcgacatagcctcctggagtggccaaagagagtgtggataagaaaagaaatattggagtgaactttcactcactcccacttctgtaggtttcttaaaatatatgggtttagaagcaagatacttggcgttttcaaatgactcaaaagagatgtagatgaagagaagttcggtcatcccacagatcttccggagtaacctggacacatccctaaatctctagctcctgggtcttcgaaagcctgtttgcctcagggttgggaggaaagggtttggaaagtaccaaggcaagggttggcaaaaagattacctcatcagtgaggaaatgaaatttccagaagttttcgccagatctgggaccagagacaaatgctggatgaatttcctatgcaaacctcttttagaaccaccgcttcaaaggccgtccagagacttcaaattagatctggtgaaactgctcccggtaggggattggtagttcagcggtagaggtttttgtctcccacgccggcgactccggtacgactcccggccatgcaggacttcttactcttccggcaggaagggctactacgtttctacccaacaaagttattatattatacaggctgtactgcatttatggaccttggtcgtggcagctagaagctaacctgaggggcgtgccacctctggagcattctctgtgctcgaactaataatcccggaatttacgttcctgtgctcgaagcctgtccttgaaagtggggagtgtttccggtgggttgctgcagttttaaatactgggaattaaaacctttgctactttcatctagtctcccggcaaacccctgggtaacccaaagcccatcagagggattcgcgtgctgggctttccgctacgttaggccacgtctcactatggagcgaggatcaagaaggtccgggaaggagagaagctgcggggtccagggagactcttcggcggttggtcggagaggtttcagcggcccaaggaaaagggaagcgtgtgggaatctatccgcgtagagatgaggggcgcggcggagacagtcccacgcagaggtatgcccaaacaccgagttacttaacctcctcaaccaccttggcatccgcgccttccgtgggcccgtcggtcttccgggagagattctgtgtccctggtattgtgtgtcaacaggtgttagcctgatagttatatttttaatgagagaaaacgaactacagaatttgcgagttttgctttttttctggttttgctttatacctcttggattctccttccaaaggattccaatctgaggggcattgaggtgtgactatggtagacaaggggtggtgaattttcatccaaaaatctttggcggattcccttgctctcccgctccccagtctaagagcagtttaaaacagaagatcagaaacatttggagagtgtttttttctctgcgttctaatgataaacttgatttattcaattccaaaagtttc

SEQ ID NO: 175562 - DNA, 221 bp, Homo sapiens
ccggtcagaggagatagcaggatattttagctgtgcaacatttttaatttgattggaaatagtgtgattgtttaagattgatgttttaccaaggctttggcatcaatccatgcaccaactagataatgaagtgtaagcattaattgcatgggaaaattgctgaattttctctttctttctaacaccccaccgcataccttgaccccaaccttagatagaaa

SEQ ID NO: 175563 - DNA, 873 bp, Homo sapiens
atctgaaggggtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatattaaattctgggattttggtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcagaaaatactgattctcctccaggcagttcacatgactagcttttaggagtgagtataccgttgcccacccctaaaattcttgatcatgtctccagatgtctactgaccactgatgctgaggtcatgaatcttgggcattctagaggctttgggaaaaaaaattctacttacttcttttgcccagacactctggggtctacctcttggtaaattattcaaatg

SEQ ID NO: 175564 - DNA, 828 bp, Homo sapiens
  misc_feature (680)..(681): n is a, c, g, or t
  misc_feature (683)..(684): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (732)..(732): n is a, c, g, or t
  misc_feature (734)..(734): n is a, c, g, or t
  misc_feature (736)..(736): n is a, c, g, or t
ggtccatccatcacttgcagaaaacaaaagagagcaagagagaagacagtgggtgaagtcctggttccagactcccctttttgccgggatatgatggatctgtcagctggtgcctagagtcctagagagctagagatggagggaaattcagatcatctaaacccttcagcccttcactggacagaagaggaaactgaggctccatctgcatgacgttcccagagtcacggcacaaattcatggaagaagcagcaggaaactcagttctccagtctgggtccaatgtgtgttttagaaatatctccacagggttaatgactcaatttttcatgcatgattgctagtaatgacaatcatgttatgtttgtttctgtagctttggaaatcactccttccacttgagtttcaggtcccaactgtccacacctgcaggagtgaggttttgctgagactgataaggcactcacattttgtgggagttgaattgtctctgtagcctagaatctagatttttttccctcctctgctctcagtgaacggagaattccatctcggtacaatctgtgaaccattctgcagtaagattgtcatcgtctcattcatactacctggtcggtaacacagaggctgtaattgatgtggttcagagactcacatccagcataaaatgaattctagcnnannaaaaaaaaaaaaaaaaaaatttggggngcnccnccgaaattttaaccntntngggcggccaagagagaatgccaggccagaaacggccgaagggggttcacaaaaccgggacggtgacaccaggggcgcggtcacgcgaagcgg

SEQ ID NO: 175565 - DNA, 877 bp, Homo sapiens
ggtccatccatcacttgcagaaaacaaaagagagcaagagagaagacagtgggtgaagtcctggttccagactcccctttttgccgggatatgatggatctgtcagctggtgcctagagtcctagagagctagagatggagggaaattcagatcatctaaacccttcagcccttcactggacagaagaggaaactgaggctccatctgcatgacgttcccagagtcacggcacaaattcatggaagaagcagcaggaaactcagttctccagtctgggtccaatgtgtgttttagaaatatctccacagggttaatgactcaatttttcatgcatgattgctagtaatgacaatcatgttatgtttgtttctgtagctttggaaatcactccttccacttgagtttcaggtcccaactgtccacacctgcaggagtgaggttttgctgagactgataaggcactcacattttgtgggagttgaattgtctctgtagcctagaatctagatttttttccctcctctgctctcagtgaacggagaattccatctcggtacaatctgtgaaccattctgcagtaagattgtcatcgtctcattcatactacctggtcggtaacacagaggctgtaattgatgtggttcagagactcacatccagcataaaatgatccttatggtggtctgcagcacgcaaaaaaaaaaaagggggcgtctagagtaccctcgggccagctacggtcccggttctgtcaagggccctatgggccgtatagcaggccggcggggttaaacgtcggctggaactgtgtggacttggagaccctcgggggcttgccactcggtaagctgataatggtgggcgttggggtggtta

SEQ ID NO: 175566 - DNA, 348 bp, Homo sapiens
cattagtggcattttacagttaatgaaatatggtataattttacattgctcacaaggagtattggctgtgttagcctgctagtttacattatgtgatctggcagacaaatcagtttttaaaaacattcagaaacagactcagcattcaggtgatttggacaactgattgatgttattccaaaagaaacctctctctaaggtgattcgtgtgaaactagcaacttctttttgtaaaaggtctgccactggataggctgtgtttgcagttgccacaaattctgaatcaaaggcaagtaatcattaggtggaaatcaaagtaacctttctctacccctgtgatttgagggg

SEQ ID NO: 175567 - DNA, 140 bp, Homo sapiens
caggatctcaagccccaccccagatttacaaaatcagaacctacattttaacaagatccgcagataattcatacgcacagtcaagcttaaggagcatcttgcttgtaagcccaacgtggacctcttcagcttcagtactg

SEQ ID NO: 175568 - DNA, 520 bp, Homo sapiens
acctttcaagtgcagactgccaagtgtcatgaattagaaatgaaagaggaaggagggaaggtactaaattatagaatactttgcttcagtagttaaccatagagtaaattgattcaactgtaagaatttcgtttgttgtggaaaccatgttttttttaaattaattcatattagtaacctcctttgggtaagtgctctttatagagccttaaactagacacgcagatcttaagttttaaaggttttcaatccttgtgtataaaagcttcaaaattatgagggggaaattgtgaatgtttttaaccttatggccagcatgttgatgtaattaataccccttttcatttttataaacgggttccccagaattccaacctcttagcttagaaagattaggtattcaatatttgagttttaagaaaactctgggaaaaaaaatgatataatgatcaggtatgcatatcagtctacaagaaatttggactttattttggcttaaaatggttactacttagcacca

SEQ ID NO: 175569 - DNA, 349 bp, Homo sapiens
gactgtgatgtctgagagaagagcaaacaaggggagtcctagcgctgcaccacattgctgccttactggtacatttgttggatgtagctaaagcagaaaaatctacaacatgaaatgtttatattagaaaaaaggttttaaatcaataatctgagcttctcctttaagaaactagaaaaagtagagcaaactaaatccaaagcaagcagaataaaagaaaataatacagataaaagtaaagcaaaaaaaatcaatagaaataaaaaaccccagaaaaacagctctatataattgtggaggtagttacacaacttgcatatctttgccaaaactcatcaaattatatgtt

SEQ ID NO: 175570 - DNA, 682 bp, Homo sapiens
caggtgggctttgtttgtcctacatagtatttttttgagcctaaatgtgaaaatcaggtgatctgacatacaaatccagatttccagcttctcttgagccttccaggtctgtagtcccacaaggcagtgaccactgggctagacggggcttctgcattgtccaatctgccctgccatgagacccctgacatgttcttagcacacctcgggatggttttcttccttgctgacacatgtttcttggaaccttcttctctatcaaacgtgggaaaaccaaaggcagccagagagggtgacagagtttctctttcgcctggcctgctccactgtttgcgttactgggtggtggctgcaggcatctgagtttgtggctcctgctttacagagaggactgtggccccaggacagaggggtccttgcagcagataagaagacggccagcctggctctgtgaggactgtcagcccagaagccagatgggtggcctcgcttgtgaggacacgctcgtctaacagcagtgcagagaggtagatatgccggtcagggcaggacggctgaatgcagcacccattgttgcctggctggagctgcccagccacaactcaagagaggccttgacagcaggccaatggctgcccagcaccagcctttaagcacagtcctccctgtgcccacgcagtcc

SEQ ID NO: 175571 - DNA, 449 bp, Homo sapiens
aactgggattacaggtgcccgccatcacacccagctaattttttgtatttttagtagagacgaggttttaccatgttggccacgctagtctcgaactcctgacctcaggtgatccacccgccttggcctcccaaagtgctgggattacaagcatgagccaccgtgcccagcccacttcataaattttagtcatgctctaatcttttacagtgagtctgtgtgatttctttttcttttttttgagacaaagtcttgctctgtcacccaggctggagtgcagtggcacgatctcggctcactgcaacctctgcctcctggattcaaacgattcttatgcctcagcctcaccaaagtgcatggagtttatagagcatacagccaccagtctggcaacagtaggcattcttgatggacataaggagttcgtatccacattaaccataaatcac

SEQ ID NO: 175572 - DNA, 255 bp, Homo sapiens
ttagaaagataatacaccacaatcagatacaatacattatatcaggaatgtaaggatagttcaacacacacaaatcaataaacatgatatatcacaagaacagaatgaagaataaaaaccatataaccatctcaaaagacattgtaaaagcatttgaaaaacttcaacatctcaacaaatgcacaaaaggaacatacctcaaaataataaaagccatatatgacaaacccaaagtcaacatcatactgaacacag

SEQ ID NO: 175573 - DNA, 499 bp, Homo sapiens
tgcataatccccagaacttgtgaatatcactcccacaggtaggttatggcacagctgtcgtttagaaatggagattgacctgggtggaccttacctcattaagcagtcccttaaaagggaccagactgttcctgaagaaggatatttgacatgtgagagggacacagggagatttttcattgctgactttgaagacagaggtgacctcgtggcttggaaccgtcagtgactttttggagctgagtgcagcctctgacagcgagtaaggagagaaggccctcagtcctacagctgcaaggaattgagtctgcccacatctggaatgagcttggaagagggtatttccccagagccttgagaggacaacctccttagcttggcccacactttgatttcagccgtgtgataacccaggcagaaagtccagctacaccatgcccaaagttgtgacctatgaaactgactgctaataaatggatgttgtttcaagccactaaat

SEQ ID NO: 175574 - DNA, 270 bp, Homo sapiens
cttatacagggaataaaggtagtagtaacctaatctgtaaatgtgactttgtactacattttattattttttcagcacgtctttaaaataacttttctaatgaaaattagtatgtctactatttagtaggcaagcaatgtgaagggaaattgatccacaatgacagttctactcattctgttctcactcatgagctgaatgtgcaaattgttccttgccaccatcccatattccccacacccaccacttgcagcattacaccgccaaaca

SEQ ID NO: 175575 - DNA, 158 bp, Homo sapiens
gtggtgggagaagttgctgcatgtttgcgtgataataggaataatctcctggaaagggtaaaacttgctgatgtagaaagggaagagaattgctgcagcaacgtctgtgtcagtaagagagggtaggccacaatgtgcagtgcggggagtggctttag

SEQ ID NO: 175576 - DNA, 276 bp, Homo sapiens
aggtggtaacctttaaactaaatttagcaggaagaatagcagtatttcaggggatgggaatccaaaggcatgaaagcacaaaaacaatacagcatgttcaaagaatagtgaggattttatctgagtccatccaatgatgcctagggggtaccggtagcaaatgatctgtagaaggtaaatggggaaccccggataagaaaccacatattaaggagtttgaaattttgctgtaggtaatgggagccctgtgaaattttttattgatgtgttttacaa

SEQ ID NO: 175577 - DNA, 233 bp, Homo sapiens
actgaaggctcttttcctgcccatgctgcacatcctccatggctctcctgtgccctgtgccccacatgccctcatcctgccacgagaataaaggagcagcctccatatgggagctgtcagctgctctaagagatgaaggagagagtggcccgtctcaatggctcccaactcttttgcctcgaggtgacacgctctccttcatctcttagagcagctgaggagggcagaagggg

SEQ ID NO: 175578 - DNA, 675 bp, Homo sapiens
ctctgtctcaaaaaaaaaaaagacaaaatagaaaaaccacataaatattcactttattgccaacaggaaaaccatcacttcctgccttattgtttaaaaacacaaattcacccatattcaatcacatgataaactggaggggctgcagtttgcatgtgactgagtgacttgccagtgtgattatgttgcagatgtcagcagacacatgtcaagggttagtcaccagacgttgccaagaaatacgaaaagagaatctgcatgcgatccaggcactaacacagcagtacgcttttattttgctggaagagcctgtggcacagcccatgcattgacatttgatcttgtttcagctaaactaaatgtgtctgttaagattttttttttttaatttgaggtagatttaggtatgaggggaaaagttttcagcccttttcctggcatagaccttacaaaagaactactttctttagctgtgtttgttgaggccgttggtgagggtttgaaatctttttagttggcttgctgctaactggaaattgaggacggttgggggatgcctgactccacgttttaactaagctctctctgaaaagggatctccccagcaaaatctgtagtgcaatcaattaccaagggagcggctgaaagtgcttaatatgcttaagctggcttcag

SEQ ID NO: 175579 - DNA, 214 bp, Homo sapiens
aatgggacaagcaaagaggagggaggtaggaaacttctggctttggggaacagtcagtgattcggtgtagaggaggagggcagggagtgggagatgcgcctgttaccagagggaggggctgagcactgtgaaccacacacatgaaggccagcaagcacgggaaagccacaggaggttctgaggaagagaagtgtggtcagacttgcatgttagg

SEQ ID NO: 175580 - DNA, 185 bp, Homo sapiens
caccccctgtgctaccacacccccaccaggacccagtgcacctccatctctgtgtaatggccttgcccctccaccctccagctgcagcgactccccaccccctccctggccctcaaggcctcagcacagaaaagcctttcttaatacttgttgattgatttgcaaatataacctcacaggcccca

SEQ ID NO: 175581 - DNA, 381 bp, Homo sapiens
gacataggagtttgcttgtgctaacctgtgcactgggatgccgtgggtgctggagcatccttctactgcaggaaggatggccttgggcctgcacactgttggacttcttgggcccaacagaaccagctcctgtggcagactgccctggccacgcagtcacttggtgccccaatgtcccaaggtccagttttcatttgttttgtttttggaacaatgtccattccctgctggggaaggcacagccttgatctgggaccataagattatgcactatgactctctcacgaggcttctgctagaaacaccacctggccctgtctctaccacagctatttctagcaccagggggtgtgctcgattttctgaaccaagcagaaggtt

SEQ ID NO: 175582 - DNA, 521 bp, Homo sapiens
ggaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggatattcaggaatatggagatatccctgactcttccaaaagaatgaccaagatcatgcctaattacctccatgtcctgggaaagccccgctgtaatggagatggcatctt

SEQ ID NO: 175583 - DNA, 571 bp, Homo sapiens
gaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagc

SEQ ID NO: 175584 - DNA, 512 bp, Homo sapiens
ttatttattcaggataaatttccagatgtaaaattgctagatcaaagcctttgcaagatagtgccaaatttaccttcccaatatcagtgtataagaagtgtccactccttcccctgtcaacaacattgggctggttcttttttttgttctcattcttataaaattattcatatcccagtagctttggctggttcaactaattaatggaatttagtgttcttctcttaaaatcttttaaaagttttccactttgttctagagttaaatagtgcttcttttttcatgttggatgagaaatagagaaaagggatgatttgtgaagaaagcatttatccacataattataaaacacttctagcatgaattgaaatgtttgacagaccagacaagcagatgcttttactacagtgtttcagttttgtgactggcactaacatgtatattacagaagctaacatttgaattctgctaagctgtggtttgggtcatgagaaatgtttgcatctaagttg

SEQ ID NO: 175585 - DNA, 505 bp, Homo sapiens
gccctgctgggattctgggaagaagtctgctacttccctatcctcagagagcttgctgtctcactaaggagatgaggcctacccacaagaaactctctaagacaaacaccaggcagtatatgaaaccagggctcatatagatgatgtggaaatgctcagaaaacagcaccagtgtagagtggtctcatcttggagtaagccctacagacttactttataaataaggaaatcatcagcatacagggaaatgttacccagcctttctttcctgtgtgacatacccaacagacaggaacacattaacacacaaccactaacccaatttaagttcgagaagactgcatgtccgtgtcactccatgttgctaggttttgtctttagggctatgtggccagatggggcagtttcaggctccaccaagaccagcctacagagcatgccccagaccagttatagagcctgacagtgcccagcagccagtatcactggatgcagaatctgcgag

SEQ ID NO: 175586 - DNA, 456 bp, Homo sapiens
  misc_feature (427)..(427): n is a, c, g, or t
cagcaggatattggctctatgtggtgtgtatttcactgaatgcctactatggtcaagtttttctggctctaagttcccttggaaagggctctctactttagctgaataactcagcacctaaatctgtcaaccacacccttcagtaggtaactttgttagaaatatggtctattaaggtaagagccaggatttctgtggttgcaaaagtggatgcgggctctgaacaaaacctctagtgagctgagatactttatcagatgacatatttgaccaccaaacttctgttggagcagggctgatttgccaaacagacagcaaccttgcagacttagttgatggctagaattaagactcaaggtcacttcagggcctgtcactgattgtgggagggcttggtaaaaattgaacctcattaacaccactaaangtgtgaagggatcctctgaacgcgcagca

SEQ ID NO: 175587 - DNA, 510 bp, Homo sapiens
cagcaggatattggctctatgtggtgtgtatttcactgaatgcctactatggtcaagtttttctggctctaagttcccttggaaagggctctctactttagctgaataactcagcacctaaatctgtcaaccacacccttcagtaggtaactttgttagaaatatggtctattaaggtaagagccaggatttctgtggttgcaaaagtggatgcgggctctgaacaaaacctctagtgagctgagatactttatcagatgacatatttgaccaccaaacttctgttggagcagggctgatttgccaaacagacagcaaccttgcagacttagttgatggctagaattaagactcaaggtcacttcagggcctgtcactgattgtgggagggcttggtaaaaattgaacctcattaacaccactgaagaagctgatagacaagaaatgggattaagactcaatactcatcaaaataaggctttccttatccacagcctacctgagcagtgc

SEQ ID NO: 175588 - DNA, 550 bp, Homo sapiens
tcagcaattgataatagggctgccaaggtgttgatatttcagacttatgtcatctttgaggagaagatctagagcatgtaattgtacatgggtcatggggaaggggtggcaagagagttagaattgcgaataatgtggtcaggagccttcaagagtctttgagtcagcaacattatgaaagatgtggttcaggacattctagtaaattttggagtctcctgagaagaaacttagaattctagactcctgaagcagggagagactttcagagagaacctagtccagcacagcatgtttacccaggacaggaaacctctatgctccatgccaacacacaggcatccaggtctgcaaagtgtcttttaaaaggggacatattatgcaacccattctgtttctgaaaagttctgtgcttggaactgaggctcagctgaaatcactgtcgctacttctatccttgggtcctcattttaccttctggacctatttgtatctacttgaaatctaacacctctcctacctaacagtcctgagggtgctcattttaaga

SEQ ID NO: 175589 - DNA, 307 bp, Homo sapiens
aagtgtttgcttttttatattaaatcttatatgttggaaattattgctctccaaacttattttaccctgacttttcccaatctgctttagttacttgtagataattcagctgaagcatctcatggaacctggaacaattaaaagctaagcaaagaatcttgtaaccctaaattatctatttttttctgtcattctagtttccagttacatgattctttccttttggttttccatcaaatctaacccatcatttggttctgccagttgtctttgaatttctcagttcgatttttttccatttctgtag

SEQ ID NO: 175590 - DNA, 416 bp, Homo sapiens
cgttttatacacccaaacacacagacaattaggataatgctgcagatgaagttttgttatgttgctgttttcttttactatattgtgaacatttttagtgaggaacatttagcatgcatgattgataaactatactaagagctgtgcataatatcctgacttaaaccttgaaagtaaattgccactttttgaagttctgatagatatctagagtggcagatacaaatattttttggctcagctggagcaattgtttttagcacctgagaggaacttgtagcttattacttcgcttccaaaatacagtaaaaagtggtagttattttgcctgttatcaaaaccactgctgatttgtctagtgtaactttatcaaggctgactggttgtatcataaaaggtgtaggcatattaatata

SEQ ID NO: 175591 - DNA, 451 bp, Homo sapiens
aagaagcatggtaccagcctctgcttctggcgagggcttcaggggacttctactcatgatggaaggtgaaggagagcaggcatcacagggagagagcaaaagagcaagagagaggggagctgccagactgtttttagcagcgatatcccccgctggaaccaggagtgagaactcaattctgcaggaatggcactaagccattcatgagggatccgcccccatggtccaaatacctcccactaggtcccatctcgaacaccagggatcaaatttcaacaggagattgaaggaacaagtatccaaactatatcacttattaatttcaattttgttttctttttgtattttgaaggcaacgagttttttgggcctcagccatttttgtaggcccttgaacaattcacaggccttaggactataccctatcatgactaatgggtgaagtagcctt

SEQ ID NO: 175592 - DNA, 619 bp, Homo sapiens
taaccgggcctgcgggcgatcgttaccactttggccccgagaaccttcccatacttgctgaaaaggttcttgagatccgtagcgcgtgtgtggaggacagcccgctgacccacaggttccgaccagaaccgctgccgacccgacctggcacgagagggagattcttaggcatcaccccaaggcctaacaggaagcacaaccattcttaagaccgcggccctctttaaaaaccctaacgacgcccaatcccaactgctgacttaagaatttaacacacacacacacacacacacacacattatatgtatatatacacacacatgcatacatatatattttaatagactatctaaatactgaatggtagggatcatttgagttgaatgtggtatattcaggttggtagactatcaagcatccattcaaaattgtatagattttgtggcacccatgcagggctcctgacagaagcagggatgtaccagtgaggcatgtctatcatggacactacggggaggggccaggaaggaaggaaaaaagcttcgttgattggggtggcaggatcacaaattatttcttttacattttggttgctaatgaccttgttataaaactattt

SEQ ID NO: 175593 - DNA, 839 bp, Homo sapiens
cagacctgaagcgagtatattccccagaagtcataaaaattgaaagatacacggccaggcgcagtggctcatgcctgtaatcctagcactttgggaggccgaggtgggtggatcacttgaggtcaagagttcgagaccagcctggccaacatggtaaaccccgtccctcataaaagtacaaaaaaattagccaggcatggtggcgggcgcctgtaatcccagctactgaggaggctgaggcaggagaattgctcgaacccaggcggcggaggttgcagtgagccaagattgcaccacttcactccagtgtgggtgacagggtgagtctcctcaaaaaaaaaaatacaaacttttagccagaagttcaactttaggccttaggtttgggacttagccacccactaaaaacaactataaaaattggtcaaaagatacaaacttagtatttccaggcattgaacagcaggctttccaggactgtcatccttgagaaaatggagatacatgaggtgagccccacgtttctcccacctttctgctcagctttctgcgacagagcacgttcccgttgcagcacaagtggagctgcagtatcagaacctaaggaggcagagagtggaattctgggttgctggcatgactggaatatttgctagagaggaggaactgctccaagaagttctagaagtctctggacattcaaactaggtcctgagaactgtatattttaaatgcttgcattggaactgttttaaaccaatgatctcaagtctttgtcttaagttagaaaaagaagggcaaattaaacgccaagttaatagaaggaataaaatagcaca

SEQ ID NO: 175594 - DNA, 328 bp, Homo sapiens
gtgaggatttattgtaccatgcaaaaacttaggatctttacaggttttattatttgtatttaacactagttccatttcagctggtcagataagaagaaatgtgatagcaaaagatatgcaagatgttaatctgctcttaaaaaaaagaaaccaatatttgacctgaattgatacaagtgttttcttttttttgagccgagacagggtcttgctctgttgcatctagagtgcagtggtgcaatcatagctcactgcagtctcaaactgctgactcaagtgatccttctgcctcagactcccaaagagcttggattacagacatgagcca

SEQ ID NO: 175595 - DNA, 414 bp, Homo sapiens
caagaagtatgtaattttacaaaatatttttacaagtgttatgcaaatataaggcatacacaggaattaaaagagcagcaatgtatgagagggcgtaggagagtagtgtattaagtaggaaggcaaggaagaatgatgttaaaaaaaaaaagctgtgaacattgcagaggtagagaatagcccccgctgcctttctccattgttactattagttactgctcagcactcacttctcaggccaagggatcttggcccaaaattaaaacagtttatccgagatttttcattcccatgttaataagggattgaaaagtttaattaaatagcctctttgttcatctcttctacatagaataagaagtgaacatacataaaggatcaaaagcaaatttatttatgttgcttgtaatttaa

SEQ ID NO: 175596 - DNA, 516 bp, Homo sapiens
agaactaggacagtcaatgagctttaatgccagtttcctcatctttataaaacttgaggtaattagacctctcctgcccaccttagaaagctattcataaggaacggctaaacaaatggctgacccggccacaaagagaccacacgatgttctgtgcagttatgtataccacatatgagaggaaaatgcagccaaggaagattctgagtgactctgataaggcagtctgagagtcaaaacacaaagattcttaactcataccaaaaacttaggccaatttacacagtcttgaatcaaaagtccatgaaggcagccatttctttgccagctaatcaacactaggacctattaacctttccgatttgccagattaaaaatgctgtcttcttgccttcctcttctttccacccctctgatcaattattttaatttgaattgccaatcattaatgacaatgaacatacttccatttgtattttcttactgaaattgtacatctctattgcccattagcca

SEQ ID NO: 175597 - DNA, 524 bp, Homo sapiens
caggaccttgcagttagatataataaaacctggaaactcagtagaagtacgttatttaaaaaacaaaagcaaaaaaatgttaaaagcagttttactggggtagtaggtatatgtacaatttttttttttagtttgttatatacttgctacctctcaaaacacatctttttaagaaaacattgaagtaataaaaaaatcctttagaaatcttataaagtatttttggggacagagatgactattaacagggagtgttttattacattctaaaaagattcatcacaaggttccacacaaaagtcaaatacctggttctaatctataacatatgtttccagtttaaactggcctttaaaagcagtgtcttgcttttgagaaaaaagtagaaattcaccatacacatacacagatgttgatagctaagagggaaaatgcttaaaatttaagtttatatactcttagcagtgcctctgtgttaaatattttatctatttccttaagtatagttcactctaacagttcca

SEQ ID NO: 175598 - DNA, 362 bp, Homo sapiens
gtttctcatggttcagcatccaaatcatggaagtgcgggtctgtgtagagtgagacagcctaagcccacctctgccctggcccccacactctaggtgagcagtcatgcatgcatgcattcatttattcactcaacaaatattcagtgagcacccatgtggcagcctctcttctagaaactggagatacagggttaaaaaaaggacactgttccttcttaccctgtttgcatcttagtatggatgacagtaagcaaacaaaccaacaaacatacatactagtgataaatgccttgagaaaggaagcaggttaagagatggcagtgaggggtgcactattttacacacagtggggtcaggaaga

SEQ ID NO: 175599 - DNA, 478 bp, Homo sapiens
gaaaggcacagcccactgaggaccggacactcccagcctcagtgtcctccggagccaccgtcatctgaaggcgtggggacaggcagtgccctcccacctcaggaagagctgtggggtgagctgcggatggcgtgagcagtgcagggcggccctcgcagcggggtctctgtgccactctctggtgcccctgaggggcatgtgaaacagaggagaacctggtgctgactccgggaagggccctgagaaggtctttgaccagcatcagacctggggctcccaggccaagatagaggcaaagtgaagggacgtggggccccttcttggcaggctctaggacagtgggtgtccccccaaatcccctcgtatccagatgaccaggaggcggctccctcccctgcccccagcccccagcctccagggctgtgccaagtgtggggatctggggtgggcagaggcggcctgagagcctcaggcgctg

SEQ ID NO: 175600 - DNA, 395 bp, Homo sapiens
tctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctacc

SEQ ID NO: 175601 - DNA, 409 bp, Homo sapiens
agacgtcacctcctcaaaagccttcccagattgcactttcatcttccaggctgggccttgactctcagcactgaaaactcttcattgtaattggctagctacatgactagccccctgccagatggtggcaggcaagctcctagtctgttttgtccctcccccacttcccatcacctcaccccacatgcatgccaggaacatagtgattattaatgcattaattcactagatattgactaagggccttttttaagttctccagcagtgatgaagacaaacgttgtaggctgggcacggtggctcatacctgtcatcccagcactttgggagactgaggcaggaggatcgcttgagcccaggagttcgagactgccctgggcaacaaagtgagacccacccccatctctcc

SEQ ID NO: 175602 - DNA, 539 bp, Homo sapiens
gtgaaatgtaaacttttctatgttcatttttgcctgatgatctatcactgcagacatctcctttagcattcccttaaaacatgactccgctttgccaatacatttccaaagggagttcagggccacatatttgcctgtcatttattttttactcaactaaatttgttcaaaaatttagtaaaatcttcctcctagtaattctgtgtataaaatttagttctgctctgtggagctatccagattaaagctgtcttcatcattttacatctgtggaaacattgcttcctggcatctcttcatctattacttccacttattacaaatatggcctggttttcagaaacattcacactcctttatcctcttctaagcacagtttcacttgccaatacctcaattaacagatgacaactaaatagaaaactcccagaatggctgtgtgaattctatctccagtgaaataaccataactggggaaaattattaaaacaacacttacaactatttaaagtctctgttaattgtcctaagggcacaca

SEQ ID NO: 175603 - DNA, 371 bp, Homo sapiens
cagttacagctgctcttaacggttagatatctttctatacctttttttctacatgtatgaaacgcactgtcactatcaagaacaacagtgctatgcattttgtaagccttcgtgttgtaatcggttataatgtagacagtgagtagatgcccagagtatctgtggtgttgtaatatatttatctatagctgcgtgttttacctttccccaagtttagatatcataatgaagcatttaattcatgcttgttcacttgctcttcatcgcattacacactgggtgatctagaaaagaatgttaattggaaggggcctccttgcagtgaatcctcagcagccaggtagcagaactactccttcttatgtaatagt

SEQ ID NO: 175604 - DNA, 405 bp, Homo sapiens
caaacacagcagtgacctggaattgaggaaggaagagctgggaatccaattagatgagaaatggctgggggatcctggagctggcctgagatggggatgctggagtctccagggccgcaggatccctctcccccagcaccagcttcagagccaggggggccaggggggacagaggtcaagcaggcacgggttcaagcctccctgtctacagacctccccagcctgaacctcggcgtgctgctctgtaacctggggccacagagtactaggttttttttgtaccaacttttgaaaacttttagtacaaaaaaaggtgaaatatctcattgatttttatattgattacatgttaaaaggataaggattttgacatattgggttaaataaaatatatcgttaaaagta

SEQ ID NO: 175605 - DNA, 269 bp, Homo sapiens
gatgattctacttattatgatgagatgcttctaataaaagttacaccagtagaaaatgccaatatttcataaggccaggatgatgacttagatagtactaataatacaacactttaggaaagttcatttcattttatttttaggaaggacactaagtttcaaaaatttaaatttaaatgaaagagggtcttaaaactctattgcaaaaaggactcagctgaataatctgtggcacaggtttaaatcgccttggaccacaccgccatgtt

SEQ ID NO: 175606 - DNA, 730 bp, Homo sapiens
gaatataaatcatttccttgtacagaatcactgccaaactcagtatggttaaaagatttttaacacccagctgcagcattcactctggttagaattggccatttaaatttatttcacatatgtaagtatcatatcctttataatgcattcttaattgttgctcagttcttccagattgaattcctttaaaaaattccttatgtaatcttttaattctagttggaaaacatcacttgacagttgctgtttatacaggcatgcctcgttttattgtgcctggctttattgtactttgcagatactgtgtttttcacaaatggaaggtttgtggcaaccctgcgttaagcaagtctgttggcaccattttctcgacagcatgtgctaactttgtctctgtctcacattttggtaattctctcaatgtttcaaactttttcattatgattacatctgttatgtggagctgtgatcagtgatctttgatgttaacattgtaattgttttggggtgccacaactgtgcccagataagacagtgaacttaattggtaaatgttttatgtgttcagactgttccactgactagcccttcttcaaactctctcactctccttgggcctccctattccctgaaatacaacaatattgatattaagccaattaataaccctacaatgatttccaagtgtttaagtgaaaggaaagacatgtatgtttcaccttaaatcaaa

SEQ ID NO: 175607 - DNA, 626 bp, Homo sapiens
gcaggagaattgcttgaacctgggaggcggaggttgcagtgagccaagattgcgccattgcactccagcctgggcaacaagagcgaaactccatctcaaaacaaaacaaaacaaaacaaaacaacaacaaaaactacaatgggctaaaacacatcaactatgtttaaatccttgatttcaaaataatacccaaataaatttaagtcatcacccttggaggaagctagtaaatgattcattatattgaaagcttatagataaagggaaagaatcaaatgtttttcttgcctttcctacacatgctataccacttgctaaccaaatagtagatatgaagtttctctttaaagaagtagtccagctaataaagacagaatgatagaattagaatatcattattttgcaaatccaatgaattaatgaatgcagggattgattactcaagggtgctaacttcacaaaaaaaagacaatcagacattatgtgcgtttgaagaaagaatatatgacctaagatgctcaagccatacatgtaccacttttaggaaacacagagaacaccaccttgaggatgtaaattggcaaaattcacgccgtcagaaatatgttgcaaacaacctgattcgt

SEQ ID NO: 175608 - DNA, 713 bp, Homo sapiens
aaagtggagctgagttaatctcaagcttccctacatcctgggacacagaactcttctttgaaggaaggaaagaatgctgtctcgcaggatcgttctctacagaatagctcacgggcagggtgttcctggaatcaggggaaacctcaggctggctgattcttaagggccctttcagctttaaaacccactggtgccacctgagatgctgacagcagtgggactgggatcagtgtgttcctttctagagctgtagggttatagaatcttcacagaatttctattaaaattggcttcaaatgatatgtcctttgatttttaggtgatccacggaagtgttcttgaagttgaaagaagcagttgattttacagagtttaaaataaatctataatcagatgttgaggctttatcctgacataatttttctcccgactataaagataatgaaacttctaacaaaaaaaaattagctctaatatgagcaaaagatgaaaagataatgaaacttctaacaaaaaaaattagctctaatatgagcaaaagatgaaaacgcaagctgcccgtaatgccagtgcccacagggtgcccgtgatagtgtgttacctgcgtcccttgagactctttcccgagtctccctttccagaaatgatgccattctgtgcatgttgttacatcagtggccttttttcacctttttagtaaacgcacattttca

SEQ ID NO: 175609 - DNA, 568 bp, Homo sapiens
ctgatgtcccctgtcttttgtacaaagatacagcagtttgaacggtggctccagaaccatttcctcacccccagaactgtgaatgtgaccttatttggaaaagggcctttgaagctataattaagtgaaggattttgagttcatcatgaattacctgggtgggtctaaatatagtaacatgtatccttagacaaaagagatgacacaaaggaggccatataaagagggaagaagaagttggaatgatacagtctgatacagtcacaagccaaggaatgccaccagtggctggaagagataaggaagtatcctcccctagaggcttcagagaatgtatggtcttgccaacactttgattttggacttctggcctccagaactaagagagaatacatttctgttgttttaagccaccaagtttgtggttatttgttaaaacagccacaggaaactaatatacttgtgctgtggtttgattatgtccctcaaaagttcacatgttggaaacttagatcccactgtggtggtgttgatgaggcctttgcagggagcaaacgggtcatgagga

SEQ ID NO: 175610 - DNA, 106 bp, Homo sapiens
cagagatttaggagacctgatgctatgtctggccctgcgattaattgtgtgacttagtgcttgttcccttacctgcgaaaaaagggggccgtagtagattaccctg

SEQ ID NO: 175611 - DNA, 315 bp, Homo sapiens
tagaggatctcggaaggatcctggtggttatagcaaagtatacactagaataatttgagtgtttgagatggatacaggtatctctttttttaaattagtaggtacaaacaaagaacttgaaaaccacatccttttagattctttgttgtttctaggagtgtatttcaaggtggttagtaatttgtgtttcctgggctccctttaatagtgttagcaaatttgctttgtgattaccttgacttataatctccccacacactgagttgcctcttaggatcagaaaattattttctaagccctgaccatcaccaccag

SEQ ID NO: 175612 - DNA, 465 bp, Homo sapiens
accccctcccatcccaatccccagcagtgctgcgtcacttccagagaagcccagaggcgcggagttcggggcaacctcggacccggggtgggatctcagggtgggattcgaagctgggacctgccagggacctccagctccccaaaatgcgatctcaagccgtgagctgctcaggctttcaggcggagcaaagcactggcaccctgggagccggcagcgggtggccagggcgaggccaagccacatacctctgactcacccggtgtgcgccggccgggaagggggcctggttcagccgccgccgccggcgacgagaaccaattctgggaaggagcaagatggggcagaaggtgcgcgcgggggagcaactgagcaaataacacggcggtcgcggcgcgcggcaccttgggctggcgcgtggctgggaggccgcatgggcgacgcgcaccaggctgcccctctcct

SEQ ID NO: 175613 - DNA, 481 bp, Homo sapiens
ataggagttcattttgtgaagctgtcacgagttttccagtagaccatgagcttgctgatggcaggagcctgcctgtccttgatccttgtttctgtggggtctatcccagtgcctggcacagtggctttggagatggaaggaatagagggagagcagatcctcaaacacagcctgcatctctccctgctcccctcccaccctccagttttccagccagaggcatttgctctaaggcccaggctgtggcccacctatcaccgctacccaagtagtacaggaaaaggaaatttgaagaggaaaagaggcaccagggatgaggacacaccgagaaaagaccatgtgaagacatggcgagaagacagccagctgcaagccaaggagtgaggcctcagaagaaaccaaccctgccgacaccttgaccttggacttctagtctctagaattatgcgaaaataaattcctgttgtttaagccacccact

SEQ ID NO: 175614 - DNA, 401 bp, Homo sapiens
cataaataaatagtcctgataaagaatactaaaaattagagatccggccgccacttctaattccagtctcctcttccaagtttccagaaatgtctttggtttacagcttttcagaccttttcctgtgcatatgtatacatgtgtttgtgtgtatatatgtgtactttgtagaaaattttaaaatctcacctgagtattactttgtttctaattgttttgttggcattctccttctttctgatgactcttaacttcctatgctgcctagagagagttaaaagaagaaaatgttttgaaataatttcctttatcagatctcagtcacctgaacattaatttcaaaccaaaagagagttacagaaagagataattaaatgtttgccagtgacttgtaattgcct

SEQ ID NO: 175615 - DNA, 151 bp, Homo sapiens
ccattgaaaggtagagagttcactgtgctgactttccttctgggtatcggccttgtggttgaataactgcacctctcaggcacctttttgagtgctgtgttaatccagggtctgttcctaacaccctggtgttttgaagaaagagccgggg

SEQ ID NO: 175616 - DNA, 478 bp, Homo sapiens
aaacataatttactgagcacttcctaaaccaagtatttttaacttattatatagagtaaaaaatgaacaccatgctgctaacccaagactgacctaggtttgagggcagatctagaagagaagagaaaacaactgcttgttgggatttcaagaataaatatactaagaactataagaaaacttatttaaaaacatcaccacacacctgcagctcagaaacatattaagaaacagaaagcactgtctgtcctgattctggagtgcagactgcctagatggcactccttccaagcctgagaaccaaaagaccagagacgagtcctaaagcctgaaatggcatctcactgaggtctctactgagactgtgggacccggatggtcacagaaccccaagatctaaacgaagagtcaggaaaggagaaataaaggtaacgaggcccaactcttcctccagcacggtggggcgagcccgcggccg

SEQ ID NO: 175617 - DNA, 241 bp, Homo sapiens
ggctatggagctgctcaagcttgtgtttgcacttatcagaattcaaggcagttagaaagagtttccaagtgctgatgtgctggagaagaaagggcatgctgcagtgtagaaaccacgggagaaacaattgcgtcacctagtttcaaactgtgagaaaactactagcgaactagaagaatatttaacttcctaaacctgagagatctacatcttaaagaatatagattctactctaggcaca

SEQ ID NO: 175618 - DNA, 442 bp, Homo sapiens
ggttgtttttctgtgatgccaaagagaaataaggtcaatttgcaatctgtaaagttggacttgggccttatcaaacacagagctgggaggcagattagccagagaagcacctactctctgcccccactgagaagtctctgcccagactgagcgtctggcgtcagcagagccagcctgcccctgcagtgaagctgccagtgctctgggacagcctgactcaggtgctgctctatgcctgggtccggcgggtcacacagggcagcccctcaccctggcctgcagatgcctagctcagcttcagaggtggaggacccgggccgggttccctggccatggctccctttgcactgagaaattggccttcctgggcaaggtctgcacgccctcactgtttggctggggccggcgcagggcctcagttctcactagaggtgagggcact

SEQ ID NO: 175619 - DNA, 783 bp, Homo sapiens
tgggccagattcttccctgcatgtgtgattcatatttggaaatttctgatttatctccccccaattgtgccatgtggcctgcacttaaaatgtaagtaattctgattttattctcaagaacttatttgaagattcaagccaagcaatgctgaaaaaagctaggcctgcaaaactaaaacatagcacgagcctctcaaaatttccaccaaatatacaaaatccagtctgctctgaatgtgcatcagaaactcaactttggttattagccctggaatttggtgccaaaaacaaaaatttggttttgttgtcaagcaatttctaaaggaagaaacaatgtaaatattaatctgtcattttaaatgttgttgaaactgccatgagtgtgcacacagctctctgtttcatacctgtaatcagtattcgcatgctttcagtccactgtttctacttaaagcattattccgtatttcagcacagaatgactttggtgaaactgtagctgttagtgagtaattgcgttacaggcagacccagtcttaaattaacaaatctgggttcccttaactatcaggtttatgttggttttatttgcttctatctggatcccttctctttgcctgggaccttattctgattagctagatttttaagagcttttaaagttacattccccagaaagactttttttctctggactttctcttttatggtctgtaaacatttctcctctgatggtcatgacttagttctaagactggccttcctctagtgtgatggtatgag

SEQ ID NO: 175620 - DNA, 385 bp, Homo sapiens
  misc_feature (44)..(44): n is a, c, g, or t
agggcaagcttgatgcctccccccgaccctagaggaaacccggngcttatggatgccacctcatacatgtgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaagggcagttgcaggctggcccagggcagacccaactgagggcaatggtccttagagctatggccaccctgacgtggatgcctggtga

SEQ ID NO: 175621 - DNA, 233 bp, Homo sapiens
agctgcagattagcctcgaaggctatgagaaggctttggaatttgccaccctggccgccaggctcagcacagtcacaggtgggtggtcttcactattgggtgtgttgaatgagaggggtgattagtcaaggatagacagcaaagcaataacaccgcaggccctggagtcagactgtgtgggttcaaatcccaggtccaactgtcagagagaccttagttaagcaagttgctta

SEQ ID NO: 175622 - DNA, 1234 bp, Homo sapiens
agctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacacaaa

SEQ ID NO: 175623 - DNA, 1400 bp, Homo sapiens
tgcaaatattccaaagacatgattgtaagcctttgttccctgtaaaagattgctctgtattaaaacaaatccaccaaacaacaagtcatagacccgttagaaaccagcattctaaagcatggtttaagtgtgaacaggtgtttgtagcttatctgagactgacagtaggtaaaggggccaaggagagactgctacatggtggtacccaagataattctctgaagagagagacttttgtgtgaggaagacatttattatacagagtgatttattgcaattcttagctactccatcaagctagacttgtcaccatgtcccattaaaagggtttaagaagaattctttctcagaatcctgcattacagtagcatctgcaataaggagaaaattttcttctgggaatcactccaggaaaccttgacccatcctctacttagtcactcttatagagccctgcattttcttttgtagcatttatgacatgtgtaatgttacatttgtttgtgggattatttaaggaatgtctgtcatgtgagacaataagctttatgagtacaggcacctcttctgtcttatttcctatgccccagcacagtccctgacatctagtagaccttcaaaaagttttacggaatgaatgagtgaacaaatgatgcaaagtgttggttgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttcggggcacgttaatctcttagaaaacggtctccataaataaatgctgggtcagatgcagtggt

SEQ ID NO: 175624 - DNA, 1857 bp, Homo sapiens
tgcaaatattccaaagacatgattgtaagcctttgttccctgtaaaagattgctctgtattaaaacaaatccaccaaacaacaagtcatagacccgttagaaaccagcattctaaagcatggtttaagtgtgaacaggtgtttgtagcttatctgagactgacagtaggtaaaggggccaaggagagactgctacatggtggtacccaagataattctctgaagagagagacttttgtgtgaggaagacatttattatacagagtgatttattgcaattcttagctactccatcaagctagacttgtcaccatgtcccattaaaagggtttaagaagaattctttctcagaatcctgcattacagtagcatctgcaataaggagaaaattttcttctgggaatcactccaggaaaccttgacccatcctctacttagtcactcttatagagccctgcattttcttttgtagcatttatgacatgtgtaatgttacatttgtttgtgggattatttaaggaatgtctgtcatgtgagacaataagctttatgagtacaggcacctcttctgtcttatttcctatgccccagcacagtccctgacatctagtagaccttcaaaaagttttacggaatgaatgagtgaacaaatgatgcaaagtgttggttgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacacaaa

SEQ ID NO: 175625 - DNA, 197 bp, Homo sapiens
gcgttcatcaattcaacagacatccactgagcgccccctatgggtcaagtcggcagctgggtgctctggaaacaaaaatcagtgcgatccagtccctgccctaaaagagctcaacctcgtttagaagagacaggtcctggataattaaaaccactgtgacctgctccctaaaaaaaagcaaggcaggcacagtggga

SEQ ID NO: 175626 - DNA, 433 bp, Homo sapiens
aaggtgatattcacttaaacttctgggcattctatttaatagagaggctgtcatctccgttgtagctccctgccgcctatttttgtctggtacttacattttactgattaaagaactacatttgatttctgatttaaataatttgctgtaatctcatattcactggacacactcctttccatttcctttattattatggggttatttactaatgagacttctatacttctattttacagggtctcagtagggacatgcttagtctgctattttgagccaggagtcactcctttatgtctttcgtgctcaatgtatcgattttgcttcctcaatcaataaattctgtaacaaccaacattgttttaaataatttatcccaaataatttatgcatttcaatgtactctgggtataaaaaaacaaggccgattatg

SEQ ID NO: 175627 - DNA, 1160 bp, Homo sapiens
caaacagttgggtgacccctagtaaactctaaggttaagcttttccatgaatattttttttttccgagtctagggtatggaaggatataaggtgtcttagttaattttaggatttctcttttatgacatgagacctaatcaatacctttgcatttcaatgaggctttttcttatttttcatagtgtacctgatctctctcctcttgtaggaaggagaaaggcatttggcctctccccttcctttagtctaacaccttcctctgtttttttgcccctccctcttatctttgtttccttatcggcctctccctaaagccctgctttctccttttaaggctaggtgaggtgtctttggcaaggttgcacagggatccaggtaagtaactcagtctcttctcaggattagagaaaactcagtgtgaactgtcccagtggagggccttggagaggcacatggataatgggggaggagaaggaggcggcctggcctgagagatcaggacttgttagaccagtcctgtgtgtgcgtcatgcatgctccacagagaagcaggtttttttctttctgtaccctttcagtcctgggccccctcactagctgagagccacacccttccttggcttcaaagccagcccagcactaagccattttagtatgttatggtttagagggggttctcagaatacttgggaggggaaaagagagaaaaagaagaatgttttatttggtctcagaatttaggaggtcatgatggtggaggtgatttttttttttttaagttgcagtaaaaactttaaatattgacaggtagctttgggtaaggattataagactaaagggagtttaaggtaccctgttgatgtatagaggttgccagctcaaattccttttaacaaggagtattatcttgtttatatctttgttttttaaaaaattcttttctctgacgttccaatcagagagaatgtatcactctttcctaagaggagggtggtctgcccagagccttccttaattcatcagagagattcctggtggacacctagtttttcctcatgaaaataagacttctttggtcagccttttaccctcttttaaaataaaatccttaactaaattaaatttaacagtgtttaattgaacaaagaacagttcacta

SEQ ID NO: 175628 - DNA, 242 bp, Homo sapiens
ttttcttggcatgtttaatttgtatttatcttaaggacttagcttatgtgttcctttctcaagaaagttttccctgaccttccatttgcctaaaggtagattagattccctctgaaattattaatagtaatgatggtaacaacaataatagcagcaacctttgagtgtttatgagttgcagagactgttcttagcacttacacataggaagttttttggttttcatagcaaccctatgagtt

SEQ ID NO: 175629 - DNA, 442 bp, Homo sapiens
tttgcaggctcttggtgtcatgaatgctaggaagtgacaatatcagatgagcgtggcattgtagttatctaagaagaaaatattagagccagatgttattggatccggctgatctcttactcacacatctcaaagtagaaatcttgggacttggatcacccatgttgggggtatgagggagcttgagagtaagaggaggctccagctagtgactaggtgtgcaaacttggaagtcaaacctaggtttgcattttggctctgccatttgcaaactttccttgctaagccttgatttcttcatctcataaataaaggatattgctatttacttcctggatgataacccagcctttagtgtatgcaatatgaaaaattagggcttatttgtcatacagattctggttatttttgtggagcaaataaaggtgcataaatatttctt

SEQ ID NO: 175630 - DNA, 542 bp, Homo sapiens
ggaatgttgccttcatttgaaacattacttatctgagataagtaaactgaagctcaaataagtgcccaggtaagtggtagagtctgacttgaacatagatgggttgtctccctgtcttgattgctttgctctcacacaaactccaaccatttgtataacaagtagccaagcatattgtaggcggtacaataaatactggtcatttgattgaggggaagtatctcaaatgctatgtatattaagtaatggccataatgaatctagagacggaaagccaggtttgataagtgaataattcatcaaattattcatcaaataattccacaaagcccccatcaattcacatcccctcctaggagcagtggatgagagtgtctgtttccacacaccttcaccaacagtctgatgttacaccttttgaattttgcccatccgatagatgaaaaatgggcaaattttcagtctcattcattatataagaattaaattatatattataaattgtatataattttaattatatgaaaattaaaaccacactg

SEQ ID NO: 175631 - DNA, 347 bp, Homo sapiens
aaaagagaaccctctgagatgcccccctctcggggtggagcagagctccccaccccttccgtgggctgcacccagtgacttgcttcccgaaagtgcggtgtggacagggcgtgggggacctgacgcgcagcgcctcagccaggtgaggaaggctcactgcagtgaccggcacggtgctagcatgtgccctgggtgaaagggaaggagaaggccactgagcctcagagggccccctccgtgaacccgaaaccccagtccagccacgagaaaaccgtcaaacaaacccaaagagaagggctttccgcagaatacctgacaagcgcttctcaaaaccgccaagctcatca

SEQ ID NO: 175632 - DNA, 288 bp, Homo sapiens
ccagaccagctgcttcccagcacagccaccttcccagagcctctggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctgg

SEQ ID NO: 175633 - DNA, 3925 bp, Homo sapiens
  misc_feature (780)..(780): n is a, c, g, or t
  misc_feature (1077)..(1077): n is a, c, g, or t
  misc_feature (1968)..(1968): n is a, c, g, or t
  misc_feature (2337)..(2337): n is a, c, g, or t
  misc_feature (2559)..(2559): n is a, c, g, or t
accctgttttctactgatatatgtatgtgtatggctacctgaatccaggtttcttctaggaatatacagaaagtaattgatttctctgtggatctctaacagtgacaagaattttcacctatgcctgtgagaataccttcaaaagtattgggtgctcatcataaacacacatcagtttaacaaactcttatggatgcattgactttcccagttagttgctagatgacttcggatgatttgcataatgggtctcagtttccatatctgttaaatggcaataatcagagaattttaaaaaatttaaggacacctggaaagcttgaaagatccctagaaagcatgtgtttattccacatagtgggaactatgctagattccaaagacacaaagacaactaagacaacttagaataagaaggaaaagagaatgattcgttgcaatgatccccttgaagctccagttgaaagtcagagtattgccctggattggaagtagtctccaaactgacatcattttctttttcgaaccatatctggcctgtctctcttgccagttgcatattaaaggtaacagatttgaaaatgtttggaataaaagctctagttaggtgtggtggcacacacctgccatcccagctactggagagtctgagactcgatgattgtttcagcccaagagttggaggttgtagtgagctatgatggcaccactgcactccagtctgtgtgacagagcgaagaccttgtctctaaggaaaaaaaaaaaagcactatacaaatnccacattgggaaattttcactgaatcaatggttaaaggtttatacaatggatggagtatttggttagtgaggagagatttttgaggatcgatggcaatacttatttctagaaatagccttgtttttgctgattactgttggtagggatcagtttaatgctttttcccctaatgtacctagagatttgtggtagaattagctatgcaaattgaatccttaaaaaaaaaaccctccacaaacctgtatgttatatttataaactttacattgtactaaagtcagcaaatgtcacagaantaaaatcagtaaatgcaaaagtgaaggtttctatagcaacagtaactcacccatattgcacataaaatgaaatgtacattaggatttacatttaatcgcctattagtggagaaaagtcctatgtataacaggtgcaatatgaatacattagggtgaccctagcaactctttatcttttaaactccaggctctagctgccgtaactcttttatatctaccaagttttgactcctttagggaaagtgaggtaggaaaattagaggcagcgttagagcagaggtgtgtacccctagatttaaatgcagtggaatattaccattgcataaattatcaatcaactcagtaggtgtttcagagaaagaaatagacccagaatagtaaatgtttatgaaattgttgcacgtagggtacttaagaagaatttctgtctagcatagtcggtttatccaaaccttgagcgcttctgaaacatgctaatgcaagatgattttgtgactttgagttggttgcggaatggcccaataggagggtggcaggattggagccagggacatgggacatggccccagcccatcactctgcacatatggcctcccttgttgaatttcagtttcttcctataatgcattcctacttcctataatgcattcctacttcctataatgcctgctatccagggttctaagaatcaaataggagtggaaggagaaggatagagggtattttgtggaagctaaagctctctatatggacaatgatgtcgctattgtgaatgtgactttcataaggcaaatatcatccccagcagttataccatgcctttggctggtggtccctggagacggcctatccttggccgtctgcttacataaaggaatgtctcttcgctcngcagcagctcttctggtggagggctctgagtcattgctgagaataaccgtcatgcctcctccagctcagtctacatcagataactctagatagagactcttctattggtcaaaactttcttttataaaattggaagaaatttttctagtgactagacagatgattcactctaaaatgcagttgatttttaaaaataattttaagtaaaattgatcataagttttctttttcttttttcttctccatgagctttaatgttctttagtattccttggcttcactctgaactctttgattcagttggtccggagtaggccacaggatctgctttttatccagtagcatggtaatctttaaaaatttattttncaattgataaattaattttgtatagcttaagacatcaaatgaggttatctgattaccacccagatcagattttgccagccccagaaaccctaccctgatgataacccctttccttgtatagtcttaattgacttttttggtattaattctcttatgtttccccagacactatgtttccccagctgctattgattctcagactggcctgccttgctgtccagngaatacttgttggctgtttttgattccctgattttctggtctatcagatgttctctagcttccttcctgcctagaccctgataacatacatgtctatggctgtagtggtttgttccactggcttgtattttgggatgtcaggtccccttttcttttcaaatataatttttgttttattgaaaaaattgaaagagctttttaaaaacataattggaccaatttttgtcaagtgccactcttgtgcatacataaacaaggctataaatgaaatacattggttaggtattactaagacttacactcagggtctaatggtttagaattgttcttcaactcatggttgtccacgattttccacgtagtataacctttgtgccaccaaggatgttggtgagatggcattcttcaaaataatacttttagaaaacagacatgatgcaggtctctgagcaggctttgcattaggtagagcttgcctaattttgaatttgattttcaggaatgtagcgaatcttgttggatgcgcactctccctgactcttaccctcaactatttgattgagaggagaaagagtgatctatctgtccctccttttcttccaaaccattcgcacccattctgcaaattatgattacagctttgattttaaaaccatttaagaagtagcattcatggtggcaccctgtgttgtctaggatggaattgcattgactcattcattccttaataccttattgagcttttttttattatgtgctcagtgagggaggaccatatataaaccctgccctcaggatgctcacagcctagtggggaaggtagccagctgaacctccagttataactgagggtgccaagagtgagctgttgagagcagcgaggacagaggttttcccagccaggattgcggtactgagacatgcacacacgtgcatacacatgcacagacatgtacactcacaccctaaattgcttgtgctatgtgggaaattttgacccacatattcctatgtttaattgaaggcactgttaacttcttaacaatgctacatctctgatgattttaggaggaattagactgcgtaaacatctcaaaacagggaggtgaagctaggaagcataaatgccccagtgatggctgcaactaggtctcttaacttattgtaatctaaaccttgggtgagggagaaagaaaaaaagagcagctttttaaagtccactgaagacttcagatgtggcaaaaataatcattttttttctggccatgagaaattgtctgagtagagggtggaaaatttcatccttatcaggaagttaatcatagtaatttatgtggaacttccaggtggttacttagtcaatctt

SEQ ID NO: 175634 - DNA, 393 bp, Homo sapiens
aatgatgtgatagtttacactggagagaagtctgcagaacaatttaaccatgttttaagattatgtagttaaccatacaaagaatggagattaatcagtctgcgtatctagagacaacagagaagaggaagtagacttagacagaaagagagatcatacaaaggtttttgggtcaaacataaggggttctctgaaaattacttttatatacctggataggttccagagggagcttatgttatttgaaaatatgaaaaataggacaacatccatatggaactgtttagataggccaatgcctaaaagttggggtcaggctatctgaacaatcacatcatgacaatcacatcatgaacaatcacatcatgaacaatcacatcatgacaatcacat

SEQ ID NO: 175635 - DNA, 471 bp, Homo sapiens
tgggtgggagtgcagatattccttcagtatgactgatttcattttctttgaatatgtgtccagaagtgggattgctggatcatatggtagttctgttttcaattttttgaggaacctctgtactgttttccataatggctatattaatttaccttcctactaatagtgtacaggtgtttccttttctccacatccttaccaatccttgctatcttttgtctttttcttcatagctgttcaaacccctgaatggtagtgtctcactgtggttttaatttgcatttctctaattattagtgatgttgagcattttttccacatccattggccatgtgtatgttttctttggagaaatgtctattcaggtccttagcccatttttttaaaaaaatcaggttgttttcttgccactaagatttttatgtgtttttggcattaacccctaatcagatatatgtttaaaaatatttt

SEQ ID NO: 175636 - DNA, 700 bp, Homo sapiens
agatgatataattgtctacttaaaaaatatctgaaaacttttattataaacaaagcaaaacaaaacccttctggaagtaataagtgattatagcaacgttgaaggctatgaagttaatatatgatagtcaattgcttttttatataccagcaatgaacaagtgaaatttgaagttaaaatttcatgataaggtataaatagaacaaaatttgtattagatttttatgaaaaaaactatcaaattctgatgaaagaaataaaataattattaagtaaatggagagatatttcatgtccacagataggcaaactcaatgacaaaatgttcattttttttcaaattgatccataaattcaatgcaatcccaaccaaaatccaagcaagttatttcatggatattgacacactcattttaaagtttatatcgagaggccaaagatttagaataatcaacacaatatggaagtgaggatggaagtcagagcactacactacctgacttcaagactaactacaggctttagttttagacagtacggcagtggtgaaagattggaataacacatcagtggagcaggatagagagtccagaaatagatccacatgaatatagtcaaagatcaactttgacaaaggagcacaggcaatgcaatggagggaagataaatagtgcaaggacactggacatctacatccaaa

SEQ ID NO: 175637 - DNA, 413 bp, Homo sapiens
agggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttctt

SEQ ID NO: 175638 - DNA, 199 bp, Homo sapiens
atttaaagtccatattaagataaatttgaatccttttatatactgttcttatttatcaattaaagtaaaaaatagtttgatatcaaatttgaaccaaaaaagcagaatactcaaatacaatgaggattccaaattatctgctatatcacatgactaggaaagtaaattataagagaataaatttcctcacttatatctt

SEQ ID NO: 175639 - DNA, 824 bp, Homo sapiens
tttaaaaaattaatacactttattttttagagcagttttaggctcacagaaaaactgaatgttaagtccaagaattcccatacacccactcccagccatccacaccattgacatcccctgtcagtgtggtgcatttgttataatcaatgaaccaacacagacacatctttatcacccaaagtccatagtttattctcttttttcttgagacggtctcactctatcacccaggctggaatgcagtggtgcagtctcagctcactgcaggctccacctctcaggcctagtgagcctgttacttcagcctcctgagtagctgggactacaggcacgtgccaccgcaactggctaatttttgtatttttatagagatgaggtttcaccatgttgcccaagctgatctcaaacttgagagctcaagctatctgcccacctcggcctcgcaaggtgctgggattgcaggggtgagccacagcgcccagcccagagttcatagtttaaattagggttcaccctgtgttgaacattttatgggtttcacaagtgtagaatgtcatatacccactgttacagtatcataaacggtagtttcactgcccaaaaaagcctctgggcttcacctgttcctcccttccccacccctaaccccaggcaaccactgatcttcttactgtccccatagttttgccttttccagaatgtcatctaggtggaatcttacagtatatagtttttttcagattggcttctttcactttgcaatatgcctttgatatggtttggctctgtgtcgtcacccaaatctcatcttgaattgtactccc

SEQ ID NO: 175640 - DNA, 810 bp, Homo sapiens
  misc_feature (566)..(566): n is a, c, g, or t
  misc_feature (659)..(659): n is a, c, g, or t
ggaggataggaagcaggaaagcgggagagctcgagggacaagggggctcggtgtgtttacaccaggcacgggctacgagcgtccatcccggcccctggcttgcgctcccgaagaggagagcaaggctgttctgggatccggccgtcgtgcggcaagaggcttgtctgtccgggttgccggaaccaggagaacccagagggaaaccgagggaaaggagcggcgcgttttactagagagagcgcgagcggaagaggcgagagcaggagcgcgcgagggagcatcgagcgcagcggagacatgaggacctactggctgcacagcgtctgggtgctgggctttttcctgtccctcttctcattgcaaggactgcctgttcgcagcgtggattttaaccgaggcacggacaacatcaccgtgaggcagggggacacagccatcctcaggtgcgttgtagaagacaagaactcaaaggtggcctggttgaaccgttctggcatcattttgctggacatgacaagtggtctctggacccacgggttgagctggagaaacgccattctctggantacagcctccgaatccagaaggtggatgtctatgatgagggttcctacacttgctcagttcagacacagcatgagcccaagacctcccaagtntacttgatcgtacaagtcccacaaagatctccaatatctcctcggatgtcactgtgaattgagggcagcaacgtgactctggtctgcatggccaatggcgtcctgaacctgaatcactggagacacttgacccatggcagcgctcgaggcc

SEQ ID NO: 175641 - DNA, 582 bp, Homo sapiens
tggcatattgcgttggctagagctttcagcactatgttgaataagagtgtgagggtggatattttttgcctcattcctcatcttagagagaagacattcagtcttttactaaagtatgatattactgtaggtgttttgttccttgttaagttgaggatgttctctcttattcctatttttttgagtttttttaaaaatcataaatgggtgttgaattctgtccagtatttttctgtactgattgatatgatcctgtgatttttcttctttagccagttaatatagtggattacagtctttgatgttagaatactgaaccaaccttgcatccctagaataagccccacttgatcatggtgtgtacttcttttattatattgtcgaattctacttgctaatattatgaattattggcttttatattcatgagggttattggtctttagttgtcttttttgtaaagtctttgtctcgttttgtttttcgggtaatagtgtcttcataaaatgagttggaaacagttcttttttattttctagaagagaatgcgtgaattggttttagttctttttaaaatgaatg

SEQ ID NO: 175642 - DNA, 485 bp, Homo sapiens
aataaagggcatccccagaacagccactccctgatgtgagctggtgcagtcacaggggctgccttgccggagctcttcatgggtcaggcatggcccaccagtgcagatgctatggtatgggctcctagggtacctgagactgccctgtaagcagttgtggccagactggatccctgggagaggccagcagaccaaggagtgctcagttggatcagcttcttctgatttgcaagaccatcctgcagaaattaggtccaacagttcccctagggctaaagtctcttatgggagaaagttgaacctatggaaatggccgtcaatggccacactctactacaggtgctcttgcactaaaccctctgggtaccacatgagctgggttgctgccccacctctttgcctgtcttctggttgctgcatctcagagacgtgtaggccagcaatcactcagtgcagtccgaccaggatggaggatctgtgctttt

SEQ ID NO: 175643 - DNA, 575 bp, Homo sapiens
tatatgagtctgcatccagattggaggcctttgtggtgggtggtggactgcaggtggaaccaagcacaggtgtgccctgggcagaggtgggcaagaggaaggaacccaaacagtgctgattccacatggcccttggtcaagaagctgaaggcctagaaaggaggtaacagtgcccagaatccccacctggcacactctttaaatgctttctggaggtgttttagtcagttttgatccatcggtggggacacactgactaccatatatttccaggtttgtttgttttcttaactaacctgtaattatccactgtaactagcagagggttgaaccctgggtaataggcacagaaacatcttgaatcttgacaagcctgcactgtcttatagtaatctgtattactgtcccattttatagttgcagttactaaggttcagagaagttgataggaaatggcatagtgaggagttgaataccaggctcaggtaaaagtgaccccagaaatgtgcagaggagtgtcagggaaagctgaggcctgcttaggggtgtggctgagaaggcaacacccatggagg

SEQ ID NO: 175644 - DNA, 742 bp, Homo sapiens
caaatctttcccaattccagatgatattctacttatgacctcattgctctcatttcctacagactcctgtaaatgaaagtccctgactagaagcccatacctgaactgttaaggaaaatagatgcctcattttacaaacacaaactcattcattcaacaaatggttctagatgcctggctgtgggttagatatggggatacagtggcaaacttgtcaggcaaggaccttgcttttatggagctgacattctagaaggtgagacaaacataaacaggtaaaccaatgaaaaatatcagagaatgagtaatatttgaaaaacgagaaatagggggatgtgatagagagtaacaggtactttacctcctctgctttagagtggctagaaggagtcacatttctgaggaggtaaattttgaactgagatgtcagtggcaggaagaagccagccatgtatagatcttactacaaaaagtaggtcctggctccttttatggggatttttcctacactcactgaggccttttaagacacaagtccaatgaatggtagactgtagatgccttctttatttcctggtgactatttcaaagcagcttaggaagtcttcactgctgtaagtacctttgaaaaatgtgcaaaattgggatccattgtgtatttgaagctgatttcatgtgcttaaatatcttgaaggttgtttactggttagtgctgtgagtagcattgtttccatgaaagaaa

SEQ ID NO: 175645 - DNA, 250 bp, Homo sapiens
gtcctacctcctccactgctatggtttgaaagtttgtcccctccaaaagtcatgttaaaacgtaaatcccattattgagaggtggggccttttagagatgattgggtcataaaggctctggtcataaaaatggattaatagattagagggttcatgaattaataggttatcagaggagaggcactagtggctttataagaagaagaagggggaattgagcaagcacgctcagcctcctcatcatttgatg

SEQ ID NO: 175646 - DNA, 283 bp, Homo sapiens
ttgatacagattaagatttctgaaaaagaccatcctcctaaaccctcatggactctgcagataatatgaggccagaaaatgaataattcccaactcttgctatctcgttactggccagtgtgtctggcttcgctgagtgtgtgccttctgaagcgtaccctataattattcagcaggtatagtccagttcgtcctacttactttagcaagattacctttcttttatttttcctgtgaaaatccttctcttccttctttcctcctttgtctttcctctttgtta

SEQ ID NO: 175647 - DNA, 186 bp, Homo sapiens
ttggaacacacgacatccacagaaacatctttaaacacagaaggtcttctccaagctcatctctggtgataggacaacagtgggcctcaagcttctccagccagtagcaggtgagttgcacccaggcctgtcaatttcatgcacacttgacccagtggctcatgctgccctccaaacctcccttaa

SEQ ID NO: 175648 - DNA, 403 bp, Homo sapiens
agtagctgtgattacaggcatgtgccaccacgcctggctgattttgtatttttagtagagacggggtttctccatgttggtcaggctggtctcgaactccctacctcaggtgatccgtctgcctcggcctcccaaagtgctgggattacaggtgtgagccaccacacccggtcaggaatcccatttttatacccacatgcctttctgtccatgttaccactgtcagagagcctaccttaagcattttcttttctttttttttttttttttgagatgggttgcactctgttgcccaggctggagtgcagtggcatgttcacagcttactgtagtgtcgatctaggctcaagtgatcctcccacctcagcctcctgactagctgggactataggtgcacaccacc

SEQ ID NO: 175649 - DNA, 390 bp, Homo sapiens
taattttcttaatgacaattgagaacttagaagcaacatgaatgtggaattatagattttacaaattttcacccaatactctatacttgttttgccatacctataatttagttagcagattgtttctttctttcttttttttttaattaacaacttgttttaatagaaacttgttttaatagttttaatggaaacaatgatgcgcttatttcataggtttatatagttaagcatgtatgtgtatttatactatatgtgtattgtatgtatgtgcgtatgtgtaataaatgtgtgtatgtaaatttacaatgacaagtacagttggcataagcaggggtttgcagacaaacgtgtttcagcacactgggcaacatatcagtctgtagcatg

SEQ ID NO: 175650 - DNA, 333 bp, Homo sapiens
ctcacttgtgcctacccaaggccatacacattatcttcttaatcttctaacccagactgggccaaaaacacttcccctgtttcaccttagcttcaaaaaataagtggacatgttcacaagaaacgtttctcaaatttaaggggaaagcattagttatcacctgcctccaaagattccaggttcaagaaaatagtttgccaaagattccaggttcaagaaaatagtttgcattttgttgagctcccagttccctcctcccaggctgatgtcctggttccccaagtcgaggggaatgtggtccctacactccagctttcctttccctccctggtt

SEQ ID NO: 175651 - DNA, 528 bp, Homo sapiens
ggcttcaataccatgggatatgaggtatggggtagtggaataaacatgagctttgagaacagaacaaagtaggtataaaacctgtgctgccagtttttagctgcaggacctgaggtggctcactgaagctttctgagcctggagtacttcatctgtaagatggggatgataatacctgttttttaggaagcttgtgaggatgaaatgggatggcgtatttaaagcatgtttgttggttagactctttgatgtcagagccacctgggttaatttgggtttatggtgaagatgctcagggaaggtaacagtcatgagccctagctggaattccttggggctactgtactgtctttgggatgggaggcagtcctggccacccccacatcaggcatcattcattctggtgttctatcataatcatggttcatatactttccatgtcttttctttgactgtggatgaagggtctcttccctgttttattttggaagtccaattagctggacctgctaccctcctgtataggag

SEQ ID NO: 175652 - DNA, 355 bp, Homo sapiens
tgaggctaatacactgagaagggaagatgggagaaaaagcagtatgggaggtcttaaagcctcggtaacttcagaaatgtgctaggatttgtgggcagcagatatttcaaaacattaagtaaagaacactggagttaaaggcatggagcttcagaaagttattagcactgatagccaaccacggtggtgggtgcctgtagtctcagttacttgggaggctggggtgggaggattgctggagcccaggagttcaaggctgcagtgagctatgatcatatcactgcactccagcctgggtgacggagaccccatctttaaaacaaaacaaaacaaagaaaagaagaaaagaaagtta

SEQ ID NO: 175653 - DNA, 337 bp, Homo sapiens
cctttatatgttttaactgagtaatttttgaaaagcaaatttaaggttaaattagggtgaacacggccaggcgcggtggctcacgcctgtaatcccagcactttgggaggctgaagcgggtggatcaggaggtcaggagatccagaccatcctgaccaacacggtgaaacccccgtctgtactaaaaatacaaaaaatcagccaggcgtggtggcaggcgcctgtagtcccagctactcgggaggctgaggcaggagaatggcgtgaacctgggaggcagagcttgcagtgcgccgagatcgcaccactgcactccagcctgggtgagagagcgaga

SEQ ID NO: 175654 - DNA, 796 bp, Homo sapiens
gtgttgcagcttttcaacctgcccccagataacagccacgcccacaacactcacccactgcatattcagagtaacagatgatctgcaggacgactgctgaaactcctgctgccttcactcactccagaaaacctactgaagacctgaggaatggaggactagattgaagaattgggaagtcactgagaaccaaggcagtgcctctgtcattctctgtggagcagcaggccttgtttctgcagtccagatctgtctactacttggctcctctctgcagaatgaagtctgggtgcatgtggcccatcccagcattcccagttatgcaaccagatactcttctgccagccagcctggccccttggagtctctgtgctccagctccaggctgtctgagaagaggagctagttggcccagctctaccttagaatggattcttgtctgggctgggtagtacctcatcagctgtggccaggagcaatactctcaacagcacagacaaaaggggacagatccctattgggtaaaggtgatgtgggctggggtaagtaccctgagaggtgtctgtcacagaaaactgcctgagagaactttgtcaaagttctgggctccactctccaggggttttgttcagtcaataggtataaaatagaaactaagtgtccacttgtttaaaaagctccctggatgagtctgatgcctcttcagatttagaaatcactttactctaatacgtgtaaataaattaatatgtatttgtgtttgcatgaggaaataatggaaagataagcaactaat

SEQ ID NO: 175655 - DNA, 694 bp, Homo sapiens
tccacctctgtggggattgaacccaccatggtgtttaaaaaacgcccctaggagattctgatgcctagcctagccttaagaaccactgtcccagcttggaatgggaagcttctggcatgtccagggcatcccacgtgctgctttgaggcccacaggcctgtctaggcaggtggcattgtttggtgtgggaagtgactgccacactgtcctgcaggacccatcctggcatgtgttgtggctgaaccaggctggtggtcagtgtctcagggcaggtggccccagcccgtggcgggtgtggaaagtatttttggattggcgttacttctgggaataacagcagtacccagggatggggtattgaaagagttggccagtggggcagctttgacctttggggaggcctcagacccacactgtcgtgtgctggagaggtgcagaggagtggctaggcgtcgctctcctcaaactgcactgtgcttggaacgatgaggaggccccttaactcagcctggagggtgggaggctcctggcctgtggcttctgactctgccacgggttatttccctgcagtggtttgataaaggtgagctgactcccagttacgtgaacagaaacaccaaactgctttctggggcgtctgcctttccggactgtgtgctctgccatcccttctctggctgtgtggtgtgttgga

SEQ ID NO: 175656 - DNA, 204 bp, Homo sapiens
tcagggtagaaggaggaggattgcgtgatatatatcagaaagaatgataatgtctgagagatgagagtgaagaatgtggtaatgaaatcttgacacaagcttgaagaaagtaaaagaggaaatcctgtgtgaagatcctgagacatgaatattagcttatttaatattaatgtcatccctccagtttctcatagtactactcct

SEQ ID NO: 175657 - DNA, 153 bp, Homo sapiens
aagcgctcttgagaacagtctgtctttgatatggatttgcatttccacaaaaagtatttgttgaatgaaggaaggttagggtataaagtatgaacagatactacttcaatgaacagcaaactaggataagaaaaggggggctgaagagagtga

SEQ ID NO: 175658 - DNA, 502 bp, Homo sapiens
ccagccagatgctgtgaagtctccataaatctgtcagccgtcccagtgccgcgggcagtcacctgcggcgcccccttcccggcgctagagcggcccgcggagagacgcggagaagcaacgggaatctagcccggcagactgtacccgagggctgccgaagtcagacccaagcactacaggttgtgcggaacgcgaggacccctccctgtatccccaacctggaccgacccccggaagcctgctcctccgggtctacagggatgaaggtcagagtgtcaaattgcagattttggatcctcaataatgggccgctgtatttaacctcttcaacttcttttctccacttataagaaggaacaaaataaaatgttttgtggaagtttatattgaaatgaggtcaggtaaactaatgactgcttggtattttatgacaagttttataaccttggagttgccataactttcaaacgatcatcaataaagttttattgcaaaagggtcg

SEQ ID NO: 175659 - DNA, 405 bp, Homo sapiens
aaactctgaaaatactaaaaactattgaattgtacactttaaataaatgagtggctgtatggtatacgaattgtatctcaataataaagcaccctaagtaaagctctaatttaccccaatatccttctttgatacacacagttaacaatccatctataatggggctgggtgtggtggctcacatctgtaatcccagtactttgggaggccaaggcaggaaaatcacttgaggccaggagtttgagactagcctgggcaacatagcaagaccctgtctctacaaaaaaattaaaaactagccagatgtgacagcgcgtatctatagtcccagctactcaagaggctggggcaggaggattacttgaggccaggagtttgaggctgtagtgagctatgatcatgcca

SEQ ID NO: 175660 - DNA, 343 bp, Homo sapiens
ttggtacattttggaatgagatttatcaaagtaaaggaacgtttacaaacaaataagagagccccacattcctcagatagcaatggttctaaggattggatatacattatgagttccagtactgaactatttagccactgaagactatcttctgtttatataaatccacctaatgccactacatatttttgcattttctaagcttcattcatagccattgcttttgtttttaaaaacttcttcatttctacctttttactcgtaagatatatacctcctccaccacctccaggaattgttttctccaggcctcagggcagtgtctcctcctctacccactcca

SEQ ID NO: 175661 - DNA, 685 bp, Homo sapiens
ggagctttggggagcgcagccagaggaggcccagaggaggggactgagccggtgaaggacaggcagggaggagaagagacagcagggcagagggagcagatcaggggccagggcacactttcccaggctctctttccagaatttgtctgcactggcaaagtctttctcacctaaatcaaagcaagagaatagcaggccttggctttggggatgagatgtgagggacaataggaaactgtgatacctgaggccaaagcctgcctgagcctctgtacctgtgtcatgaaatccctgctccctgggtttggatattgtcagtcttcaccagcctctttcctttatccctttctctccttcccatctctcccacgcagcagctaagaatataaaccatgggggattaaaaatagcaaggctggagagtgttatttctgaagcatttagcaaaagccctccccttctgtgtgcccacagtttagtaaaatccccaagggcaaaggaggagtgtatgttctctctctcttttatataatattaagaaacagggtctcgcttggatgcacaggctggggtgcagtggtgcagtcatagctcacggtggaactcaaactccgggctcaagtgatccttctgccttagactcctgagtaactgggactacagacctgcaccaccacacccagca

SEQ ID NO: 175662 - DNA, 463 bp, Homo sapiens
tgaggtgtttaacttttaaaacacataacatgaccctcatataatgctggtaagattataaaatggtgcagccattaaaaaaaatctgggagttcctcaaaaggttaaatagagagttaccagatgacccagtaattccactcctaggtatatacccaagataatagaaaacatatgtccacacacaaacttatatgtgaatgttcatagcagcaatatttataagtcaaaaagtagaaataaccctagtatctatgagctaatgaatatatcaataaaatgcaatatactcacacaatggaatattattcagctctaaaatgaaagtgctagtatacactacaacatggttaaagcttcaaaatatactgcatggttccatttatataacacgttcaaagaggcaaatctatagagacagaaagtggattagtggctgcctctcctaacaggaggttagaga

SEQ ID NO: 175663 - DNA, 205 bp, Homo sapiens
catccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagc

SEQ ID NO: 175664 - DNA, 253 bp, Homo sapiens
ggtgcttagtcctaaggagagagagaaagctggggaggagtggagaggcctgggctgtgtttgtctctgcaagcacctgtttatgtctctgaggtgttatctctgagggtttgtgtgtctacctgggtatggccacctatatgtgcagtgacaaagtgtgagtgattttgtatgtctgatggggagacagaggctgtgtttgtatgccctttaaaatctggaatgcttttatttcattttcttgcctgattgc

SEQ ID NO: 175665 - DNA, 1860 bp, Homo sapiens
  misc_feature (3)..(3): n is a, c, g, or t
  misc_feature (5)..(5): n is a, c, g, or t
  misc_feature (1111)..(1111): n is a, c, g, or t
ggncnggagagagcagagcaccatggcggtgttcccttcggccagcacagccatcggcttggctcccaggctgccgcggtggagtccgcacagggtcacacgcttgtggggcctctcaccagagctcccgcaaagatgtcaggtattgtctaagatgccagcgcctgcctagcgtaagcccgttcctctagccactcaatgctctggaaagattgcgctcctgtagcttgaaaacagggaagacgatggaaccagccgacagggccccagactcttcaggcagcagcaggtaggagcttctacctggccattatggggtctttctggggcccaagaggacttgccaccaggcacgagccaggcccccatccccttttccttcagggggcgcacctggcggagatctggaggaggtgttctggtggaggagcaatggggaacaggcaccttgccccccagagggaccacgggctgccgacgggacatcgtccactcatgcctcggctgccccacccctggccggagcaccatgggctgagaccgcctcccttgaagccccaggttcctcaaacccaggtggggctcactgccttccctctgcacagcctccctggaggaaagacgctgactggtggttcccaggttccagcccaggggtgtcaaccccattctcacaaatcgcttggacagaatcgggttacgtgtttttggagaaggtttaaaaaatcttgcagtttcctctacctcctgccccaggcccctcactgccccccaccccaccccatcttgttctgaacaaacttgatatatatgacaattctggcctgcagaagataacgtgaggcccgtgtgtgggctgcacagaggaagcctttgttacagaaaacgattcaccgtagggcccctccacacacaaggccccgtatactcagggaagtttccggttccagcccaggattcctatgtactcggggaacgttccggttccagcccaggattcccactttcacgactctcccgcaagcagatttcgcatgaaagaatgtcagctgtcctcctcccaagcagctgccttcagacaggaacgcagccaatccaaaccctgtcaacngcggtcctgggacaggggacctggctggggcataaatgatgtccatcgtggtggagacagcctgcctgctgcctctgccctgggccccacggaggggcctgtgagccctccaactcgtccacacaacatccgtggggccaggggactgtccccaagcctccatgtccaccgcccttccctgcccaagagagagaccaagaagggaaggccgggcagggctgctccaggtcaaagaagctgaaaccgcgtgacagccatgtgcaatgagaaaaaaccagccacactcactgggaccagtgacgagccttaaatgcaggctgtgaaatggacagcggtgtcctgagagtcggacaccctggctaagttgaaggtcctcattccagaggatatacacgggctttatacggagaaacggtcatactgcctccaacttactctcaaatgactcaggataaaaacaaagcaggctgagtgcagtggttcatgcctataatctcagcactttgggttggccgaggtgggaggattgtttgaactcaggagtttaagaccagcctaggtaacatggcaaaaccctatctctacaaaaaatacaaaaattagcggggcatggtggcacgcacccacagtcccagctgctcaggaggctgaagtgggaacacttgaggccaggaggccgaggctgcagtgagccgtgagtatgccactactctccaacctgggcaacacagcaagaccctctctctctc

SEQ ID NO: 175666 - DNA, 283 bp, Homo sapiens
ataatgtgatttgttaactcaaataaagtgaccttgcattttatcccaatatggcagagttaactcttaaagtattttatgggcaaacattaagagtcgagaaatactaaactagtaaaagaaatggcaatttgggttttatgttggagaaaccacaagaggtcactggagcactttcttttatcattaaaagcaaagtacaagatttatgaactgcttcccgcagctgagcaagaatacttggtataaatggtagctaaacaactaaatttaaagccttatt

SEQ ID NO: 175667 - DNA, 422 bp, Homo sapiens
tctccctcctcatccttcagaaagagcccttgcagtatatctgagaagagcgaacagtcagtcccatcatgggccgtggaggattctcctccagttggccactttgccactcactgcaagtgaggacttaagcgctctttgggggccttaatttctcagtagatccagtgaaaatcataacacataacaatacctgtcctctcttcctctctggggagttgtgcagatcaaatgagataatgtgtgtgaaagcatttcaaaaatgccaaaaccctctgccaggattgctgtgactgcgttattgatctctgtccatacagcagccccagcaggggtctctcttcaatccaccatcagctgtgtgtgtaaatgagtgtcagatcttttcttgaaaacaggtttggattgggggaaagagaaga

SEQ ID NO: 175668 - DNA, 178 bp, Homo sapiens
tatgtatccattctactgttgatgggcatgtgggcgatttccatttagaagctattaagaatatatcttttggtagaatcttagacttttaataaaacttgggcagggaaagggaagccatctggtctcttaaggtttagagtaaattacaggcattcttatccttgatgctttggaa

SEQ ID NO: 175669 - DNA, 499 bp, Homo sapiens
tttcaaggtaactttccaagttgaactcaaacatcataattctttttttcctttttctttttacagagacatgcctcgccatcttgcctaggctagtcttgaactcctgacctcaagtgatccacctgcctcagccccacaaagtgctgggattacaggcatgagccaccgcgcccgacccctggtcctgtttagcttctctaaatcttttctgtatataaaggcccagtccaattcttagcttttgtgtctgtgccttctcctttggcacattatttaggtttcctctgcactggaatgtagaccactcatccgggacctactaccttatactgctgttccactcaccaggtgtaggcatctgacatggaaagcaaacttctttagcctcatgggtcttggccattcctcgtctgccaggcttgtttccatttaataagcctgaaccagggcctcacgggagggtaggtgtgtggcattactaccacatgcctgttgc

SEQ ID NO: 175670 - DNA, 557 bp, Homo sapiens
aaaggacttcaaggttccaatacttcaaaccacaaaaagcacatctttatttcttctgatacaagtgaaaacaataattttatacagccgtgcatgaaatagcccaaactttctacttttctacactaattctatataaatgctaactaccataacaatgaaaatgaagacttctgtgtgttactgtgtagacggtggcaattagataacttcagaataaaactgaaggcaataaaattggcattgaacaaaataaagacaagaacaagagaaaaaaaaagaaagaaaaagtagtatagaatagtacttgagctgggcacggtagttcacacctgtaatgtcaacactttgggaggccaaggcaggtggatagcttgagcccaggagtttgagaccagcctgggcaacatggcaaaacactgtctctactaaatacatacatacatacatacatacaaacagtagccgggcatggtggcccgtgcctgtagccccagctactccgggtgctgaggcaggaggatggcttgagcccaggaggtcgaggctgcagtaag

SEQ ID NO: 175671 - DNA, 249 bp, Homo sapiens
catctcctgaagttgagaccacagctcttaagatcttcttcctctccagctggacgtcccagagcagtgctcacagagttctctccatcccctttctcagcatcctctaacatcccatctttctctgttatttaaattaattctaacacactatagttattatctaaataataagcatctgttggccgcgagccactgcacctggcctctaccttaatttaacttattcaaatttttgtataaccagct

SEQ ID NO: 175672 - DNA, 927 bp, Homo sapiens
gtttttgccaggagccagggattaatagtctagaggaagggactaattgtacacaggaacaatatttacttttataatgggaatagtttgagacagtgcatcttctagacacaaacattcagtaggaagggttatgcattaattctttcatttaatgagcattttaagcacctattatgtgccaaatatcttttcgtagctctacaacagtgttcacttctcaatcttttgctacaccagagcgttgggaccatgctcccattaatcaccctgtctcaaacaacatgctttaccttcattcgttgatttactcatccattccttctcatagtttttaacctcaagagctctgaggttcagggtggaataatatggagggcctttgagaggctaacttttgaaccaaatcttcgaggatgaactagggtagtggcaggtagaaaactgcctttatatttagccttctttggtacctggtcatggatttcttcttcaagcatgaatggcatcagttgtctgggagtgagatacagtgttcgtatgctgagaaacagattaggccattaaaaaaaaagttgtggccacgtgtggtggctcacgcctatagtcccagcactttgggaggccgaggcagggggatcacgaggtcaggagatcgagaccatcctggctaatatggcgaaaccccgtctctagtaaatatacaaaaaattagccaggtatggtggtgggcgcctgtagtcctagctactcgggaggctgaggcaggacaatcgcttgaacctgggtgacagagcaagactccgtctcaagaaaaaaaaaaaataagaaacttgtaactccctctctctacttgatgaagtagacatcaggaaagactttcttattctgctttccattaaaagccataacttggaaattattatt

SEQ ID NO: 175673 - DNA, 707 bp, Homo sapiens
ccctgaagtacactggaagaagccataacttaagttcattgaaatttttgcagtgtcccagagtcgatgtattctacctttgtcgaccagaacttctccatcatacagtccaaacttgtgggtctggaaagcacaaactctgtaaatgagaaactggtgatgatgttaagtaagttatttatattttaagtccctgattttagactcatgtattttacctactcggaaaaaatcatattatggttgttgatttagaatacacatcctaaaaagtgacatcccatctttgtatggtctcatgtctgagctaggcatcccactgaaatctttaacttaacatgccattgttccactacgcaccacccagcagctaattggtctccacgcagaatggtgctattagggggactcagtgattgtcttgtatgtatggacatcatgcagtaacaggagataaatttgtgttggagacagggaacccatgctactgaatttatgcatagtcttccttacatcaccatggttaccatgtctacatgcacctcatgctcacacttgggttgcgtgatggttaatattgagtgtcaacttgattggattgaaggatgcaaagcatcgttcctaggtgtgtctgtgagggtattgccaaaggagattaacatttgagtccgtggactgagaaagccagatccacaatcaatccgggt

SEQ ID NO: 175674 - DNA, 230 bp, Homo sapiens
caaactccgcgcgtagcactttacggattcgatttgacaatgagatgtttgaacttgagattttagaggtaggatcatccagagtatgatgatagtggtgggtgactacagcagtgaagtaaaaggacattaataacgaagaaaccaagaaatgcatgattgctgtttagtcctctcagtggtccattgagaaaggactcttaagctgattttacagatgaggaagctga

SEQ ID NO: 175675 - DNA, 1294 bp, Homo sapiens
gccgagaaatgtataaaataatcgagaccggcggaggcaggtcagagccgtctggaatgcgcgcaccttcaacggtatttggagattattcgcactgaattttctgcccgccaagaacgaataggattgccaagccacaccactttttggagcccgcttattcgcgcctatccaccctctcctgtgccccaggttccctgagcacgggaatcctttccgggcatggccaagtttgttcggtggctcagagcgggaagggaagtgcagttcgacacctgtccagctgctccgcttggagatcaaaggccggctatgggctgagcgacagatttacgggacggtggtacagattaaggcgagaaccctgccggtcctggactcgagttcgcacccaaggaaagcgtacaggtccctggaagcgggtggatgtcggagaggccgaggcagcctgcgctgtggccaggcaggcttggtgggctttagtctcagtatgtgttctttaaagtcttgacaggttattagtaaaggaaggggcaccccagggtcatgaagatgcttctcgctctggcccaagcatgctgaggctcgcttattcctcggcaggcccagtaaaacagctcaagcacagcctggagtcttcccgcatctgcgcgggagtagagtctggctttgggccccgcgtaccccgcagtcgtcggggacccagttcgaggccacgggaagggtttccgcggcagggcgcggagtaaagaggggaagaaggaatcctctccgcgtgatcagtagggcgggcttgtgatactctcacacccaggttccagctcagcccccaaactgctgccccaagaaaacaagttggggagtgtggatttagacataacaacgggtgtgagctgatgtccttacaaccaaaaatattgagactagaaattcagctccgaatccacgaccctcagattgatgcttaatcgcaccctcgactccagaaaagctgccggggacagacatggacaggttttgccaagggttcattaaaatagtctgcactggaataaccggggtgcaagagatcacgtcttcactcagggctttggggatcccctcgtcgccccaggtcagtgggtggggaggagggcaaacttctgtcttttgtttgtgggtgagggatgcgaattgtggcagcagccgagaaaaggggggaaattaattgcagccaattaataattaatcccctttaaacagctttattatctcttctgggcgacagagatttgtctgataaccccctgaagac

SEQ ID NO: 175676 - DNA, 1571 bp, Homo sapiens
ttagcgatggtttgggaacccgggcgctggaaaggcgcgggtgcggagggcggctgagccgcgcggctgcggcaccgtgggcgcgagacccctgccgagaggagcgcgcggacgccgggggaagcgcctcggggcggctggaggcgcagcaccctgggggagccggggcgcgggagagacaaaactgttcgaaccttctctcccttccccacccccagcgcccaaacccggggcgggtgagcgcgacccttgcagcgaccccttgccgagccctgcccgcgcgattactaaggagacgcggcctccggcactgccgtccccgcgccgtttgaaaacggatccatcagcggggtatttggagattattcgcactgaattttctgcccgccaagaacgaataggattgccaagccacaccactttttggagcccgcttattcgcgcctatccaccctctcctgtgccccaggttccctgagcacgggaatcctttccgggcatggccaagtttgttcggtggctcagagcgggaagggaagtgcagttcgacacctgtccagctgctccgcttggagatcaaaggccggctatgggctgagcgacagatttacgggacggtggtacagattaaggcgagaaccctgccggtcctggactcgagttcgcacccaaggaaagcgtacaggtccctggaagcgggtggatgtcggagaggccgaggcagcctgcgctgtggccaggcaggcttggtgggctttagtctcagtatgtgttctttaaagtcttgacaggttattagtaaaggaaggggcaccccagggtcatgaagatgcttctcgctctggcccaagcatgctgaggctcgcttattcctcggcaggcccagtaaaacagctcaagcacagcctggagtcttcccgcatctgcgcgggagtagagtctggctttgggccccgcgtaccccgcagtcgtcggggacccagttcgaggccacgggaagggtttccgcggcagggcgcggagtaaagaggggaagaaggaatcctctccgcgtgatcagtagggcgggcttgtgatactctcacacccaggttccagctcagcccccaaactgctgccccaagaaaacaagttggggagtgtggatttagacataacaacgggtgtgagctgatgtccttacaaccaaaaatattgagactagaaattcagctccgaatccacgaccctcagattgatgcttaatcgcaccctcgactccagaaaagctgccggggacagacatggacaggttttgccaagggttcattaaaatagtctgcactggaataaccggggtgcaagagatcacgtcttcactcagggctttggggatcccctcgtcgccccaggtcagtgggtggggaggagggcaaacttctgtcttttgtttgtgggtgagggatgcgaattgtggcagcagccgagaaaaggggggaaattaattgcagccaattaataattaatcccctttaaacagctttattatctcttctgggcgacagagatttgtctgataaccccctgaagac

SEQ ID NO: 175677 - DNA, 1244 bp, Homo sapiens
gttgtggtcgggtgcggtggctcatgcctgtaatcccagcacttgggagactgaggcatgtgagtcgcctgaacccgggaggcagaggttgaagtgagccgagatcgtgccactgcactccagcctgggcgacagagcgagactccgtctcaaaagtaacaagaggattcagaatctgagagatactgcttaaaaggaaaatgtcctggagggatgccaaactgcactctcaaaggtttcggctggatgtgtgatattgatggggaaacccatttcagtgtctctaagaagggggtagtgctcctctttccaggatgtctctggggaatctagagcaccccaaagtgtggtatgcatagaaacattgctgcttaaggtctgaatatttgttcctcatcaattcatgtgttgaaattctaacctctcctgaatgggattagtgctcttacacgagaggcctgacagagactcctcacccttcccaccatgcgaagacacagtgagaaggctcagtctatgaaccaaaatgttgactgtcaccatttactcaatctgctgtcgccttgagcttggacttcccagcctccagaactgtgagaaataaatttctgttgcttataagacaaccagtttatgacatttcgttatagcagcctgaatggactaagacacccttcccaccatgtgaagacagagtgagaaggttcggtctatgaaccaaaaactgaccctcaccagtcattgaatctgctggtgccttgatcttggacttcccagcctccagaactgtgagaaataaatttctgtcgtttataagccacctagtttatgatactttgttatagcagcctgaatggactgagacacccaccttaaaaagacagtacctcaaaaccataaggcaggataactgctagcctgatattaatagtttttaatttactgctagcttcattttgccaactgagtcagatattttttaaaagttctgtttgcaattattttaacttaggagaggagaaaaagagcaggcatcagcctgcatatgggatatttctgaaaggattttgctatgattagcttgccctcagggagagtaaaatgtgagttatacaaccatgcttatatttagatgttgttgatgttctggcttataatatatgatgagttagaaataattttgtactgatcagcccaaccagaaaataaacatgctttaacttgtatttattactaaacttggt

SEQ ID NO: 175678 - DNA, 471 bp, Homo sapiens
ttcagcacagccacaccaggtcattcccactctgtacgctgaagtggagggaacttccagtggtgggggattgaggaaccacatggcagatatgcctcaatgtggtgccagctggaagcacagttggctttcaaggccagcagctgggactgtccacctagccccaggcacagctgtttatggtttctcctcacgttggcagtttgagtttgatttacaagggtctaagaggaaactgaatcttttcaaaaggaaaacaactttgcagaagctgcctgttttccaaggaaccacttttgacgatgttttgctcctcttggttacaggtaacaagaggattcagaatctgagagatactgcttaaaaggaaaatgtcctggagggatgccaaactgcactctcaaaggtttcggctggatgtgtgatattgatggggaaacccatttcagtgtctctaagaagggggtagtg

SEQ ID NO: 175679 - DNA, 190 bp, Homo sapiens
ctgacagagactcctcacccttcccaccatgcgaagacacagtgagaaggctcagtctatgaaccaaaatgttgactgtcaccatttactcaatctgctgtcgccttgagcttggacttcccagcctccagaactgtgagaaataaatttctgttgcttataagacaaccagtttatgacatttcgttat

SEQ ID NO: 175680 - DNA, 352 bp, Homo sapiens
gaagatgtggatgtgcttgacgtgtggctcacagaaacagtcgtgataagttcccatcccctgcggactcccctctgcagtaacacggctgctgtgaaacctcaaatgagcacatccttattgtcggtttcactgtactgataagcatcaatattatttgactttgttagaaactcagccttcacatacttttgaagtatgttcccacccttgggaaaagaaaaacaaagtagaaatacttgtttccctggccattttaaaacatgtacagaaagcttgaagtttttcccttttacagaccaagcggaggcattttatctaaatccatcatggttttatcttgtatgaaata

SEQ ID NO: 175681 - DNA, 621 bp, Homo sapiens
gggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttcacccgctttatgatggggttggtcggtttactcttgtaaatgtgtctgagttcattcgagattctggatattagccctttgtcagatgagtagattg

SEQ ID NO: 175682 - DNA, 135 bp, Homo sapiens
cacttactactaagtaaatatcacagattttttctatgcatagagacatagatacatacataaaaaggataattagagaaaaattattaaattgagtgaaacctactgatgttttaaacaccaaaggcagattta

SEQ ID NO: 175683 - DNA, 394 bp, Homo sapiens
tttcacctaagggtttaagcagatactaatgattgatgcttacatctattatttcactgagagttataaatgatgccttctcattcctttgcatttatcagctgaaatatatctaaaaaacttaccttgatcagctatttgattatcttgaaatataatttatactagaaagtagaaaatgtttgcttctcccctttaccaattttcagaacttgattctgcagcaacctccaaaagtaacaccaatttctaaaattttgtttagtattagtatgagctcataaattatttttactttaatattgatataaataaatttttatatattcaatcaattacactttttccttttgatatgtgaattgtctcacctttggcaagtagggtccccctt

SEQ ID NO: 175684 - DNA, 389 bp, Homo sapiens
acaggtgaaggccaacctacacaccaggaggaacacactgtaatagatcatccagctcaacagtgaacagtatttgacagaggtgtaagtacataaaagctacctgttttagcaaaaaattacaatagaactatattaggggatagagggcatggaaaaataggaaagtggtgggatgcaagagctaaatacaaatctatcacaacaagaaatcaacaggccaaacatgaggggaaaaccaagaaagaataacaaaccaactatttagcaacaagaagatacagcagactctcaaaaaaagtctttttgttcaacatcgttttttcataacattgatgagagaataagtgattcctggctgaggctacccgtttgtgtggagttggcat

SEQ ID NO: 175685 - DNA, 479 bp, Homo sapiens
tgaattctaaggatcttattatttctgcatattctggtcactttggatctcgatgggagatggataaaggaaaatcttaagataatgcctcaaaatctagggtgagaggctcatttcatggaagaaaaacaaccacccatggaatataaagtaactattttgggtcccagtggtagggagtctagtgggagagactttgtggggaggaatggggaggggatggaaatgcgcaactggcctggaggtaaatttctctttcctggacagtggcaatatggcgccaggatgatgtcattattgtcccacagagatctcttctcccaaggccaactttaattttctgggctcaccacattctgggagtgtgcttcattcctctttgctcaggctgataaggttttatttttactttctctaattaattcaaatgacctaataaaagaatactatttggaagatgcctcaagaactagcatcaa

SEQ ID NO: 175686 - DNA, 586 bp, Homo sapiens
tgtccaaacatgaggcttctggacttataaaattgctagacctcaagaagtatatcagttcccatcaatgagtaaaatgtataaaatcttaatggtttggagtttttctttgaatccctatgatattcaaattgcatcattcatctccccctaattttctccttagacaaattcattacacacaagaaagagttcagagcaaagcaatccaacatttgcaatttacttgtgtacatgttgccccaacagtagatactgaataatggttgaatttaacagattagtccttttgagactagatcatttcctatagccaaaaataagatactagattttatgtagcccagttgtggagatgcagttaaaaccaactcttcctcaaatacatgaagctgtagttgcatggtatttttattggccaacatatagttttgtagtggattacatctgaactgaattttcagtgctgctgtgtgcatattaaatgtttcccttacttcctgctttaggatcctaattagcattatgcataaccttgaaaataatctagtccagtatcattctacacttttatcatatatatgct

SEQ ID NO: 175687 - DNA, 434 bp, Homo sapiens
cctaaccacagaccccgctggtctgagtctctcagtcacctggaggctcaagattcctttcatttccaaagaaggaaagtcagcttggagagggggtaagacaacaactgcagctgccataacccagcacctactttgtgcagggcacagtgttaagcatttcagagatgatctcattcaatcttccaggagttttttggaagcagatgttatcatcgccccattttgcagatgaggaaactgaggttcagaggggttctgttaattttccaaagtcaccgagctagcaggtggggtagcccagatttgattcccaatgtatctgactccagggtctatgttctatggccttggtgccaggactgccccctcggtacccctgaggggtgagtactgcagagatctgcatggagaagggggtacggaacacagct

SEQ ID NO: 175688 - DNA, 385 bp, Homo sapiens
cttattcctcatgctttgaatcactagacttcaagataaatggacagttaactatgcagcttccagaatcacatggtagtttctgttactttttataaaatgttcctggtatgctttgcaacattaacagacattgaaactgccatgtttttcaaatgggaacgtcattaacccccaagtaagggctgaggatcaactcacaggacccacacttatgccagaggaaatcaagtttatttctgattttttcagtgggaataaaagctaattcaaatctattctcagttaactcttatctaatttctacatcctcctatgagaatagcaagtactactacttctaatgttttgtggggttttttggagacgaggcctcactatgttg

SEQ ID NO: 175689 - DNA, 471 bp, Homo sapiens
gggaaagttcatagttctgggtctctagcagagatgaaagttcatagtttcaaactgtacagataaaatcttttatttagctttgcaaatgtattggatttaatacctaaatctaaattatatgtatagtgttcattttgttctcaggaatgaaattggaaaggaagttgaactagataaattcacaggacctttccaactttttagtcaagatgcttagatactaaaagcacattaaaaaaggatttcaataatacatgcttatttgttccttgtaatgaaattatgatgtaatcccactttgctttctcattttgcttttgtacatctacaaacgttcattgccaacatcaactgcatactagtgtgtatgtacttcccagatatagatgctgaggcttcttttttgcacacgagatgagccttggagaatttccaaattccaaatatacagttgagaaacaacattga

SEQ ID NO: 175690 - DNA, 477 bp, Homo sapiens
cctctcaaagtgttaggattacaggcgtgagccgctgtgcccaggctgtttttacatttcttaacaatatggatccaatctttgaaagtgctcaatattaaaaagtcagaaaggccatatgcattgatttccatgttcacaggatattttagtctaatatatttggatcacattggatattcattcctgggcccattatttcataaacacgaaaacttgatttcaaaaagaatctggatatattaaggtggtaaacaatgcttgtgcttttctaaaacaatctttttactgggttctcactagttttgttttcttttggaaataacacaaatgtatgagtccttttctttttctgacttcttttcaattctgttcccttataaaatctcttccttcaaagcagttcaataaaaataaattgcccctttaacatttttttaaaaataaagttttaacatctgaaaaaaattaactggg

SEQ ID NO: 175691 - DNA, 327 bp, Homo sapiens
aaaataataatcaggagaaaagcagagtatggggcagctgtaaggttaataaggattgtgtgatgggggtgatgaccagaacatggtattattacacagcctctgccgtcagactcccgcacttacaggccaagtcactttctcttctctacctctcagttttcttccctgtacaatcgggatattattgcttaccttgaagaaaaaacacacaactcaaccgtacccagaactctgtgatgtttctgcccctacaaaaggaaatgtaatcctaggccgggtgcggcggctcatgcctgtaatcccagacctttaggaggccaagca

SEQ ID NO: 175692 - DNA, 509 bp, Homo sapiens
gggattagctgctggggggtggggtgctcgcagatgggaccagaagtgatgctggtgaatgtcacgtccaggcagagagtggaggagggggcccgcccagtgttgaatccagcttggggaagagaagagaagggggctagggggcagactagcctggcctataggaggcccatgggggaaatgatggcccagttgggttatttggttccccatttgagggttggagggtagagctggcagccaagctcagctgtgtctacagtggagtgggcaccagaaggatttccacctgggaggggctttgggggattgattggattgcaggggtgggtattgactcttcatttgcaaaacactttatgtatgatggaggtggggaccctaagaatggggaggtggcaggctttgagagatgtgtctagagaatctgccaccaccagccaccccttggcagggccaccagtctaaggccaaagactatgcccttccccagccagcaccatgaaagt

SEQ ID NO: 175693 - DNA, 354 bp, Homo sapiens
cccaccttaatgagtaactatttaaaagtaatttttgttttgcttcatccttccattgtttttcttaacataaaaacataagtatacatatttatattcttctgtttcttaggtaaattgtaatctgctatatttacttttttctactttgctttttttattttacaagccattcaggagattactgcatagtagtacgacagtagtaatatggcatagtgtgggattttgctttgctagccaatctgaatttttttttttaaattttaacacataaattaagcccatttaaatgtattggtatagccaatatgtttggccttggctctgtcattgtttcatattacatatgta

SEQ ID NO: 175694 - DNA, 672 bp, Homo sapiens
tcctttaaaaagtctttcgttgccagctcatcttttccagtccaaatgacacactaatcaactatatctcatcgttgactacatatatatgcctaagttactgccaaaagctcaaaacagattttaccaagtacaacttctcacccttctacccatcttgcacactgttaactaaccttccttaaaaaaaaccttacatatcacccccctctgctcaagaacctaaacgatataatggatcaaacctttaactcattactatgttttacgttctatcctcaatgaaagacctctgttccaatcaattcaggctcaccgctccagcagagatgaagttattgcaaactctgcctttgttcactactcctttcttccaaatgctactccacctttcctcttcacttatctacttattaactattaattcttttgttgttgttgttgggggattagggacagggtctcactatgttgccaaggctggtctcaaactcctggtctcaggcgatcctcctgcctcaaccacccaatgtgctggggccaggttcagtggctcatgcttgaaattccaccatttggggaggccaaggcaggcagatcgcttgaactcaggggttcaagattagcctgggcaacatggcaaaacctagtatctacaaaaataaaaaacaa

SEQ ID NO: 175695 - DNA, 556 bp, Homo sapiens
acgtcgtgactgggcatgacctggcgcaccttctacccatcttgcacactgttaactaaccttccttaaaaaaaaccttacatatcacccccctctgctcaagaacctaaacgatataatggatcaaacctttaactcattactatgttttacgttctatcctcaatgaaagacctctgttccaatcaattcaggctcaccgctccagcagagatgaagttattgcaaactctgcctttgttcactactcctttcttccaaatgctactccacctttcctcttcacttatctacttattaactattaattcttttgttgttgttgttgggggattagggacagggtctcactatgttgccaaggctggtctcaaactcctggtctcaggcgatcctcctgcctcaaccacccaatgtgctggggccaggttcagtggctcatgcttgaaattccaccatttggggaggccaaggcaggcagatcgcttgaactcaggggttcaagattagcctgggcaacatggcaaaacctagtatctacaaaaataaaaaacaa

SEQ ID NO: 175696 - DNA, 386 bp, Homo sapiens
ctgatttttttttttcctgaggctgtaaacttttcatgtgcgttggattcaaataatgtaaacaaaatttaggctgtccttaccaaataccttataatctagaaatggacagttatttttaatatgaaccttcatttatgaaattaggtataccagaggaacattctgagaaggattgaaatgtttaatgtgtatttctaccttctcctcttcacagaagaatttttttggcccagggaaggcagaactagaggcagttggttcctgtaaaaagaggcttacaggccgggcgcggtggctcacgcccagttttattatttttagaatggtgagtgttgaatgctttgtggactgaggagaagcaaacaataaacaatcacatcatg

SEQ ID NO: 175697 - DNA, 188 bp, Homo sapiens
tctagatgatcccatactgacctatctatactacctatctatactacctatctatactggacctatctatactaccacccccggggtccgggctgacctgactccacctttggggtctcacctgagccagctcctccctggccccagaatctcacctcagagaccaccttccctccttccagcagcgt

SEQ ID NO: 175698 - DNA, 503 bp, Homo sapiens
agttcacagtgttctgagaaggaagcaaggtcaaaagaatgacctaccaaggccagcaagcctgcatttcctccccatcctttctcccggcttctcttttcttttgcccctctcctgcctgggatgcagattctcccctagagaaagagcaggctcctgccccaaggattggctgtcccctgacactggggaagcacacgtacagcgcaccttgatggagcctagtgaactgagcaaccctggtgtggtttcctccgccagctgcttgagtaggtggggtcaggcctaaggaaggtgagcacccagccactgccttgccttgccagccgtaggagcctactcagactctctgagcattaggctcattgtccatgagaaaaggaatcatagtacctgccttggaaatggatctcctaaactttaaagagactatatgtgtaagtgcctcgcatgcattaggtacatagatgacatctgccgtttggtactttgtaattttcaag

SEQ ID NO: 175699 - DNA, 227 bp, Homo sapiens
tatactgacctatctatactgacttatctatactacctatctatactgacttatctatactgacgcattactaggggctaggaacacagtgttagaacagacaagtacctgccctcaaggaacttgagtggaaggacattaaataatgccacagatacccgtatgatgaacgcagaggtgagtgttcctcagctgcagcttaaagggggacagcctgggtttggggt

SEQ ID NO: 175700 - DNA, 648 bp, Homo sapiens
aagggatagataccagaagagaaattttgtgtacattttaatttgggttgtggaaaattgtattctctattaaagggtttagaggagtgcattcaaataatactcctaacagttggataaactgtcatgagggcatttggctgtgaagttgcaatgagtggagaggcattgacattgttgctgatggtgacgttcctggttgatgacatagaagacttaatttcctcctcatgattaatctctcagttggagagtatacacactcttacacagaatccaggacgaaagccctcatcagatgcttacatcatgatcttggacttcccagcctccagactgatgctatggaagatcagaaaatataaatttatgaactgctataaactgttattttcttcgtgaagatcagcacaacaagatgttccagacttattcaacatattgtccagccagtcctggaaacaatcagttccctgaggacagaattaaagtttagagacctgaatctgggccccaggggtggtcattactactggtttgccactgcttctgtagcttttcagtgaagaggtagttatgtaatatgtatctaaaaaaataaattcaagttatgtattttaaaaataaattcaaggtctatatatttta

SEQ ID NO: 175701 - DNA, 530 bp, Homo sapiens
gcctgaagttttctgcctccagactctactctcctgcctcaattctactctctacttttataagctcgactcacatgacgaaagccctcatcagatgcttacatcatgatcttggacttcccagcctccagactgatgctatggaagatcagaaaatataaatttatgaactgctataaactgttattttcttcgtgaagatcagcctccaggttcatcacatgactcagctaagagaaaatatccagtggctcatcgttacctgtgggaggaggtctgaactccatggctttgcattcatgttcttgtttgtctcacttcaaccttcattccctccaagtcctcgttgtcctcccagggttcctctgctacagccgggggagtctgatccctgcttcctaaatttctctgaagcttatctacacctatgtttttgctccactcttctttctcctttatacaccaattattctcctgttttatccaaattattcccttctgcaagactcacatcaagtacgatttctttc

SEQ ID NO: 175702 - DNA, 515 bp, Homo sapiens
acttgtgaagcttatattttgcacttctaaaggcagcagaatcctgaagtgtaaacaatctcttcttacccatgttttttcctcctgtgtgttttgtcttgcctattttttttattgtgttatgaaaacagaaaaccagggcaatatatttggtaggaactcaaagacagaacaaactcataatcttgttttatgttttgtttcagatgctatggaagatcagaaaatataaatttatgaactgctataaactgttattttcttcgtgaagatcagcacaacaagatgttccagacttattcaacatattgtccagccagtcctggaaacaatcagttccctgaggacagaattaaagtttagagacctgaatctgggccccaggggtggtcattactactggtttgccactgcttctgtagcttttcagtgaagaggtagttatgtaatatgtatctaaaaaaataaattcaagttatgtattttaaaaataaattcaaggtctatatatttta

SEQ ID NO: 175703 - DNA, 444 bp, Homo sapiens
gcctgaagttttctgcctccagactctactctcctgcctcaattctactctctacttttataagctcgactcacatgacgaaagccctcatcagatgcttacatcatgatcttggacttcccagcctccagactgatgctatggaagatcagaaaatataaatttatgaactgctataaactgttattttcttcgtgaagatcagcacaacaagatgttccagacttattcaacatattgtccagccagtcctggaaacaatcagttccctgaggacagaattaaagtttagagacctgaatctgggccccaggggtggtcattactactggtttgccactgcttctgtagcttttcagtgaagaggtagttatgtaatatgtatctaaaaaaataaattcaagttatgtattttaaaaataaattcaaggtctatatatttta

SEQ ID NO: 175704 - DNA, 542 bp, Homo sapiens
cctacctcagaatatcttgttttgtaagatagtactttatcttcattattttatttgggtattctattattatagctgaaaatattttaatggatattacttggtagaaaagctagagcaaaagacctggattcaaattctcccatggctccctagatgatattacttcaactaaagtatttattcccattcatgtattcaacaaatgtttataaatgaacttcaatgtgccaacaaggtactgtttaagacagtaagaatgcaacagtgagtaaaaccggcagagatccctgtcctcatgtagctaacaattgactatgtgttctgtgggactgtctgtgtgtgagggaggtggtggtatggagtggcaagaaataaaccaggtaaataattaagatgatgttgagtggtgaggagtgctatggaggaagataaagcaggacagggtgacagtgtgactagggaggtcctcatgcacaaggtgacatttgagtaaggacttgaaggagacccagtgtgtattaggaacacttctagtggga

SEQ ID NO: 175705 - DNA, 485 bp, Homo sapiens
cttgagacttttggcttaaaaggccgagccaggtatatttttaaaaagctactttgaataaataacttttaatttcagtaatgatgttgctttcaaaacaaaacaaaacaaaatccagacattcatgttcattcttagagctttttttctttcattcaacaaataattgctcaggtgtgcctaggggaccccagtaaaatggaaacagcgcctacctgctctcgtagcttacaatgtagggagagataaacatttatttgtgtaaattatttgtttaacgtggaaattagaattgtgacagatactaagaaggaagtattgggggaccttgcctagtcagtgttagggcaggcttctttaattgaatatcatttgaaaagaaaacttaaaaggtcctcctattttttgcttacatttgtaattattacttttaatacgcttttttgaattatgttcaagagcagtttatattttcaagttaccca

SEQ ID NO: 175706 - DNA, 439 bp, Homo sapiens
tggacaggtgaatcccgtggacatttgtagacaccgtccaagtgctcagatagcatatgtgaataaaccctccccattttagcatggtccctgggcaatttcaatttttgtccatcagcattaagtttttccgatctacctcagtgatgggccctttcagatggaattttagagggcaggactgacacccagttgagtgacttcactttaaaccaaggagaatgaatcaagtgttgacactcaccttatcacttgtgcctagaggttttgccaatattccagtaaccaaaaggaaaggccagaaaggtaagaaaaccactaggtgtcacggaagccagagaagaagctatgggcagctgtgctaaatgctgtagaaagagcagtaaggacgactgactctgaggtcatggtgaccactggcagatgcagttgctctagg

SEQ ID NO: 175707 - DNA, 372 bp, Homo sapiens
cctagctgcacaactcactagttacgtgaccgtatgcaaatcccttaaacttcagcttcctcatctataaaataaggctgtaacccatttcacaggacagttaagagggttaaatgaaatgtaaagcccacaactgaaatatagttttgctcctcatagataggctatgtttttatgtgaatttttcccacagttagccttgggtcattctcaaaaatttgtgaagttatgaaagactgttatcaattaagtcagaacactcccttcaatcttttaacatgaggaagatcaactccatcctcccacaaaatatctgttgggcatggtgagacaccaaatgctacatgacatgaccaggcttgatggagaatt

SEQ ID NO: 175708 - DNA, 248 bp, Homo sapiens
actccagaaatcactgtgcaatttcacgaatggcttaaagcaatggacataaaaggaaaaatcacttcagaaaaaaaagaaagcaatggtaaaagacctagagacgttattcagcttcactcacagtgacagtggggtgtgttttcctatccctaagacaaccattgccttttaagcatcaaaatttaaaaaacaaacaaacaaacaaacaaaaaagctattataaagacatgtagaatatcactgat

SEQ ID NO: 175709 - DNA, 493 bp, Homo sapiens
tgtaaccccatctctactaaaaaatacaaaaatgagctgggtgtggtggcgggtgcctgtaatcccagctgctcaggaggctgaggtacaagaattgcctaaacccaggaggcagaaggtttcagtgagccgagatcacaccactgcactccaacgtgtacaacagagcaagactctgtctaaaaatataaattaaataaataaataaaagagattgttaaaaccttttacaagctgggtatagtggctcatgcctctaattctagcactttgggtgatagaggtaggaacattacttggaggagttggagaccaccctgggcaacatagcaagacactgcctcaaaaacaaacaaacaaacattgtctgctggctgggtgcgtggctcacgatgaggccggcaaatttcttgagctcaggagttcgacaccagcctgggcaacatggtgaaacccagcctctacaaaaaatacgaaaattagttcgagcatg

SEQ ID NO: 175710 - DNA, 490 bp, Homo sapiens
caaagagcaggcttttttattaaagaaaaagaaagcccaccgcccccactgcatgtggaccttaatgaaactaatctaataaacactagaaagaaggtgtgcaaatgggccagcatttgccgtctatccacctgtgtcacccaggtaataaaggtcatcctggttgtaaacccctgtgacagcgtgccgggttcgcccccacgccggacccccgactccgatccacagatcctctccgtgaggggttcctctgggcttagaacgcccccgcgcgcgcgtgcaggcacacacgcgcacacactcacacgcttgctcgcacaccgccagtgcctctccttcccacctgggacccccgggcagccgggctggatgaacaagttgcagctggccgcggcgctccgctagggggacgagggtggggagggggagcccagcggggcgcagggccgtggccagggcctggggacctgcccgcttccctccgcggccg

SEQ ID NO: 175711 - DNA, 857 bp, Homo sapiens
aagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagtggtgaaagtgccacagaagacactcctgatggatgctcttaaagaagaatctgagataatctatgacttttgcatgtgcaaccctcccttttttgccaatcaattggaagccaagggagtaaactcacgaaatcctcgaagacctccgcctagttctgttaatacaggagactcgcttgaacctgggaggtggaggttgcagtgagccgagaatgccactgcactacagcctgggcgacaaagtgggactgtctcaaaa

SEQ ID NO: 175712 - DNA, 733 bp, Homo sapiens
aagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggtatatcattttaaattcttttttggctaaacagttttcataagttttgcgagatcaaattctttgtaaacttttctactgggtatttgttgttgtacaaaagaagctggctacagatacaggttgagcatccttaatccgaaaatccgaaatgcttcaaaatctgcaacctttgagcactgatgtgttgctcaaaggcaatgtgcgttggagcgttccagatttgggggttagggatgttcagcctgtaaatatagtgcacatatttcaaaatctg

SEQ ID NO: 175713 - DNA, 445 bp, Homo sapiens
aagatggcggcgcgctgggagcgtatcatctgcgtttctaggagcttcgctatgcggctgctttaagattctagggttgtacaggcccacgccagacacgacgtctggcaggaacctcggcctcagaggtgggtcacttatatctctcacgcagatttactatcatgggtcacttaacccgtggatcacacgggttcctcattcttgagttttgggctagtgaggtgccgacttcggggtctaggaggggagacctgatgtggctgtgtgtgcgcacgcgggggtgttgagagtggatgagtgggaggagttggcgaatagaatagagactaggactgaagtaggaaagactccccggtgtttaggaggtttagagagatccaaaactgaggcagaccacaggacggggtcgacgcggccgcgaatttagtagtagtagtcgacc

SEQ ID NO: 175714 - DNA, 353 bp, Homo sapiens
accttgaatggctggtatttcctcgcaacagaagtggatgatatgtgtttcaactatgcaaagaaaaatgtggaacagaataacttatctgatctcataaaaggttagcgccacagaatgaatgcctccaaactttgtgtcttcacctgcctttttagtttaacgcatttcattacctttttctttaatacacagacttcggtaatttaaaaaaatctggcactttgtaattgggtttgctgtcttgataccagaattaactcagaaaatagtaactacagttgatccttatgatttgtggattctttttttgtgaatttgcctatttgcctaaatttatttatttatccatt

SEQ ID NO: 175715 - DNA, 3372 bp, Homo sapiens
aagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagtggtgaaagtgccacagaagacactcctgatggatgctcttaaagaagaatctgagataatctatgacttttgcatgtgcaaccctcccttttttgccaatcaattggaagccaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcccctgaaggaggagcttcgcatacaaggggttcccaaagtaacgtacactgaattctgtcaaggtcggacaatgagatgggccttagcttggagtttttatgatgatgtcacagtaccatcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaataggcaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggtaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgaggcacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaggtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgcggagctggagctggagaaggcagcatactgaccagtggctttttgattgattgtttgttatgaggtggagttttactcttgttgtctaggctggagtgccgtggtgcgatcttagctcactgcaacccccgcctcccgggttcaggagactcgcttgaacctgggaggtggaggttgcagtgagccgagaatgccactgcactacagcctgggcgacaaagtgggactgtctcaaaa

SEQ ID NO: 175716 - DNA, 901 bp, Homo sapiens
aagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggtacccaaggacgtgcttgtccagtagcactggagccaggataccctcgggcaaaaatggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagctggagtgcagtggtgtgatctcggctcgctgcgacccccgcttcctggattcagcgattgtcctgcctccctcgagagtctccgtcgaactggggatcctc

SEQ ID NO: 175717 - DNA, 184 bp, Homo sapiens
tacaacataagtaggctatgaaacatgtaaaataaataatcaaggtttaaggactttcattttggaaagctgataaatgaccagatttttttaaaaaagggataaaccccaaattcctgggaaagcagtcggttaatagaaaagcttgaagtaggtctggtataaaacaataggtactatctgc

SEQ ID NO: 175718 - DNA, 398 bp, Homo sapiens
tatcttccccagatagtactttgctgttcaaaatatagtaattaaaatcatgcactagaagaacactagaaactttgtaagaactcaaattaattgtgatttctttttgtctggtagattttttttggaaaacatacctttgcttttactatttatgataatatattagtattttaatttctaattggctgttgtgcaataaaaaatacacatattggtctctgccccccagtccctggcacagagttcttaaaactcttgtagtttcctgagcaataggagtgctaggagaatctttcattctaatgtttggtttctgctctggttcttgaaacagagttcttaatactctgttagataggggtgctaggagaatcttttgttctaatatttggtct

SEQ ID NO: 175719 - DNA, 169 bp, Homo sapiens
tgatgtgtcagtaatatctaaagacaattggcccccatcctggcccttgcaattaacttctgcgtacttactgggagtagaaacagctcaaagtgttcaacaaagtgctgagattttaccttgtcttggtccggatggacagtcttgtacttttcagccttatgtcgca

SEQ ID NO: 175720 - DNA, 387 bp, Homo sapiens
ggcctccccaagctcatgtcccttgacaccacgcaagccagggctggcagaaggattgcaggtgcactgctggacaactgcacccggtcccactctgtcactgaccagcagcgtgacgtgggcagtgtcttcatctctcgtgcctcagtttcctcctctgttagatgggggtagtgctgctacctccctccctcctggaagggcgctgacaagggagctgaggttcaggaatctctcatggtgacccagagaggagctggcgtccaacagcacgtgtgtccactttttgtgacacttacctgtgccactgcaggtcaggggcttggccccgtgcacagtaagtgcttacagttagcatcattattcagggtggactatgagtgctct

SEQ ID NO: 175721 - DNA, 337 bp, Homo sapiens
ccaccattcggacatggtctcaataatcttcccgagctcggccagctcacaggagctcaagcttacaagtagttggtgtgtaatttgcatggtcagtagagacaaagaaaggcttcaaagccactgcacactcctgctgctctccagagataaagcgaggagagggtgacgatagccaatcagggcccacgccagtttcccagataggaaccatggccgataaacccgagaccacaggtgttccatccctgctactcagcccaaagcaacaaggaagcctgaggtgacaccacaaaatgcaaatttatctccaacgctgtcacttgttaagatagca

SEQ ID NO: 175722 - DNA, 258 bp, Homo sapiens
tcacaggacttttattcttccagagacttaatcttatatggttatgagatttaccaatttactgggcaggatgtaggtctttggggatcttctgatctcacttggttctgttctgagtattactgctttgcttcttgttcatttttaatgaacacattggaacattgttttccttttttttttgaggcagggtcttgctctgttgcccaagctggagtacagtggcatgatctaaatgcactgcaacctctgcctcca

SEQ ID NO: 175723 - DNA, 556 bp, Homo sapiens
gtatcaagaaactcagaggtacaataaggattgtccacagtgatccaacatttaaaccagcagagctaaaagcggaatcctgagttttgtcctgtaagcattataccacatttgtatttatatgtgtatatatatatgtatacatgcacatataaataaaatatttttattatttatgtatttatatatagaaaataaacatatgtatatatttgcttctaaatgtaaatatatatctggattatgcgtatatataggaacagagagatagttttggccgggcgcggtggctcacacctgcaatcccagcactttgggaggctgaggtgggcagatcacgaggtcaggaaatcgagaccatcctggctaacacgatgaaaccccgtctctactaaaaatacaaaaaattagctgggtgttgtggcgggcgcctgtagtcccagctacgggggaggctgaggcaggagaatggcgtgaaccaggaggcagagcttgcagtgagccgagatcgcgccactgcactccagcctgggtgacactgtgagactccatctca

SEQ ID NO: 175724 - DNA, 642 bp, Homo sapiens
gcctgtgacctattattatcagtgccattgcaggataatgttatagaaatgtgatattgaaaatactcatctgtttaatagatatattcaaaacttcccgtggtagacagaataatgccccctcccaaaaaaatgtccatgccctaatcttcagaacctcttaatatggtagattacatggtgaggagaattaaagttgcagatgaaattaaggctattaatcagctgaccttgagatgaggagatgattctagattatccaggtgggcccagtgtcatcacaatgtccttataagtgaaggagagattcagaagaagggcaggagttacagtgatgcagtgtggcgcagactctaccagccattgctggcattgaaatggaactccacaaaccaagaaatgaggacagcctctagaagcagaaaaaggcttgaaatgtattcttccctggcatctccagaagggagtcagccctgatgataactttgttttagctcagggaaacctatttcagacttctaaactccagacctataagataataagtttatggtgtcttaagccgagtttgtgaataatttgttacagcagccattaggaatgaatacgatggaaatatttatgtaataagatctttggaga

SEQ ID NO: 175725 - DNA, 352 bp, Homo sapiens
gcttatgctcctctgcagaaccactggtcttgagctgaaaggggatcaggccaggtgctgagtgggatgactttgtgattttgagaccgagcatgtgtctgtgtgtgttgtgggggggatgctttgtggatgtgcatacataccagcaccttcaagaatgcgacttcttctccccctaagttccaggagatcctcacaggttctggctttgtgcctgaaaattttgggattatggaattataaaattttatgtcttgcctgaccatatagtcagatcttcagcattctcaggggcagtgtttctgattttctcagccattgcccttgccttcccaaataatcaagattatta

SEQ ID NO: 175726 - DNA, 368 bp, Homo sapiens
tggccctcacacctggctgtcatagtgtcaaaggaagcggatttaacacagaaaatatattggaaaaatttttcagaagtgggaaatagtaggctgcaaattatgagaaaagatatgaattgatggcgatctggcccaaggtgacatgactaagcacagcacatctctgaccttgctggtttctggccaccttctctgagagctgggcagtgtgactcctaacctactgataggactccaagggctctttaaattacttcaagctagacccacaatgctgggtagaggatggatggtcgggtagtgaccctggtggagatctcaggtatgcagccagccatctgattagtaactggctgggtatctat

SEQ ID NO: 175727 - DNA, 446 bp, Homo sapiens
ctgtctctgtctgtcttggagcacatcctgccgttcttctgcaatagcatcctgctataggggaagaccctgctcccccgcattcaaacagtggactttcagtggggctgctcatcccagaatcctcacaccctgaaaacaggccaaggcctgggatccagtcccacgctggccacagcgacaggtctagggataactgcaggacccacaagggccagccacagtccttcctcaggatttttctaggtggattgttcttaaaggttctattcctcttttgactgtgtgaggctgtgtccccagaaaggcagtctagactgccctctgccatggggagcagctgagggatggaggcaacatcccagggcactggagccaagaagcagaggggccctgaaggagcaccaggtacctaaggctactctgagttcagtttcagttcctga

SEQ ID NO: 175728 - DNA, 397 bp, Homo sapiens
ggaattaggctggttcaggtgaggagaggagaggaatgaagagagggtatggatagctttgtgatatggacactgagtaggcacttgaaggagtagaagacttaccaaggtaggtactggtggtggcaagataactctagaccccattcagaggagtttagattggagggagggagatactcggaagcgtttgtgttggttccttgaattccatcctatatctttgatttcttgaatttaatttctaccaggtactctgcctagatcagttcctgttggcagttttgatttgactggatgttttaacaagtcctcttaactttgctttattctaatctggttataatattatggaatcttaaaaatcttaaggttagaagggcccatattcacaacc

SEQ ID NO: 175729 - DNA, 629 bp, Homo sapiens
ctattggctccattcatcaagaagtagaggtgattcctgctcttcctctttgaacttgggccagccttgtgatttgccttgaccaactggacatggaggaagtgatactgtgccggtgcttagcccggccttttagaggcctggcatcttcagctctctctcaggagaatacttgtacctggatcttcactaggggtaagtccttgttctcgattttaaacatttatttagccaactaagtgctctattaattctagttgaaggggagatgcagagacagtgttctagttgctaatgctgtgtgagaaagcaccccagaaggtcgtaggtgaaacaactatcttaagatgctggctgatcggggctggggcattcagaagggccaaagcaagagtggcttgtccctgctctatggttcttggataactcaaagggctgggggctgagagagtggaggaaggaggacacacttccagatggcttgcttgttcatgcacgtggttatgcaccgggcaggaacagggacagccagagggccaagctcaaactgacagctaaagagcccagaggggcagtccttgggggaggcggtgcccactgcctgccttatagaccgtatccctaccatc

SEQ ID NO: 175730 - DNA, 652 bp, Homo sapiens
cttggcctcctactcaccaagtccaaaggttgttgacaggcctaattcccatgccccttgtagagtttgactttcttgaccagtttcccattctcagaacctcatcttggcttgatgttctggtctctcccctcccctccatctgtttgtctccagtttggtttctctccctcctctgaatttctgtagctcatgatctccatgctctgacagcatttgttactttctgtatcgtgccttggtttacattggtgatttatatccatgtcttaactcctgtgctagatagactctcagggtaagatccaattcttgattctcttctttattcctccaagtacctaggataggcatatagtgggcagacagacattggaatgaatgaatgaatgagcaaacaattttggggcatttgttataagttaattgcttagcagtgttctctaagtgtgatccacaggccatctgcatcagattcatgtgtgtataatagagtgttttgttacaaatgcagatttcagggccatacccagatttattgaaccagaatctctgagagtttacaattttcagtcacaccgctccctccccatgttgttcactttaaaatctgagaactcctggtttcatggacaataaaccaacattataa

SEQ ID NO: 175731 - DNA, 182 bp, Homo sapiens
acctcattgtaaaaaaaaaaaaaaacaaaacacacaaagataatgttagatacttctggctttcatgtgattgaggctctgggctgagagaatgttcagccctttcctataatatgtgcttctgtattacaactcatcaaccaaaggtgtatgttccaaatttccacttgttgccattaaca

SEQ ID NO: 175732 - DNA, 159 bp, Homo sapiens
cagggcgggggccagaattgacacacacaccaccacccattccatcactgtgttgctgccatagctgaggtaggagtcgaggcccatctgattcctgagcccacattcctcctcccagcagataggacagagaatacaaatcagaggagcctgcagagc

SEQ ID NO: 175733 - DNA, 516 bp, Homo sapiens
gtgttttgtgttaagatgagctttaaagcaactctgaaaaagaagagggtgcctataagtaattcatagactgtttaaacaatagtagaggatctaagcatagatcccaagaggtaaagggaatctttatcactttgggaacttttactgataaatagaaattactgtcagtacagtccacaaatatgttgtttatcagccatctttcctccctgtcttcatctagcactgtagcctgtgttccacagaaaatatagtcaataaaattcaacattctttactagcttactctaatttgtggttggccataaagtattcctggtagagataatagagataatatttaactggccatgagaaaggaaacactatcgtatatgatacacccctttttctactcattccaacaacgatgatacagcacgtttccttttgaagcacgtgttttttccttgagtgaccagttcaaaagatgatgacagttaatatcttgttactacagaatttgtactcaaa

SEQ ID NO: 175734 - DNA, 393 bp, Homo sapiens
ggattccaggcatgcaccaccactcccagctaatttttgtatttttagtagagacggggtttcaccatgttggccaggctggtctctctcctgaccttgtgatccacccacccttgcctcccagagtgctgggattacaggcgtgaggcactgcgcccggcctgcttatattttttcattgtccagaactcatctcgtggccttctctggagcaaaggggtggcaagtgtagtctgcagtatgtccaggaaagaggaatgtggaacaggatttgggaacacatagtactgttgctgccaccagcagttacaagctatgaactgaatgaatctatacatacagccatgaagacatgtctttaaaacatagttttgagttttaaaaaaaggtagg

SEQ ID NO: 175735 - DNA, 157 bp, Homo sapiens
gcgacttggctcttttgttgttgtcgttaaaaaatattgaggcaaaatttacataacataaagttaagcatttaaaagtgaacacttggccaggcgtggtggctcacacctgtaatcccagcactttgggaggcctaggcgggcagatcacgaggtc

SEQ ID NO: 175736 - DNA, 523 bp, Homo sapiens
agtcagctttggctgaagggcagggctggcacacagctggcagagccaccccatccaaaatccagccactgtgcctcagcagggctgtggtttgggggtcggggggcgctccccacaggataaggagcagccagggcaggcagatgacactaccactactagctgcatctggatctattcacttattcaacaaaggtttattacacccatattctatgccaactactgtactagacttggaataatggagaaaattcaggcacagtccttgctcttagggagctcacatgattactcattgatgaatatctctctcccctgatagactgcaaatccatgaggacagggactctgtcttgttctgtgccatagttccacagcattccagcatgatgtctggtactcagcatgcaaacagtgcgtattggttgaatgaataatagtacagctaatagcagctgagagcttcctctgtgctagacacgattctaggtgccttccacactttgacaaccttatgcag

SEQ ID NO: 175737 - DNA, 160 bp, Homo sapiens
ccaggttggtcttgaattcctgacttctagtgatctacctgcctcaacccccaaagtgctgggattacaggcgtgaaccactgcgtctggctgagctttctatgtttttaatactcaacaaagcttccatcataaattatgaacgtatgactttcaggca

SEQ ID NO: 175738 - DNA, 521 bp, Homo sapiens
gggcctggtagggggtgattggatcttggggtggatttccaacttctgttctctcaatagtgagtgagtgagtgagttaccgtgagatctggttgtttgaaagtgtgtggcacctctccgcttctcttgctcctgctcccatcatgtgagctgcctcgctcctcctttgccgtccccatgaatgtaagtttcctgaggctttcccagaagctgagcagatgccagcaacatgcttcttcctgtacagtctgtggaaccgtgagccaatgaaacttttttctttatagattacccagtctcaggtatttctttgtagcaatgtgaggacagactaatacatatattgtaggatttttgtgaaaattaatacaatgataaagggtctggcatgcagcaagaacttacaaatgcagggtctttgcagtcacttggaaagcacttctctccacactaggaaattacaaaatggctttcactcccaagaattcatagttctatgtctttacctgatcaaacatgaa

SEQ ID NO: 175739 - DNA, 515 bp, Homo sapiens
gatggagtgtgtacccttagacctggagtccagcacgcaggcccctgcgggtgtgagatgggctggaagcttgaagagaattcgacccggagggagaagcatgccatcttattaactgcaactttacttcaagaaatcacgcatttgacctgagatcagtatgtcctgtatctggctgcaatctgcctcctcccctggagcctagggaatggctgactctcatgcttcttgccctggatgaccaaaggcccttggctaatattttttctgtgaagcgacagggttcacctgtgcaagagaggacagaggcatctaagaagatttccaatcccgcctgcacatggcccttctcctgcctggaggccggtgtgcagccctgcctggggggagaggaggcatcagagggatgctgaaggttcctttggatcctttgaccttttcccacatagactctttttttgataccaagactaatgatctggtaaccctccagaaaggcatccaggaacaggggc

SEQ ID NO: 175740 - DNA, 322 bp, Homo sapiens
cagcgttagctattccctgcctatcctgaccactgctgtcccctgcacctatcctcatgcttgtcctgccacccggaacccactgttcagctgcagacctggacaggcaggcataggaaggcataaggacacagttgacagatagcaacaattctagattgagacaggcagtgcctctgacagagaacctgggaccagctgctggtcctggaggaataatgagcttggatgggggacatagagtctgagatactgaaagtgaacgcatccacatactctgggctggagacagggaggggcagatcggcagagcagagccaaa

SEQ ID NO: 175741 - DNA, 294 bp, Homo sapiens
caaatactagtcatttgaaattattcagtaaaagaaataaaaaggaatgaaaaatgcttatgcgattgatgcaacaccatgaagagtagtcatatatgcactatgggagtctcagaaaaagaaagagataaaggggaagaaaactaacttaaagaactagatcagtctctccttatctgtagttttgctttccttggtttcaggtacagtacaatgatatgttttaagagacagacaatgaaagagaacatgcaaatattgacataatttttattacagtatattgtcatagtt

SEQ ID NO: 175742 - DNA, 1028 bp, Homo sapiens
atgctgaacatatttaaatgcaaatctaaataaaatagtaaaagcggaattatggtagccagcatcctggatggccccaaaggtacccagtatgtggtattcacaacactgtgtagctgcctcctatactgaataggattaacttgtatagcaataaggtactgcggaaatgatagagtatgagatagatataaaagacactgtggcttccagcttatgcgttcttgctgtccttttgctctggagaaaaccagttgacgtatcacagggacacttaagaaaccccatggagaggtctacatggtgagaaactgaagtctattgccaatagccatgtgagagccacgttggaaggtgatcctctagtccctgttatgccttcaaatgatagcagccctggccaagagtgtgactgcaacctcaagagaccccaagccagaacttcccagctaagccactcctgaactcctggtccacagaaaatggtgttaagataataaatatttatttctgttttagggtaatatgttttacagcaatagataactaatatagaaatgaaggttagagaatagaaaatagactagctcattgattgcctcatttgtgataactgagagataaagggtgtcatttcaagctgaaaatcaaggggaagaaatttagaaatgtttaggactacagccaaggcaggaggactgccttgaggccaggagtttgaggccagattaagcaaaagaatgagaccttctctaaaaaaaaaaaaaaaatgaatacaaatgtaagtcaaacagggcaaaatgtcaattaaatttcaacatacaagcaaaaagtaggaaatttaaaatgacagcacttagcaggaaaaattcaaattcctataaataaatctaacaatatatgtaacatacaatatcttttgtttgttggtttgtttttgagacagagtctcgctctgtcacccaggctggagtgcagtggcacaatctcggctcactgcaacttccgcctcccgggttcaagtaatt

SEQ ID NO: 175743 - DNA, 224 bp, Homo sapiens
tcttcccagttaaaagtgtacaaacccctacaagtcactttatctttctcggtcttagtttcttatgtgccatatgagagaaataagatgatgggtaagatttcttctaattcctagactacatgatattacagaacaggatccctgcctagtttgagaagatatacatacatacatacatacatacatacatacatacatacatgcttaaacaagtgccagtg

SEQ ID NO: 175744 - DNA, 787 bp, Homo sapiens
gcatagaatcttcaccctacgtttggtatactttcccaaacctctctcattcagtttttctctgcttaagtctagttctttcttcaggtttcaacttagattcttctgggaagcagaagaatctggccatcttccattcccatatgttaaccctttatatgtgctcatataaaaatgcatattagttacttaaataatttgacaaaatcttttctatttatattgtgttattttccaccatgcagactgccttctattctttatcttcttttaaaattgtaaatatgcaaatgcaacctattttaaaatatctatttctttcatagtcctactataatctgccttccacagtctcaagagtaaaggaacacctactatatgccaggcactgtgctagactatctcatttaattctaaaaaacaaaaaagacggtaagacctgtaccttcaatttgtaaataaggagaccaaggctggtggagtgttgtgtggtggtcaaaataacatagtgtggatccaggcacggtggctcacgcctgtaatcccaacactttgggaggcagaggtgggctgatcacttcaggccaggagttcgagaccagtctggctaacatggtgaaaccctgcagatcacttgaggccaggagttccagatcagcctggccaacacggtgaaaccccatccctaataaaaatacaaaaattagctgggcgtggtggggggagggtgcctgtaatcccagttactcgggaggctgaggcaggagaatcgcttgaacctgggagg

SEQ ID NO: 175745 - DNA, 639 bp, Homo sapiens
gcttgaaccatggcacctggcctttttttcattttttaaataaaaagctgccaggagcagctagcagtgctgttcagggaaaagaacttggaaaaagcacaggaggaaggaaggttagaagcaaacacagaaaagctacagagtaatgggacatgctacagaggttatgtgagaaagatgggggaattttaagtgggcaagtagaacaattagacatattttagaaaaatcaccctaaatggtgacaaacatttgtcctctgaaggagaatttgatgggggttattagctctgatttatagatgagaaaataaagctgctagaggttaaatgatctgcccaagattatagtgccatcaagaggcagagttaagatttgaactcaatggtgagactcaaaaccaagcttttattacagcaaagaaaactgtatgactatcacaaatgagctgtaaaaggccttgtccaaagacacttcaaaaaatgttttaaataatggaccaagagttaacctcttgaagttttattttatttctttttatttattttttaccataaggcttttttgcactgttgaaattttctgatacaaaacttctggcatctttttatttttatttttttttgagacagggctgga

SEQ ID NO: 175746 - DNA, 253 bp, Homo sapiens
gtaacaaagcctgttccctgggcaggttaaacttgcatgcagcaacccttcaactgaaatgctttcctcatcaacctcttttgatccctaaaatgttgagctgtctctttttgggtttgttttccccaccctccatctgcctctgctgttccctgctttcttccaccattacagtctcagtcagccacagtcagcatccgagaaaaaattatttctgggctgataattttctagtagtcacacccatactcta

SEQ ID NO: 175747 - DNA, 577 bp, Homo sapiens
gagtagctgacaccacaggcacgtaccaccacactaggctaatttttgtatttttagtagagacagggtttcaccaggctggtctcaaactcctgggctcaagtgatccgcccaactcggcctcccaaagtgctgggattataggcatgagccactatgcccatcccatgtaacaaacatttatgcctggaatcttccctcgatcttctttctgcctggcagccaatttgtcattggaagtccatttctcaagcctccctgttgctgctgggcacagtgttcccccagcttattgaacttgcttctgttattggcaacaatccagttatccttgaattatcatccacactagactgaaagcctgctgaggacaggagtctgatgggttcatttttatatttccagtgtccagctcaaggtctggcacagaggacagccaatggctattaattgaatagaatttcttaatcagtaggtatttattaagcttctgttacggacttaattggtgccaggctctttgatatgtaagataaagacctcacacagttgacatcctgagcaaatactctgtgag

SEQ ID NO: 175748 - DNA, 307 bp, Homo sapiens
ataaaaagaaaggagctatcaagtcaccaaaaggcacggcggaatcttaactgtatattactcagtgaaagaagctagtctgcaaaagttacatactatttgattccaactctatgaccttttggaaaaggcaaaaactacagagatagtaaaaaaaaccaaacagttgttgccaggggtttcgggggagggaggaatgaacaggtggagcacaaggaatttttagagcagtgaaactagtttgtatggtgctgtgatggtatatacatgacatgcatttgtcaaaacccaagaactggccaggcac

SEQ ID NO: 175749 - DNA, 371 bp, Homo sapiens
tggcgttgtggaccatccgcctcgtgtagatcggctgtgatttagacttcttggccagaagtgctgtatttcatggctttgaacatccggatgaggccagatgtttggtgtggacagcatggtttttagtcaaatggaagagaatctgtgagcagcagccgtgctacaaagctgcacccggccctgcccatcagttccatgagctgtaaccgccatcggccgtgaactttctgttgtttgaaaatatcgccatggaaacatccctttgtggagcagaatcaagaatgtattttgacgtcttcgagttttacggtgggacgcaggagttgcacattttcctatgttgacagtatcgtggcctgtgtctccta

SEQ ID NO: 175750 - DNA, 462 bp, Homo sapiens
gcaggagacaacccagagtccacgcaggggtacactgacaccatgtgaggttcacgagctccaccccattcaccagactcgacgtgctcacgggaggagtggaaagccaacccccttagcaaaccagcaccccagcacagtctgctccaagttccagaacccctgctcctgtctgcagcactctgctcacacaatcctccaaatgtcagccctgccagaggctgggcgtctgcagcgctccgctcatacaatccttcaaacgtcagccttgccagaggttgggggggtttcatccctgcttaccaggaagtcattcgccctttgaccaccctgtgctagaggttagtgggggtccccgatgctcgtcctcactgcatagcacatgcttgggggcctctcgcaaccttgacctttcttgtaggtctgaggtaccactctgatttggttttgagagaaactgca

SEQ ID NO: 175751 - DNA, 481 bp, Homo sapiens
caaacagtgaggaaatgcaaaaaaagattgtaagaattttagaagagtcccagccacacagggagtcgaggggagtgtagagttccacccacccagccagtcacacacacacacatacactggaagctgggcattctcactctcacgtacacacccaggggcttggcacacacacagatgcaccttctggggcacaacactttatagtttgcaaagggccttctcatttttcatctcattgatactgaggggtggagagtttccctgaatatgacccattctagagctggcaagagatgagagtcccaaatatcttcaagaggccggggctgaacgcatgggctgggctgcctgttttctctgtgtcggtgtcagcagagctgaatggcaatagaaactctggaaaagttttaacccagctctcccagataggccctttcacccttaacaagtcacacctggactcagggacttttttttt

SEQ ID NO: 175752 - DNA, 264 bp, Homo sapiens
tattctagaggatcagggcaggtgctatgatgccaggctgctcaagggatccacctgcctcagcctctcaaagtgctgtgatcacaggtgtgagccaccactcccagcctaatttttgcttttttaggtgactttcttagaaaggaatttcagaagaggacaaagggttataaacattttgtgtatcttggaacatattgtcaattatcattctaatgacttaaactactgccagcagtaaataatggaaccatttttattaca

SEQ ID NO: 175753 - DNA, 513 bp, Homo sapiens
cttggggggcctgggtcaggtgcctgaggccagcctgcatcagaagctggctccgcctctttactgtatgtggccctgggcctcagtttcttcctctatacaatggggacaataacataccagcctcctgggaactggctgggttacaggagagcaagtctttggagctgggccggcaggcatgggggcccaaagagggtcctcagctttggatctggacgcctcttctggagatctcacttccggagcacccgccatctctgcgtggacatcccattgggccacttccctcagggggccccaagctgcagcctcctcctccccccacagccctgcctgccctccctgacccagacgccccgtgctcaagcttcctctgcctggacgctgttgacattggggatgtcccgtgcatggcaggatgctgagctacgcctttggcctttcctgctagatactactgtgacaaccaaaatgtccccgtcagcctcgggatcaacaccgtctgtcctc

SEQ ID NO: 175754 - DNA, 236 bp, Homo sapiens
aggtaagcttagtcagggctgtattccatcccaagcacatgctgtccaccttcccaggagggtatattaaatattattattactaatgataattaataccaatcattcccttgagatctcaggttagtgatacataactaagtctgtgtcatttcaagacatctcccaggtgagggggtggtttaagaaacaaaaggaagtgaactgtgtctggtttcattatgagactgggactt

SEQ ID NO: 175755 - DNA, 950 bp, Homo sapiens
atttcctcccaccccagtgaccacactgtcacctgcgacacttctgataacaggagcgggtaggtgagaggccagcagagggaccaccactctgagacttggatctgagtgtgcaagaaaccctcgacaggcctccctccatccctgctggcctacctggggaggggctcctggcttggggcctgtgaagctaaggctctgtacccaaaggttggcagacaagtcccagtgggcaaagtcctgtcggctgccaggacccccaaggctggcaggtggaacccatccctcctagcagtgccatgcgcaggtctcactgttccacactgatcctgattgaagccacatctcctcatctgcttttgtccctttgaccaagagttgattcactagcccaactaaacatgactgaggaccaggctctggcagtcccacaggggccagacatgaagcccatatttcagtggaggagggatcgtaccagcagctaaacatgcctaccgtagatagcaccagatgctaggaaggaaggaccataatgtactgggagagatgggaaaggagaggccggggacagccctgaggtgacatgtgagtggaaagagcggagtgcaaaggcctcagctatgatgagtcctacagggagagcaattcaggtagaggggttggcaaagacccaagccctacagaaagcaaacaagctggggcagcgaccatcaggggcacatggcagagaggtgggctttgtgtcccaacacagtgggaatcactggagactttgaagcatggtcatattttcaagtcacttgcagctgtgtaggagtggaagtagaagctgagtaccctgcaggtctcggcagctttgatgagaacaaggccgcttagccagggctgggtgcagaagcagtggcaaggatcccccagacctgggagacctcactgccaaccaagca

SEQ ID NO: 175756 - DNA, 397 bp, Homo sapiens
ggtgatagctgactcttgaggatccccagtgacatgtgagtggaaagagcggagtgcaaaggcctcagctatgatgagtcctacagggagagcaattcaggtagaggggttggcaaagacccaagccctacagaaagcaaacaagctggggcagcgaccatcaggggcacatggcagagaggtgggctttgtgtcccaacacagtgggaatcactggagactttgaagcatggtcatattttcaagtcacttgcagctgtgtaggagtggaagtagaagctgagtaccctgcaggtctcggcagctttgatgagaacaaggccgcttagccagggctgggtgcagaagcagtggcaaggatcccccagacctgggagacctcactgccaaccaagca

SEQ ID NO: 175757 - DNA, 567 bp, Homo sapiens
agatgaggagagtgggttggatggaggccaggtggaaagcaccaagatcatttaagaaagaatatgtttgggttttagttttagtttaggagaccagttgtgagatgatggtggtaaaaactcagatagtggcagtagggaaagagactggaggatttattggaaagtcattaaagaagaagagtgaacaggatttgatgattgatttactatggaggtggagagagagggagaagataaggctgatgcttaggtttctgacatggacaagtcagttgattttgtgccattcactgagataagcagtgctgaaggagagcaagttggaggaaaaagatgatcagttcaggtcaacagattgagtttgagacatctggatgtacacctggatgtatatgtctaattagcaaatagttatatgtagtggcgttaggaacaggcaggaaagtaagatggggatagagatttaggagtcattggcacctagagaataactgaagataggacattaacaagatgagtcaggcaaagggactagaagagggctttggccatggctcaaggaac

SEQ ID NO: 175758 - DNA, 298 bp, Homo sapiens
ctagggtgcttctcactgatcatgcctccttgaatctactctgccaccatgattcgcgccccaacacctctcggcctgctttggatgaggagggccagctatgggcctacctcacagctcctcacctcagggtagggtgttctgaatagatccccacatcagacagagctgctagagaggcagaccccatctccctattgtctcataaacacacacactcactcacacactcacacacactcatactcactcacactcacatactcttcatccagctccatctgccgtaagtccgttt

SEQ ID NO: 175759 - DNA, 2225 bp, Homo sapiens
taaatgaaagcaacaggagctgctccggggactgcttttgccagcacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagctatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagttttcatagttacaaaacagctcatgtggaccttcaggataaaagacaggtgaagactgccttagagcaagcagagtggcagccgggaagaggactgtttgatcatgataatctcatgcaaagtacataaaggggtatatatatgtatgtatatatgtatgtatgtttatatgtgtttatatgcatacatatacatatgtgttttatatatatatatgtatatatttttttttttttttgagacaaagcctcactctgtcactgaggctttggtgcaatggcaccctcagggctcactgcagcctcgacttcccaggctcaagtgattctcctacctcagggtcctgagtagctgggatacaggcacatgcatcaaaccccactaatttttaaaaatatttttgtagagacaggttcttgctatatttcccaggctgatcctgaattcctgggctcaaatgatcctcccgcctctgtccctcttttattctctcttcctctctttcacagatgccctctctctgctttctttcattctcttttattctctctctctctccttcctcccccataccacttccttccctcttcctggggccatgtgatctctcccctccatggtaccctctgctcctttgttttctacctgcatatggcttttttgttcattggcttaccttcctcacatggttggtctggaggaccaccactaacagaggcttcattccccaagtatgcatgccctggaagcccatctcccagttactggccttgggctcaggatctccacttcaatcccaggaaagcaaatctggctcactgcaggtctgacatccatgtaagtccagccagctttgaaaaaagtcaagcagggctgcgccttctatgcagtggatgggtctgttctctgacaggggagaggggatagggcggacaccatgagagttttcagtacacatgccacagtgacctctttggccagcttaaaggatttcccattcaatctactcatccactgcccagcttctgtcctttgtcctccgattactagatagaaaagcaaagcaagaaggcaatgccccaaaagaaggccagtcgatgggcattaatacaggattgctgtgaaaatgcctcgagcactgagaatgcacaaaatagatttgtttagctgtattgaaaacaaacagaaaaaaatacagtttgccatattaatttaatatattctgcattctcagtccctaggaaaagatacactatgcaccatcagttttcaattttttatcactgtgtgagggaggcattctaattaatccaaactctatattttcagtgtcttgacatccccatatctccaccaaattagc

SEQ ID NO: 175760 - DNA, 1288 bp, Homo sapiens
taaatgaaagcaacaggagctgctccggggactgcttttgccagcacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagctatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcgggtaggtaactttccaggccccatggaagaaccctaaagcctgtttggaaacgagggtatgagtggattatgttttcagtagctcaaccaagacctcaaatcaaaacaagctatgaacaaattgtctaaaaaatgtctgtcatgggagggctgtggtgaagaacagagaaacatattctaaatgtcctgtgaagtgggaaattctatgaaagctacacggataataaaaagggtgaggaaaagagaggaaatca

SEQ ID NO: 175761 - DNA, 933 bp, Homo sapiens
taaatgaaagcaacaggagctgctccggggactgcttttgccagcacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagctatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagt

SEQ ID NO: 175762 - DNA, 442 bp, Homo sapiens
acataccattatacatggtgcttttaacatgacacagtcaagctattggctcctaatcatactaacaaattattatgcttataagaaaaagagtttctagttaaaaaaaattgtatttattctttttatagacattggatgctttttgttttttcatatgaattggagtaagaaatgcaatgctagaattcatatacaaatctggccaatgcatctggcattacagccatgagtttatgttttctcctaaatacaagtagtttgtatagaaatgtgtcaaaattttatattcaatttatttaacctcgggagaaaccattaccacagttttctttagaatgatgaaaaggtatttgctttaaaagaaaaaatcaatgcttctcttttttttttaggtgttattcgtcatgttggcgatgccttgaaggatcatgcctctaag

SEQ ID NO: 175763 - DNA, 171 bp, Homo sapiens
gttctctctctctctctctctctctctgtctttctgtctctccacctctttctctctctcctgtctccctttgtttcccctcccttctctcttcctctgtccctcttttattctctcttcctctctttcacagatgccctctctctgctttctttcattctcttttattct

SEQ ID NO: 175764 - DNA, 4452 bp, Homo sapiens
  misc_feature (1)..(1): n is a, c, g, or t
ngcccgcggcgaggagccagcgagagcgctcggcgctgggctgtttcccggccgagggaggcgaacttctcatggggaagaagtggagggatgcggcggaaatggagcggggctgctccgaccgcgaggacaacgcggagagccgcagacgcagccggagcgccagccggggcaggtttgccgagtcgtggaaaaggttaagttccaagcaggggtccaccaaacgctcgggactcccgtcgcagcagacgccggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagctatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagtaagtagcggttgttcccactggcatggctcgtaggaggtatgctgaaagtgaataactttaagtacaccatgcagcaatgtaataaaaacttgagcaagttttaaacatgaaccattatttctaccgggccagagcttagaatgagaggaagccatccagaggagaacaattggaggcgtaagaagtaattacacaattagtgactccagcttatgtatcatgtgtgaaaaattcaactccatctggggtatgtgtatgcagataagctttctcttcagacttttccttcatcatctgcatggtactccaaggagaaaagtttctatttattaagctctttttggtggctaaacagaaaagcaaaagaatcagattttgatcttagcaccgatctggctgtgcaaaggcatttcaaagaaattgaacattcactctctaagctaaagcatcatgtgaaaatgtttctatttattaagctttttttggtggctaaacagaaatgtttctatttattaagagacaatgtttctatttattaagctttttttggtggctaaacagaaaagcaaaagaatcagattttgaacttagcaacgatctagctgtgcaaaggcatttcaaagaaattgaacattcactctctaagctaaagcatcatgtgaaactatcttcatgaaattttaattgtctgaattttaagtatgtactcattgtctctagatacatatggatttagatatagatagatgtatatgtgaaccacatagtacatagttacgctaatattatctcttaagcgcataggaatctctatttgctgtatttattgtgtaaacatttgttttaactgtgaaaggtagcatcatcaaaacagcaatgctccccagatcactaagtggcttgcatttaaatgcaatttaggtatgaaagcaatctaccgtcccgcctcacaaaataaaattctatttgtttttataaagtaacaggtgaggatgcatggcaagctcaaactttgtggtaattagatgtcccatcagggaaactttgatctaattgattgaaattccaaagtctacagttccaaagaacaaaagattccctttggctagatgagttttcagaggttctatgtactgtgattcaacttttccaaatgacttttcccttctctagatttttctctgcacctgtcccaaatgggtcttcattgccatcgccaccttcctccaaaaacagggatgttagatttatcagaccacagcttctccttcctacactctcttttctggtcccaccttttagggactgctactgtttaagtgtcatgtttcatggtttcatatttttcacagtgaaacctgaaataataaattttgtcctaggtctgaaataaaaattatattacgaaatttccttcccaaactgtctttggaaagaagaaacacaagtgttattatcccaaggtgaacatcttctggaaacaaaaagagtagaaaagactagaaaatatacagagaccagcagagatcaaatgtaacaaagcactgtgatcaatgggtggtaggttttactgtaaatactaaaattgagttccattacagtacttgatagaatgggcaaatgttatgtaatcagtgttatctatttaggtttttataagctgcagcatgactttctgtacaccatcaagttaagaacgagagcttaaataggactgagctagaagctgaagaggataagagcaaggaaacaaggaataaattcagggtcaagttcagtacttggtaataagacaaaatcggtccagagaggcaaagcatgtcattgtggcaggccctggtggcagctgggctggttagccagtagtgtgggtagcaggcctagggatgtgttcgtgtaagttacacacccagcaaaggggatgggagctggagttaaaaccccagccagagcctaggttttagtcaaactttggcaccttccagaatgcctagaggaagggggttcctttttctaattgatcatcccagagggagtacccttttgcaatgtacgtgcctgaaggggtgactttcttcagaaatgggagagctgctgcatatatggatggcactgcaggggaagtccagggaggctcatggacagtggcctggcctccctgaggagcagaggccaacagcacgcagctgaagagcagggcacggtggatggtcagcatgtcaggaatgctggaggagtcaccacccgatactagtccttgggtagatcatcagggacacatcacattccatttatggaaacaccaaacctttgctagattatcaaggcaggtagtggcacatgggcacttgacaagcaggggcccgtcaggagtctagagtacaaaggaggggagaggcacggatccaggtaccacgggacttacttttgggactgtatttgtggcttcatagagacccacaggctcctcttccagtgaatatattaataattaaatggtaagaggagagttataaaagcccaagagaaattctgaagtcacaggaagtaaaaaggcccaaggtaaggaatttgtgcatgagctgtagtgaatgtcaagagttagctcctatagcagttctacccctgaacttaatagtggtagggtgaccaacttgtctcagtttgcctgggactttgttaggtttagccgtgaaagtcccaaatccctgggccccctcagtctgggcaaactgagataatgggtcgccctacaagagagtgactcataagtcattaggtcaacttccctcattactgtactcagcccccaaagtcggatggagcagcaagctccttagagggtagggagtgacccaggctctttgaagtaggtaaagcaggacctttgaggtctccattcaattaacagcaaaaaatgctcactgagaacacaaaggcctctagaacagcactgacaaagacacaaagacaggcaaaaagcggacctggtcttaacatgaaaaacggcagaagaatacaaacctttaatgcaatcctcagtcagcaatttagaacagcaaatctactttctaacatggacactttgtggttcttccttttaaaaataaaattttatggccgggcacagtggctcacacctgtaatcccagcactttgggaggccgaggcaggtggatcacgatgtcaggagttcgagaccagcctggccaacatggtgaaaccccgtctctactaaaaatacaaaaattagctgggcatggtggcgggtgcctgtaatcccagctactcgggagactgaggcaggagaattgtttgaaccctggaggcggaagttgcagtgagccgagaccatgccattgcactccagcctgggcgacagagcaggactccatctca

SEQ ID NO: 175765 - DNA, 770 bp, Homo sapiens
taaatgaaagcaacaggagctgctccggggactgcttttgccagcacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagctatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgtaagtcctgagtgctgtcgctttccatgacttctcctagaggggatatcagaaaagtataataaaattagtattcaaaatg

SEQ ID NO: 175766 - DNA, 476 bp, Homo sapiens
ctcccgtagacgttcaggggagcctgcattccccgtgagaaacgctgagagaggaccacgggtgtgtcgagccttgaaggagggaaaaggcggtgtaggaccggagcgagtggttgcctggggagcatcttgttggggagacagtgaacagatgagcttgactgaattgcaggactcccctgagggagtaatgtggataatgtacaccgcgcgatcacttagtctggagaggctccccgcgggttttcctcccctggaccatcatttgtagcaataaaggggttccccagccgataggaggggcttggaatgcaggaggcttgtgatgcggctccaaacagtctgcaaaactacaaagcacagataatacacaatggagaaagccgatttcatggtagacccccgaagatcattttgaaaataactctccatttaatttgctgcccttacccccctttttttaacttactgctttt

SEQ ID NO: 175767 - DNA, 305 bp, Homo sapiens
ctcccgtagacgttcaggggagcctgcattccccgtgagaaacgctgagagaggaccacgggtgtgtcgagccttgaaggagggaaaaggcggtgtaggaccggagcgagtggttgcctggggagcatcttgttggggagacagtgaacagatgagcttgactgaattgcaggactcccctgagggagtaatgtggataatgtacaccgcgcgccacaccaagcgccccacaaagcgccacgcaaagacacccgccgacccacacgaagagccaccctaagtgtccggtaccgagctcgatcatc

SEQ ID NO: 175768 - DNA, 335 bp, Homo sapiens
catggggaaaatgcagtgaatataggctttgccataggtaagacgttgcagttaggaaagtggaagtgacttagggtggagaaatgggaagagaaattggtttagtgtgtggagagaggaggcagtaagacttaactcttcccaggggtagacattaaatggctcatatttctggtcactgactgagttattttgtacctggacaacttcagaagtcagcatgtcagaatgcataaatgaagagggccatatgatgtgactctatctgacacagttttatctatttattttgaaaatggtgccaggtgtggtggctcacgcttgtaatcgcagca

SEQ ID NO: 175769 - DNA, 514 bp, Homo sapiens
ctgatcccaccagtggcagagccaagagcaggagccttcgcactgcgggtccacagctgccattgctccatcagcctccccagccctggtccctgccctacactgcagagtcctgggcacatgccccccggcacctggagcctcctctccttgcaaagttctcttggcctgcttgtggccaatttggtcatactcaggtgtaaatgactacggcaccttcaagagtcctttccggtgggcacctgcatataaagggaatccagaattttaaggaagaggcaggcacatgcctgggagcgggagaaagaggcagaggggttctcaggaccctcagggcctcagagatctgaccacagaggcaaggaccacccaggccaccaggtgaagctcatctgccataccatctacaagcctgatgatgacgatgatgatgatgatggtaactcacatttatttagcttgatctttacactttggatccaagaaccggtgactcaggcactaagtgggaaag

SEQ ID NO: 175770 - DNA, 103 bp, Homo sapiens
ggactcccccatcatcccccttcctaatcactctgtgttcccaagggtaaccacttccagaaattcacttagcctgtttaataaattgcataaagttagaatc

SEQ ID NO: 175771 - DNA, 473 bp, Homo sapiens
caatagagcaagttgaacaaagagaagggacattcattgattgcagagattactagcttctacccaatatctatctatctctttttcctgatgattagaacatcattttatcctgctaggcaatatttctagctaaagggctacatttcccagactcccttgtagctagcaatgaataatgggatataaatacaagtttacagggtttcttggaaggagttctgactcaactaggagacacaaccaagttcctctatttttctgcctggaatgtggacttgatggctggagtgccagcagctattttgtgtcataaagcaaacttgagatagaaaccaactataaagtatggtagagcagaaagttaagaagagcttgcatcctgacaactgtgaagctgctatatcagccctggagagccacccttctggcttctttcacatgccaaataaataaatgtcagatttaaacta

SEQ ID NO: 175772 - DNA, 780 bp, Homo sapiens
ttggataagttatttaacctggcttttgggtgcttctgctgtgaaagaaggggattaggttaaataattttctctgttttctactagctcaataaattatctgattctgtaccaagattacaagttaagaccaacttctttgtctggtcatctataacctattgttacaaatgaaataagaaagtatggatagaaagtattcgcttgcactgggctctttgttattttaaatatttgaaaaacttacaccaggcgactaacttttgccatggtaaagtgtatgtgtgtgtgctcaattttaagggctgagactgttcccagaaggcctgtgctggtcacaaacaaaatggaacactcaaggaccaagcactaaaaatatctcataaaaatgcttcctccatgcagtcattgaatcaggtaattactgtggcaacaacaaactaatttgaagtgttagctgttaattaaaacattgcagaggtgtatagttgttttttggtgtaagcagagcctccattcaaacttcattaatcactttacaattaatgtgttgaggaaggtcaagacaattgagatgtagtatctgttgaaagtaaacaaattccttttctctaagtaaataccatttggaaagttaagggacacactcgactcatgcctggcattgcctttgtcatccagttctccttgatgattaaatgttaaattggtactgtcattgcactgtaaaccaaaccacatagcatctttattcctcgaaatcgaacccaaacttccacg

SEQ ID NO: 175773 - DNA, 369 bp, Homo sapiens
cctagctgagaaaagtggcagcaaaatcagggctctaactggattgttcaaatggagcacataatcggagagtaaactgaggaacatcccctgacagagacataaacttgaatttaaaataatcaaaacttttctaaggaaaagtagaagttacctctgtcctaatctgattaaactctaataaaacaagggaaaaaacactaagaggagcagccagaacaaatccccacaggtattctccagttagcaaaggagacagtgcacaaatgaaatcttcagaaaaaaagatttggaaagaaatctgcatggcttttaaactcattgtccgaacttagagaatgcctcttcatcctggaaatcagaaccctc

SEQ ID NO: 175774 - DNA, 456 bp, Homo sapiens
taaagaaatacaagttaagcaattaccagttagcttttcattaggtgtcaacaacactcttagtgtcactgtaaatggttgtcaattcaattcacacccctaatgtttgtattcctttacttatggtaacatgtcaaagaaatcattcaaaggggaaaataacttatttgaatgtagcgtttcatatggaaaacctgtaagtaatccaaatgctcacaactggaaaaatggctaaccaggaaatagtatgtcgatttcgtgaaacaacagaaccccattagaaaaagccatgggcagaatttcaatgaaaagagctatggctggcatggtggctcctgcctataatcccagcactttgggaggctgaggcaggaggactgcttgagcccaggagtttgaaacccacctggacaacatagggagaccctgtctctatttaaaaaaaagaagaagaac

SEQ ID NO: 175775 - DNA, 209 bp, Homo sapiens
gggtttcaggaaaaactgatgagaattgtttgtttagactgtcagtctctctgtgcctcagtttcttttttctagaatgaaggggcaatcaccagagtgtcttgaaggtcccattcagtattccattttccctacattccctgttatgttatgttatgttatgttgtgttgtgttgtgttgtgttgtgttgtgttgtgttatgttatgt

SEQ ID NO: 175776 - DNA, 462 bp, Homo sapiens
tttgatggggcttaacttgaaagggagcccttgtctgatcaaatgacatcagacagaagggagccagtgagtgtggaaattactaataaaaatgaagaaacgtgtcttcacccttttgtgccaatttctcaaaataccacagattgagtaatttataaaaaagagaaatttaggccaggcccagtggcttatgcctgtaatcccagcattttgagagtctgaggcaggcggatcacctgaggtcaggagtttgagaccatcctggccaacatggtgaatctctactaaatatacaaaaacttagccaggcatggtgtcatgcgcctgtagtcctaggtacttgggaggctgaggccaggcatgagaaccacttgaacccaggagtcagcggttgcagtgagccaagatggcaccactgcatgccagcctggatgacagagtgagactttgcctcaaagcaaa

SEQ ID NO: 175777 - DNA, 610 bp, Homo sapiens
tttaaaaaaaattgtgagtgtcactgtcaaaagctgctagggagttagttaaaataagagcaggaaggtttcaagtgaatgtagtatcacagaattaatttctgatcttgacaagagaagtctcagctgagtggaagaaaattattccaaatgaatactactgagggaagcatgtgaggtgaggaaatagaaagtgatactataggcaactcttccaagaaatttaatttagacaacattttcaataaatttaaaaacacatttattttcaatagagacaggagtcttactgtgttgcccaggctgatctggaacccctggcctcgggcggtcttcccacctcggccttccaaagtattgagattacaggtgtgagccactggaccccgccccaagaagtttaatggtgaggagaaacagagaaataggtcattagcttcaagatcatgtgaagttaagaaggatttcgaggaatgaggtgggggtggggattgttttcaagagaagcagatacttgaggatattttcgggggatgaaaatgatccagtagagagggaaaaatgacagtagatagttctgattttagttatttaaggaacacacagaaga

SEQ ID NO: 175778 - DNA, 590 bp, Homo sapiens
agctctgtcttacttgctgttttctcgtcaccttctttgtgacaaaagtaactgtttaaggtgtctgaggagctccacaaaggtgtcttaagagacactgcaaagaaacaagagtctagctccatcgcccaagctggagtgcaatggtataatcatagctcactgcagcctcaaccctctgggctcaagcaatcctcctgtctcagcctcccaagtagctagaactacagagaggaaaaaagaactggaattggaaggacagtgagattgaagggtagcaagagaggctggagaagagaatgaagagactgcttacccgatttgaaatcagtgagatgttccttgggctggtctgaggacctgaggtcataggtggatctcctcacggagtgagggcgaagacaggggaccggtctcccgaaggagtccttctgtcccaggtctttggcaccaaatgttacacgtgtccgtgtgaagaggctttgtgtgagcaataaagctttttaatcacctgggtgcaggtggactgagtccaaaaaaggagtcagcaaagggagataggagtgggacagttttgtaggatttgggta

SEQ ID NO: 175779 - DNA, 561 bp, Homo sapiens
  misc_feature (19)..(19): n is a, c, g, or t
  misc_feature (26)..(26): n is a, c, g, or t
  misc_feature (29)..(30): n is a, c, g, or t
ggtgagtggtgggcaagtnagcgaanctnnctgtgcggcctggttcctaacagtccgtggacaggtattggtccatggcccagggatcagggacccctgttctaggtaatcagccatgtcatctatgagccaagttctttcctcctcttccctgcatccagaaaatcagcttcatcctaaggtggattctttttgagtacgctcatagggcactggatagtggaaatgtgggatacatgttacttcactgacatcctcaaaaaagaaatgttcccagaaatctttacctcattgtaccattgacctgaattaagacacatgacattccatgcagactagttttggccaaggattctgatcactagcaaagagtatgggactatcgtgattggtttagactgctcaggggacatccctagagtgaagtcggatgtgtgggagatggacagaacagagggggatggaaaaaagagaaattgagaataattcctaagttttggagtcaaataaatggatagatattgaagctatatgagaagtcttggaggaaagacccgttag

SEQ ID NO: 175780 - DNA, 337 bp, Homo sapiens
ttttagatttaaaaaaagagcgatactttctgacttctcagctaagatttttatagtggtagtggttgttgatatttggtgtgtaaaacctctttatgctgctttagctatatattttttaagctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcatgtattta

SEQ ID NO: 175781 - DNA, 633 bp, Homo sapiens
aggttcaagcgattctcctgccccagcctcctgagtagctgggattacagatgctgtgaaacatacgctaatttttcatatttttagtagagacgggttttcaccacgttagccaggctggtctcaatctcttgacctcgtgatccacccacttcggcctcccaaagtgctgagattacaggcatgagccaccatgcctggaaaatccagaaattctttttttttttctttgagacagagtcttgctctgtcagccaggctggagtgcagtggcatgatctcggctcactgcaacctccgtctcctgggctcaagcgattctcctgccttagcctcccaagtagctgggattacaggcgtgtgtcaccatgcccggctaatttttgtatttttagtagagatggggtttcgccatgctggccagggtggtctcaaactccttacctcaggtaatccacccacctcggcctcccaaagtgctgggattatacgtgtgagccaccgcgcctggtgggaaaaggcatttcaaacagaagaaacaatatacaaaagcagaggtgtacaaaagcaatgtgcacttggcacactggaatcattctgtatggctagatcatgtggtttggagggcttgtg

SEQ ID NO: 175782 - DNA, 903 bp, Homo sapiens
  misc_feature (14)..(14): n is a, c, g, or t
  misc_feature (27)..(28): n is a, c, g, or t
gttacggctaggtncgaggctgggtgnngaaaaagttctggagacacctggttgggagcaggctaaggaaacaaatggggaggaattagccacaaatcctcaaatagacagctactcaaaggcatcttcacggacaatttccaagcattggatgcagtggtgcattcttgcattgggcagtgattgtgtgcacacatctctttaagggagagtggaaatggggtgaggaggaaaatgggagtaggatagagtgtagcgttgacatttattttctttaaaggaagacccgagcatacctgagagctcagtgaagaaagtagttctggcgaatcggattaatatggtatgatcagcctttagcaagattctatcacttttcccactgatgatgtgagacggtgtccgcgtgtgtaagtgcacacacgtgtgtgtgtgtgttgcatcttctgagtatttttcaaggagaagctttttagtgatctgaaaaagtcaattcagttagccactagagttcaatcaaaaacttcggaagagtgcatcatcttaaagtacataagagagaatcatgacctccagctcagaattcaagaataggcaggtttgtgaaatagtaagctcagaaagttgagggccagtgaactcctatttcaagttcttgcgggtgtttgtacttttttcccagcaccactgaaacttgaccttcggcggcgcggtggctcacgcctgtaatcccagcacttgggaggccgagatgggcggatcacgaggtcagaagatcgagaccatcctggctaacacggtgaaaccccgtctctactaaaaatacaaaaaaattagccgagcgtggtggcgggctcctgtagtcccagctacttgggaggctgaggcaggagaatggcgtga

SEQ ID NO: 175783 - DNA, 517 bp, Homo sapiens
cctcagtgtgtgtatgtgtactctagcgttgtcccacgatgagaccccgagccatggttcctcaggatgcatccacatcattaggcagcacatgactattttagtatatcatgattttgttttcattcatctcaaataatttactaatttcccttccatcacctgttggttgtttaatttgtaaacacttcagtttgccgtgttgctagcttccctctgctgtggttggaggagacacctgctgtggatccatctctctaggcttgttgagggctgcctcccagtccgtggcccatctcccagcctgtggcccatggaggcatctggtacagaggagaatgggctcctgcggttgtaggtggagctctctgcactggtctcctgggccatgggtttatagtgctgtgcaggctgcctgttcctgtttctgtatggatcctctgcttagctgttctgttcattttgacacgtttgctagcctttaaatgtggtcagcaggtattacgcagtcttggtt

SEQ ID NO: 175784 - DNA, 276 bp, Homo sapiens
ttaaagtgcacttaagcagactttgtggatgaaatcattttgtctggatacttcatgtgaaatgtgtaatgtatcgcttgggtgaagggcaaagctcaggagttgtggctgcttatgatgctcagacacatgccaggaatacttttggagtgtccttggataatagccagacctgtctccaagtgtcttgtctgtgggcaaggaagccttgctcagaccctaaaatattcattgttacatgcgtacctccctttaagcaatgaatgaatgtttgag

SEQ ID NO: 175785 - DNA, 508 bp, Homo sapiens
ccgcgtccgagagacttagcagggcgtcaaactggagagcggaaggatggaaccttttattctcaggtggagaggattaagctttgcggtgttagcagaaaatgatcgagctccagaaaatgatttggaggtcagattcgattttaaagtagtactaacaggccgggcgcggtgcctcacgcctgtaatcctagcactttgggaggccgaggtgggcggatcacctgaggttaggagttcgagaccagcctgaccaacatggtgaaaccccgtctctactaaaaatacaaatattagccgggcgtggtggcgggcgtttgtaatcccaattacttgggaggctgaggcaggagaatcgcttgaaccctgcaggcggaggttgcagtgagccgaaatcgcgccactgcactccagcctgggtgacaggacgagactttgtcgcgaaaaataaaataaaacggtaccaatggtattacgatgtgtcacttggcctgtggaagagagagac

SEQ ID NO: 175786 - DNA, 142 bp, Homo sapiens
ctaagattctgggccatttgttactggagaataacttatcctgcacagaatgatacagatcagggttcgaatgactcgatccagttcctactgtattggccactcagctaggtgtcggtacagagagatgatgaagacagga

SEQ ID NO: 175787 - DNA, 751 bp, Homo sapiens
ctggaatctgtggtcattacacccgtataaataattttggcctcactccacattgtccctcctcttgtaactgtcattagatctattcccatatgtattttccatttttctgccaaaatatattaaagattctgtaattgctttgcaattccttctttgttagatttttaactctccagagatctggcaatttgagtgtagcaatgagtatggaagtaattaaatggtgggagaggttgttgaaaaggatcatctcattgagaagaggactacctcaagtgaagggacactgatttcctcagacaaggtagaaaaaggctgttgcttccaggaaggaaggtttggtgggatttggaggcacagctgggacatgtctcaaagccttgccttccttagtcactggtttttcaaacaactacaagtgtgtactgttatgccatgtactgccctggttttccagtgttctattttgcactggcactgaggtcattactgctttcagatcagagaattaatctcagtttccatgttttatgggatttttttttcctctagagtcatttttttgtatcaggattgagcttataaaacaaccacttttaaatatttcaggattaaagggattaatactagatttagagtttacatgaatgttgggagaactaggagactggatagtaatctggtgaaggccaagagatctataatagaaagtcatctgaagcaccaaagttggtggcttaggaaactg

SEQ ID NO: 175788 - DNA, 280 bp, Homo sapiens
gccaggctcattgaggccaggcattgccttttgttcaagcatctcagagtagtttagaaaataaaatgcatttctctgacaaccttgtgaggttttctgggcattattacccgaagctcggggctttgcaattcccatttctcagcaatctaaggataaagaaggagaaatcaaccaaccctcactgtcctagggacccctcgtgtttcctggccaccttcagatttatgtatttgtttatccccactatgtgcctctcagtagctattcaatcagtaat

SEQ ID NO: 175789 - DNA, 397 bp, Homo sapiens
tcaaataagtcacattgtttatgttggttctgcattaaaacacaagaagcacctcttttgtcctgtcatcttttgaaaaagtggttaatgagcacctatgtactgtgtaagaaagggttaaatgcttaaagttactttgagttaagtagtcaggaagcaaacacttggttaccagaagttagaatggagaaagcaactttctgtgcagtctgatacaataggaggtacctttcctttttggactatccgagacctaatcttgtcttaccgtaggtaaaaaaaaagcctttcctttttatgttttgtaagtatttgctgtaagttgttggtttgtggtagccagactaacaaagaattttgggaaaaaagtattcaggtgctagaataatacctggtg

SEQ ID NO: 175790 - DNA, 363 bp, Homo sapiens
atcacccagttctgctataatgttcattttgaaaatgagaatttgtttcattgccataaatacataaacgaacaatttgggcataacacaaactttgcctttccttatgtgtgattttgtttacaagaaacaccaggtaacacagagaactgcatccagttgaatcaagctgcacaggaatacacaaagcatacacacgcacacaccccaaacatctacagctaccccagttcaccacaggatcatgttaggagccaggcctatccacatctgctgttacaactgtccagcaaacgttttttttttgtttttgagttttgctcgttgcccaggctggagtgcaatggtgcgatcttggctcac

SEQ ID NO: 175791 - DNA, 431 bp, Homo sapiens
ccaaaaaaaaaaaaaaaaaaaaaagtctggatcaatgtacacacttttcatagcagcttctgaaagagcctgtttcttgttactgttatgatataggctgtgtctttatcagttgcaactatactttctcttgccttaggctaattccagggtcccctgggtttgggagcctatgacaccttcattagttaaataggaacatgtggggttagggttagagcatctgaatcagtgatggctaatttgaagtagaagagtgacttattttaattcagtatttattgaacagtggtgttctaggaacttttgggctgtgtcagtgaataagacaacaatccctacccacatggagctaatattctaaagaggggagacaggcaaccaatcagtaaattgtctagtatgttgaaaggtggtgctaagtgttatgg

SEQ ID NO: 175792 - DNA, 502 bp, Homo sapiens
ttgagacagagttttaccccatcccccaagatggttggagtacagtggtgagattatagctcactgcagccccaaacttctgggctcaagtaatcttactgcctcagcctcctgagtagctagtactacaggaatgtgctaccacatccccgctaatttttgttgttgttgttgttaattttttgtagagacagggtctcactttgttgaccaaactgatctcgagctcctgggctgaagcagtcctccagcctcagcctctcaaagtgctgggattatagccatgagtccctgtgcctggcctatagactttctgtttcctgccgctattggtgattgggctgaatggactagacttccttttggaaattttttatgtgcctttgtaagtatttgagcactaattctggttggtaccctactaagcattaatccactcagacatttgagtgcctctaatgttccagtctctacagaatgcagtgaagaatatgatatacct

SEQ ID NO: 175793 - DNA, 110 bp, Homo sapiens
ggacacggaaaatgagcgttcagataggtaaagggaaaaccagagactagtgtgacatgacagcatagttaagataacatattgagaagaaaaaagtcacaatgttaaat

SEQ ID NO: 175794 - DNA, 268 bp, Homo sapiens
atacagagtaggaatttccacttgagatttcacaactttgaatggatgctgtttctaatgccagttctgtgatgcttaaactagcaaaaccaaactgttcccaccagaacggtgaattcctgagggaggaaagttggagggacaaataaccggacacccagcccttgcctttcctcctgaaccacatcctatcccgagtgtcccgcccacagcccaccgaaactgatcctcgagaccaagggtcttttctagcctgatacaaggcctg

SEQ ID NO: 175795 - DNA, 411 bp, Homo sapiens
caagtagctgagaccacaggcatgcactaccatgcctggctaattttttatttttatttttgtacagattgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgtttttttttccaattatgtttttgtggtaggcactgttgctgttcacccag

SEQ ID NO: 175796 - DNA, 1077 bp, Homo sapiens
agcgtgcactgggcgctcctcggcgcgtctgcccggcccgtctcggctttccttctccttcctctagtcccagcgtcacaactccgccgacctcctctgccctgagagcgcgtccggtgcgggcggagtcggacggactctggcttcacgcctcggcgcgggcacaccttctcccgggcactgaggcccagttattaggggaggcagagtccttctggagtttgacccttggattccatccagagcagcctccaaaatgacacctttgaagttgtgtatcgagctgggggatgtaaagggaggagaagaaagaagatgaagagataccagccagccttaaggagtggacatcctgcctggtgaaactgaacaagacacctaccgcatatggagtttcgctctgtcgcccaggctggagtgcagtggtgccatctcggctcaccgcaacctccacctccaggttcaagtgattctcctgcctcagcctctcaagtagctgggattacaggagccctctcccaccgctcctacactgctggtaaaaggcagccgcactgcctgctggaagacctgccagcttgggcttcagagcacttctgcctcagatccacgacgatcccttctgtcatcgtgggacctttcctgggatttgatttagggcgacgcttcctcctgtctgtgtcctgagtcctgccttccctggctggtcctctttgcttagtcacccagatcattcccagacagctgcgccctggatatggctcctctcatgtgctgcctggaaatgtctcctctcttctcacctgctgagaggtccttctgggcagggactcgggcagattcattcctgcctgccccacatttccctagcccagggcctggcccgttgcagtgctgaaggatgattctggtaagaaacaaggtactccagctcacatcttgcaatgattatgcctcccccactctcccttctccttgcagttctctctcttcactgatgattttggatgcaatttaaaataaaaatattgattaaaaatggaaactatataaataaaaataaaaacacttaacatc

SEQ ID NO: 175797 - DNA, 258 bp, Homo sapiens
ggatctcctactatgtgatagaatgatggaacactctggaggtgctttgaagaccaaatgcccacaaggataactaaagcagcttttgctgtcttcttgaatcccaggattctagtttctccgaccaatgccagaggtgaacttatggtcttaagctcattcacaccctggtttaaccagctcagatttttccaatattggttagcacacatctctccttaaagttacatgctttccttcatgataagtttcatattt

SEQ ID NO: 175798 - DNA, 398 bp, Homo sapiens
agaggagaggaaacacctacagtaggtgaagaggggttggaatctggaaattagatgctggaatttgtgaagttattgtggctgtatccatttcctcttctggtgatggaaggagacctcacccagctaggtgaatttagtggacacatgcatgccttggaaaaggaaaaggaaatggttcaggtttctagagctcaacacaaggcttagatgcagaaaatgtacaggtagagagctcatctaagggaactgtggcagtagataatgaggtcctagccataggggatactctaaagctgggggttccaggaatatcttgaccctcctggaattccacaagtgtgatttgctcctctagtgcaatgttcctttttccttttgctgctcctattttggtg

SEQ ID NO: 175799 - DNA, 582 bp, Homo sapiens
cctggtgggaggatcatggccgttttagtcgttagtgctactgtaacaaaataccgcaggctggggggcttgcaagcaacagaggttcatttatgcagttctgcacgctggcaagtcggagatcaagagcatcagccgatttggtgcctggtgagggttttgaatcagccgattcggtaactcgtgagggttttgaaggtgtcctgcaaatcgctggaggacaatagtaagaacagcctgggccccaccttgacccgaggctggcgtcggaggcaccgccgctcacagtggcagcaccatctcgcattcccacccgcaatgactgagattcctgttgctccacgtcctcacctgcaatgactgagattcctgttgctccacgtcctcacctgcaatgactgaggttcctgttcctctacgtcctcacctgcaatgactgaggttcctgttcctctacgtcctcacctgcaatgactgaggttcctgctccacgtcctcacctgcaatgactgaggttcctgctccacgtcctcacctgcaatgactgaggttcctgctccacgtcctcacctgcaatgactg

SEQ ID NO: 175800 - DNA, 175 bp, Homo sapiens
aatcctcccccagtttccccaacatgtcggcccgactccctctaatcctccgaaggtgccagggcttccacctctgtgcccttagaagagaggcaggacagcacacgcagtatgtcccccacccgtccgtggtaatatttatttaacacctttactaaatcagcttgacattaaa

SEQ ID NO: 175801 - DNA, 327 bp, Homo sapiens
ggaggacccacgaggactcacccggatgggagggacggccgggaggtggaaaaacacaaccgtgagcggtgactcaggcggtttgccccgcctcgcacataaatgcagggtacctttccttcccgttattgcccttgggtgtctggctgcttaggatgcccatttgccagatggggagagtgaggcctgtagaaggtgccctactttgccgtactcaaacccaccattagtggttaaatccagggaccgcctcaaggttttctgatgagcctagtggggcctaagtgccttaaatgggccttgtaataataaacgaggtcctacagg

SEQ ID NO: 175802 - DNA, 487 bp, Homo sapiens
ccagcaagcagaaagcgccatgggactaggtcttgagagaacttgatgggaattgaaagtctttggctctatagattctctgattcagtcagcccaccttgattggttttggcacatcccccacccgcaagctggcttagatattcatggaccttagtacagaatccaaatgtcctctgtatctccaagtcagatcttccttgtctttacagcaggagtgcctgtcaaccatgtcattcagctaggcctcactggctcttcctcacacagccctcataagacatgagcaccacactagacacttggggatggcggttggagagtagtatcacggagctcacaatcgaattgtccagtgtgtagtcttaaaggcagatgcagacagaaagagctgagcgatggcccagaactgtgtccacacctggaaaatgcctttggtgttgttatatcacaacatggaaatacagttatttagtaggaggcagga

SEQ ID NO: 175803 - DNA, 301 bp, Homo sapiens
ggtagcgattgttatttagatgcaaagatgatgaaaacaggaatttaaaattcagtctctaaaatggtataaacatttatagatcaagttggattccgatttgcctcaaacttgggggcattaagaactgccaaatgggtatcataaaatttagtccacattgaatgtatcattcttaaagttgtctgccaaaggacaaagtgtaaaaaaagaggggaaaatattaattagctaacatcctgtttacatttttgttgtcagttttagtcatttgcttcactaaattctgctgtttcattgg

SEQ ID NO: 175804 - DNA, 372 bp, Homo sapiens
aaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaaattgtaagaggatccttgtcaccccagccaggtatccccaagg

SEQ ID NO: 175805 - DNA, 251 bp, Homo sapiens
gtacgctgctttctgatttttcttaagaaagcagacagcagaacactttttaaagttaattttaaatgggtatttttaaaatggtagtacattctcacagagttcaaattataaaaggatacagtgtaaattctcactctcaccccgcctcccaactattagacttgaacctcagccttactccacaagcaattctccacttttattagtgtctcgtgtatccttccagacatacttgaacaaatattcat

SEQ ID NO: 175806 - DNA, 510 bp, Homo sapiens
aaccaaccatagatttaaaatatttgagggatcctggcatggtggcacacaactgtaatgtcagcactttgggaggctaaagcaggaggatcacttaagcccgggagttcgagaccacccagggcaatgaagtgagtccctgtctctacaaaaaaaaaataaaaattaacgaggcacagtggcttgtgcctgtagtcccacctacttgggaggctgaggtaggaggatctgtggatctcataagttcaaggttgcaataagttacaaacatgccactacactccagcctaggtgacagagcaacactgtataaaaaaagaaaaaaaatatctgggggagaaaagttcaatgaagttccaaaaagtaaaacttgaatttgccatgtacagagtactacattgaattcatgtgaatgaagttatgtgtaggcattctattaggtattataagtaacccagagattatttaaagtgaatatacatatgttacatgcaaatatatatgcaatat

SEQ ID NO: 175807 - DNA, 397 bp, Homo sapiens
attaagaggtgcacttccaaatacattgtgcactgttactttaataattatttatcaaagtctgtaatacgagttgtgttgttttggtcaactctatgctgcaatgataaaacaagctttctaaccaagttaatgcttcttaaggtagaagggaaaaacatttcacaatattcacatttctaatgcagagatacacattaaggaaataaaagattgcagatattaaaaaaaaaatactacattagggccaagcactagtggtaaatgcatactaaattgtgatttataattctattggatacagatacttttacatcttttttttttttttttttttttttttttttttttttttttttttttgtgtgttttttttttttatttttttttttatttt

SEQ ID NO: 175808 - DNA, 465 bp, Homo sapiens
ttttgcagtgtgactgaaagaacaggcatcatctagtaggggccatcctacctggagaggcaacgcacaccaaagacaaactaaatggcatcaggatcacatatccaaaatgactgtgatgatatctccaaatctgctgtcaatatcttccctggtaacatatctttcaaaaacccaatacatacctatcatccaattttcccttcttgtggcatggtatttttcaataatccaatgcatacctatagtccaattttcccttgctgtggcatagtatttttcaagaacccaacacatacctattgtccaattctcccctgctgtggcacagtatgcatagtatacaagaaaattaccaaatactagttatagtataccttcacaaaatcaaaactgaaattatcatcccatttccaggaattcgcaggagggatgggggagtgtcctcttagtggtcactttata

SEQ ID NO: 175809 - DNA, 642 bp, Homo sapiens
aggtgacggtgccctgtcagcgctggatgcttactaggggtggggtcctgcttgagatcctgagttagctgcaggagatgggtccagcatgcagttgggcatcagaaagtcttggttcctccaggctcctgactgtccctatcaacccagatgtcctagcctcataggctttggcgagttaccttgcagttctaaagcttctgtttggtcatcttttaaatgatgataataactacttttcagggtgaaaagcttaaagtatgtgaaagtatctagcaaatagatggcgctttataattaggtgactaaaaacagcaatttgtaaaaaccccaaataagataaccttatccgaaagaggggctcaaaaaactgacatttgtgtgtgaatgacattgcataggacatactgtcctttaatccttaacaacctcattttacagatacagagataccaggaagttcccagggtcacaacacctggaaacaatggagttgagcttcaagtcttctgattggaaacttgtgttccttttacaatatactaccaatacaccaatatagttagtacattttatagttaaatttctgatgattctggaaagggaaataaatgatcaaaatggtaatagtacctgttttga

SEQ ID NO: 175810 - DNA, 411 bp, Homo sapiens
gtcctatgcagtacccctgttatattgcagtaaaatacacatagcataaaattgaccattttaagtgtcactgaactcagtggcattaagtacatgcacattattgtgcaaccttcaccaccatccatttccagaactttttaatcttcccagattgacactgtatacagtagtcccctcttatccacatcccaagactcccagtggataccttgaaactgccgatagtactgaaccctgtatatactgtttattcaatctgataaccaagatggttatcaaatgtcaaactggtgggtaggggtagtgtatgtatatagcatgaagatggtagacagagggatgagtgacatcccaggcaggagggagcaggatggcatgagacttcatcatactactcagaatggtcca

SEQ ID NO: 175811 - DNA, 872 bp, Homo sapiens
atccaaaccagaacaccaatactggtccaagacaattattaatcaagctatagactgcattagaatttcacattttcacaggtgttacttttcatggcggtggtgtacagattaatgtaaccaccacaatagagaaacagaactgtcctatcaccccaagacacttcctctcccatacatcacaccccccttctaccctaacacctgacaatgaacttttttttggttgatatttatgtaaacaacatttaatggtggttcacatttgtcaatttcaatctaccacgcttgatctctcaatcaaaactctgaagatccaacctctcttccctcttttatttccacacacaggggataaaggaatcaatatttgtgaagtgcttaatatgggctggcactgtgcaaggtgctctttcatggattttatttaatttcacctaattgtcctggaaggcagtgtgtgataggatactatttgcagttggggcttggaaaggtaaatgattcaccaggatctcaaccagtctgtacgctgaggagctggggcggccccgagttggtttggtttccaccacactggtctggcatttgtgcccatggtccaggggctgtgggcctgctgctggtaaaaaggcctgatacaaaactgctaaaatcactctgctgccggtgtggggtgaaacagggccggaacttggctccagttcccgtctcgattttggaaggtccgacctaactttgagtatgttacagcctttattattactatttttaaagtaggtacagactctggaagataccctgaagcttaaatgcacacaagtcattagaatccaagagacatgcccatgttgagaggcaacatgatgaag

SEQ ID NO: 175812 - DNA, 233 bp, Homo sapiens
gacccttctgggctctgttcagatgaatgaactgataaactattttaattgaatatcttattctcacagtacataatgtaaacaaaggccaaaaagcatttatagagcatgtaatgtgtggagcacagaccaggtgcattggaggcgttgaagatgactgaatgctgacctcctgaggtgttcctgaaggcagtgccacttgtagtctttaagagaatgggcaggagaggtgg

SEQ ID NO: 175813 - DNA, 700 bp, Homo sapiens
gtgagaacatgtggtgtttggttttctgttcatgcgttagtttgctgaggataatggcctccagctccattcgtgcccctgcaaaggacatgatctcattcctttttatggctgcatagtattccatgatattaagggatttttaaacattggtgactccattgtgattctaacaaccttcacacattccataaacacatatggtaacaggttctgaagctactcactactttctcttctggtacatttcattaacgatacgccaggatttttctttggcatccatgaaaagcataaagtcatttccatgaactcagccatgtaccagagtgatagaggattgtacaacttttccaaaaccaatactgctttcaaaaaatatggtgcataatgttagaattttcttaatttttgagataagcagaggaaatcagaacatttagaatctcagtgaattttgttaatctcaaatttgtgattcctttacattctgttcttagtagcttttattcaccatattaactgataaatcttagtgatgaatttaagtattaaaaactcaaatttaataaaatgtaaacataaagtacctgcatgtgtaattggcaagaacgattttcccctctttattaatgggaaaaaaacttctaaattgaataagtatacctcttcctctccatcaggtaattgaaggtaagtt

SEQ ID NO: 175814 - DNA, 432 bp, Homo sapiens
gtggattaaatatacgtctctatccttaatctcttgaaaatcgactgaaaggatatttaagggattaagaagaggcaataaccacaaaacataggagagaagaaatgacaataaggttttggaagctgcagtgcagaaggaagagaggtaaacaatttgatctacttgagagagttgaatcccaagctggcagtgtggctaagaaacaacctgacagaaaggctaaggaatgggtggtagggcccaaattaggaggactctttagcatctgttcaaaaagcagtcagacctccaaatccatcctgcacccctaaactctatgcagcctagtaactgtgtctgactcccttcatcctaacagaaaactgggaatgtattctgcaagtctctgagggatatcatgcaagattaaggatagaggggtactgagaa

SEQ ID NO: 175815 - DNA, 603 bp, Homo sapiens
tgagtgtcctgagcctgcttggccagtcagattgtccagcccagaccccatcccgttgtgctgtgcagggcctgggttccctgaggaagctggggtgggggtacaggtgctcaggacccagccgagggtgcagcccgctcagcacacccagcctgagcttttgggaagacaggcatgacctgctggcccaggattgtggggtttcactgctgagtcccacgccaggccaggctcctctctttctcagggggtcaccccaggagcgacacccccaccagaggtcccctgctccctgaggcattctatggctgggccttggagcctgagtggctctgaacacactccctaccaggatgttgaaggcctgaggcctgcagaacagagcccagggtcctggctctgattgccccaacgcagaactgcaggtctggcccaggtggtccccaggttacaggcattagaagcttgccaccccccatggctggctgtgtccccgcgggcctgcagcatgtccattcctgggtgggggtggcctggccgcctgccctggtcactgacgcgccaccgttcccttgtgtcttcctgtgttgctgccacagcgtg

SEQ ID NO: 175816 - DNA, 480 bp, Homo sapiens
ctcgtttatcctatttggaaaaagtttgggtctaagccaaccgggatcagcttagattgtgcggtctgaccccagccaataggggaaggacacaaaaacaaaaactacgttggggttaaaaacccattcctggtcgggcgcggtggctcacgcctgtaatcccagcattttgagagacctaggcgggaggatcttgtggtcaggagttctagaccatcctggccaacaccgtgaaccccgtctctactaaaaatacaaaaattagccaggtgtggtggcaggcacctgtaatcccagctacttgggaggctgaggcacgagaatcactcgaaggtgaaggttgcagttggtcaagattacgctactgcaatccagtctgggcaacaagagcacaactctctctcaaaaaaaaaaaagtaggcaaacgctaggtgcagtggctcacccttgtaatcccaacatttggggaggcagaggccg

SEQ ID NO: 175817 - DNA, 457 bp, Homo sapiens
ggtattgctattcaatcagtgtaattctaataccacattcttccagttttaatcacatctacaaatattaaaatattgagacaaattcttacatgtctcaacttccccccccccttcccacaaaattgtttggtctatcagtgtttctttaaaaatcctttgctcctttatgggaatgtccctccatgttagcacagatgtccaataaaaactcaacctgttggtctcttacttcttgtgtattctgctacatacggatgcagtattaacagcctccaaatctagagttgcctttaaaccagcgaactcagtccatacttacacccattctcattctcttatccacttacccaaaacaaaaaacccttaaaaaaaaaaaaaacccaatcaataacaatacttaagtctaaccatactcttcttcagagaaattaccttacaaagcattggaaagagg

SEQ ID NO: 175818 - DNA, 409 bp, Homo sapiens
ggccatgcctttaggagtcctgtttgctggttctttccctgtatcccaatctccaaacatcagtagggctaggactcagttcttggacagcatctcacttctgtctacactcacaccccagtgatcttatccagagatccaggggttaagtatcttctatatgttgttgacttcccaaattacagttcagccacagatctctctcctggagaggttcattccttattacatactcaacatctccacctggatgtttaataggcacttcaaacttaaaggtctcagatggctttcctgatcctcctgccctgacacccgttcctctcacagacttccccatatccataaatgacaattcccctcttgccatcgtttaggacaattgccttggaaaatgccctacctctct

SEQ ID NO: 175819 - DNA, 159 bp, Homo sapiens
gatccggggcctgcgattctgcttcttggtcctttctctcctagaaacccctcacggcctccccaccatgggttatgcttcaaagggggtgccatggacagaattctcccccatgacaggacggaagaacactgagaccagagaagtcagacctgtgca

SEQ ID NO: 175820 - DNA, 316 bp, Homo sapiens
aggaagcagtggatgctcagagaggttaggtaacgtgggtcagggacacacagccaggaaggggcagaggctgggagtgcctgactccaaattcatgcaatttctaccccaccatcttctccccaaggaaaatagtccctaatgcatgtgtgcaatgcttagagggcagtagatgctcaacagatgctgagagagtgagggagtaaatgagatatgccatgaaaaggagcccctgtggacttatgcgtgcgtttgtttaacttgtgggcaagtacttatagacaggtgcaaacaataaatctccttttgcaactga

SEQ ID NO: 175821 - DNA, 556 bp, Homo sapiens
tattgagtgcagtgtggttgggcaggtttgacttgttaactgacataatcttgccttatctaatgcatcatcactgctcactgcagcctgggcaatatgatgaaaccctgtctctaaaaaaacatacaaaaaattagccaggcatggtagtatgcacctgtagtctcagctatttgggagacagaggtgggaggattgcttgagcccaggaatttgaggctgcagtcagctgtgatcacactactgcactccagcctgagtgacagagtgagaccctgtctcaaataaataaataaatagggatagcagtatgcatctttataggattgttatgggaattacatgagtaataatacacttacattaagcctgacacctgctaagcatgcaataaatgttaactgctattattgtgcttattactgttatcaaatatgagaagcccatataagcaaactccaagatgggctgaaacatatatgtgacacaactgcttaatctaccctcatctacttccattaggtagaaggggatgggaagtgaggaaaaagtatta

SEQ ID NO: 175822 - DNA, 638 bp, Homo sapiens
atctcagttacttgggagcctgaggcaggaaatcgcttgaacccaggaggcggaggttgcagtgaaccaagatcgcaccactgcatcccagcctgggtgacagagcgagactctgtctctaaaaaatttttaaaaattgaaaatcaacaaatccaaaagtttgtcctataaaaagattgaataaaattgtaaactcatatcgaaactgttgggcaaaaaaagaaaaaaacacaaattaccaacactgggaataaaaaagggaaaatgactatagccatcaaaaagatacaaagatattatgaacggcattatgcaatatatttgacaatttggacataatggacaagtttccccaaaattaaaacttatcaaaaataacctaaaaagaggctgggcatggtagctaatgcctgtaatcccagcactttggaggccgaggcaggaagatcacttgaggccaggaatttgagaccagcctggccaacatgacaaagccccttctctgctaaaaaatacaaaaattagctgggtatggtggtgcacgcctgtaatcccagctacttgagaggctgaggcaggaaaatcgtttgaacccgcgaagcagaggttgcagcgagccaagattgcgcactgcactc

SEQ ID NO: 175823 - DNA, 624 bp, Homo sapiens
atctcagttacttgggagcctgaggcaggaaatcgcttgaacccaggaggcggaggttgcagtgaaccaagatcgcaccactgcatcccagcctgggtgacagagcgagactctgtctctaaaaaatttttaaaaattgaaaatcaacaaatccaaaagtttgtcctataaaaagattgaataaaattgtaaactcatatcgaaactgttgggcaaaaaaagaaaaaaacacaaattaccaacactgggaataaaaaagggaaaatgactatagccatcaaaaagatacaaagatattatgaacggcattatgcaatatatttgacaatttggacataatggacaagtttccccaaaattaaaacttatcaaaaataacctaaaaagaggctgggcatggtagctaatgcctgtaatcccagcactttggaggccgaggcaggaagatcacttgaggccaggaatttgagaccagcctggccaacatgacaaagccccttctctgctaaaaaatacaaaaattagctgggtatggtggtgcacgcctgtaatcccagctgcactctgtcccaaaaaaaaagaaagaaaaagaaaagaagaaaatcttaactagcccagtgctta

SEQ ID NO: 175824 - DNA, 412 bp, Homo sapiens
agcacaggtgactcgcctgaaatagctagtaagtcggggagggaaagtttgaagccacagtcccagactgcagagctgggtggctcaggccaggcgcagtacacctgctgtggcccagcctcttatctgctgcctacaggggtcagggcttggtgccctcagcacccactgctgttgcccaggtaaagagcacctttgggtgctgcccatgccacctcctatggctcccctgactcctgcggtaggtaacagggcctggtcccctggaatgggtggggtgtgtgtgccctggtcccctcactcaagcaggcccagctgaggcagggacagacccaagccacagaagacgctggcccagaaaaggcaaacactccagcagagcccctaattacggggccaatgagcgcggccg

SEQ ID NO: 175825 - DNA, 192 bp, Homo sapiens
ccaggctggtttcgaactcctgacctcaagtgatccacccacctcggtcccccaaagtgctgggattacaggcatgagccacccatgcacggcccctcccagttttttttgctaatttatctttacttcatagcttgcttccagctcccaagggtgaggattttgtgttttgctctgtgctgtgcctcaggg

SEQ ID NO: 175826 - DNA, 321 bp, Homo sapiens
cactttactgcaaggtagactgaagttcagaagaaatactgaatttctgctcccagaagaatagtttctctggctcacaggcccaagttctcaatgaaatcgttttttaactttcacattcctaagctggcttcccggcacagaagccatggatttcccctctctcccttccccctcctcaaggaaatagtcttcctttatggattttcattggactctttcctcagcgattgtcctggctgtttattgatagtccttcccataagaaaatggggttaaacatggggtaggtattttgtctttcaaactacaaatggaatg

SEQ ID NO: 175827 - DNA, 287 bp, Homo sapiens
gtgcatgtcttacgtcagtattctcataacttagctcttagctgaccatgactggtcagcctcccagaaaagacttggtagaacttattcctagaggttacaaagacctagttgccacctctctacaaaaagaaatagggggtacagggaaaagaaggtggggtggtggtgtttcatcattcaattgatatatgtggtcacttaatactaacgtagctattagagtaagtcattcctgtctacagctgatgcattccattacggagactgaagcttggatcttcaga

SEQ ID NO: 175828 - DNA, 540 bp, Homo sapiens
cagagaaacagaatcaatacgaaatatctacctatctgcctgcctgcctgcctgtctatcctgtctgtctgtctgtcctgcctgtctgtctattataaggaattggtacatgattatggaagctgagaagtcgaaaggtctgcagtcagcaagtaagaggccaggagagcccatggtgtagttccagtccaagcccaaaggcatgagaactaggagagctgatggagtaaatttccagctgagtccaggtccgagtctgaaagcaggagaccagtgtcccagctggacacagagcaaattcccccttactcagccaatttgttttattcaatggattggatgaggtccacccacattggagagagcaatctgcttgactcagtctaccgattcacatgttaatctcatccagaaacgacccacagacacaatagaataatgtttaaccaaatgtctcagcaccctgtggcccagtcatgttgacacataaaattatcacaagtactctgctcctgattattttatgtgataaggttatta

SEQ ID NO: 175829 - DNA, 384 bp, Homo sapiens
ccgcgtcccctatcacttccttacccctacaccttccttccctccttatttctttttttcaaaattaagaagctataaaaggacacagtcaaattagtagctctgctactccaattctaggttgaaatagctcctacaggacaatcatgcatctgccacgtttatattaggtacagaaagataaaaggatgatttagaagcatattctacttctatttagatacctgaatggtaatgctttcctcatggtagtgagggaattttttttcttttgtcttcaaaatccaaagtcttttactagcaactatgtgatggggtttgttttaaacttataggttctactgagtaataacagaaatataatttaacttttcttaccataaa

SEQ ID NO: 175830 - DNA, 307 bp, Homo sapiens
ctaaacaagttgcaagagtaacagaaagaaccccgcattccctttacccatagtcgcctcttctgaacattctgctacgttcactttatcatccctctctccctcctccaagggaatacggtttttcccataaccattcaagagttagtggcagataccacttcccaagcaaggatgttattttacataaccatagtacaatcgagaatcaggaagtttcacattgatatagtacaccctctaaaacatagtccacattcagatttcaccagttgtcccagtgatgtccttgatagcattttccccc

SEQ ID NO: 175831 - DNA, 839 bp, Homo sapiens
caatttaaacttaatcaatacctcttttcattacaaatcagaaagaaaaaaaaacgttataagcaatcattcctcagtatgatcatggaaatgggttccttcattactcctatgagtataaattagcaggactctttggcattttgcatctagatcctcaaaaatgttatccttgactctttatttttacactcataattcatgagtataaaagaatcatatgaaagcttatacacaagcatgttcctccagcattattttccatcacaaaaaataggggaatggttaaccatagaatgaacacccattggacagatcctaactggatatcatataatatagtattaccttttgtaagcctcaatttcctcatcttatggagtgaaaattaattgagataaagcctataaagtgtttttcacacctgcctggcacggagtaagcactcacataatagctattaactttgattcctgaatgaatgccatagaaaccatttgaggctccctcattgttaccagtgctcattttaacaatcctgttgtccaagagtgccaggttttcttctctctatgcttagcaacagtcccagtgggttccggctagctttctgcatttcgtaaagtggtcacaataaatacaaaagccatgctatgttccacatagaagtcgaagtagaaagactcccatgccatcccattcattaccacattttaccacgtaagtaataaaaatccacagtgtcggggtgggagtgccaaggcttcataggttccatttgaaaactttactctgcaaaaggagatcagccccaggaactagtacctaagacagacact

SEQ ID NO: 175832 - DNA, 435 bp, Homo sapiens
gccaccgccaacactccctctgtcccttgcgtcaaaaccacttcccttttccccacatcatggcaaagccgcaggagaaatccctgctaatttcaggttgcttgagagatggaacctccaagtctcttgggaatgttcccttctctggtcttaggtgaaatccatgagtttcttctccttgttacggcaagatctacctgccgagtgtctctttccagccctacttggcagctctcttcctgtctgcagagatagccagggtagctggggaaacagaggaagatgtaggactgtgactatgatgtcatacatcccctgggctccgtgggggctctcccccgccatgtctcactgtgcatatcctgttacatgtcttgtgctgtttgacaaatggcctcttgacctttgcccaatcctcttgcttcttgcagctga

SEQ ID NO: 175833 - DNA, 475 bp, Homo sapiens
ctgttacttgccagcctaggagaggggaggcagactagagggttctgtgttgtcctatccagcttcagtcttaggcaggctttatctcctcagttctcagagatgggcttgcccaacttccgggagtaggagtgctctaatgatcagggtcacagaaggtttccagcctcagcctctctctcaggggtagggttttttttttttttttttttttctttaaaaaaactctcagttaacggtttctggaatacaacgcttgtgatttatgcttactcataaggggaaactcaggttggttttgaaaactttagggccaacgcagtcgtcgcaaccgggaagtgacaaacgcatttacctgatgagagattgtggcaatagatgtgcagttgggaattatgtgggtgtgaattggccagaggcccattgcttgcttggagaaggggacgaggactttgggggccaagcagtcgggttc

SEQ ID NO: 175834 - DNA, 266 bp, Homo sapiens
tttggagagtagtgtaggatgataccttatcacaatgacctaccatgcctttgccttgtcacaagaccactcagcttctcagtcattcaatttatagaagaaatccatgtcctcctgaaagagattcttcacagagcatctgacttctggttctaattcagactgatggctttctaggcctgcctcaaggttgtcatcctggaattatatttcattacaatcttgggtgagatccactgttccttagaggccatggcttcctccaa

SEQ ID NO: 175835 - DNA, 783 bp, Homo sapiens
gggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaacaaacaaacaaaaaaatttctttggtagcagaataaaaacacaaaaaaaggacttttcttctggactgaactatatttaaatctcaaaggatggacatctcacaaccttcctacagccaagtactgtgaggtaataattgatatatttacttattaaaattattgaagctggaactcagatttccattttatatttacatatataattattctattaatggtctacttagattaagagaagcgacatgagtccttggtcattggggcaaggggtgagatcgatgacctctggagattgatcccagtgttctga

SEQ ID NO: 175836 - DNA, 533 bp, Homo sapiens
caatacacttgctgaagcagaggtcaagacaaagtgcaagcatctgtcctcacagcgccacttataagacccctccatgcttaataggaggaaaactcatgtcaatgaaacacatggcatccagggataggggaacgtggacccttggatagagttggaggaatttaaactcacggcaaagagtgagatgatgtggggctacacttgcatggtaaagtactggggcttcccagagtgtagtgatgcaagaaactgtggagcagggctttctctcactagtacagttacagccagtgaaaactgactaaatgtctgttctacttgttattgttacttcacaaaaagaggccttgtcttggacttggtggtttttatgagttgggttgcactattagcaaatctgacagcctgctgcctcaagtgctttttctgtcccttgctgccaccaagcagggttgggtgttctcagagataataggaacaggaggcttcacatcagcgagagtagtaagcagggtcaagatcagagtata

SEQ ID NO: 175837 - DNA, 354 bp, Homo sapiens
ataatgcacataaaattcctgtcatgaagtagatgttcaataattgcaaccatcattttaatggccagagaacaaattaagatcccttggtaagaatttctgtacaggaagatggctcaagaggaatccagtgctctaaaagatgaaattctgggaattacaatttcaaatgattctgatgagaaagaaaagtagttactgaaggaactgatgtggccgcatagggatgttttcaaaaaatgtatattgaaagataggagagaactgttatgacagggaatgaatacaaaacaggaacaccaaactgaaggaacagaatcagaaggactgaggtactgaaataatttgaactga

SEQ ID NO: 175838 - DNA, 524 bp, Homo sapiens
gagagatagaccctgtgagcgaaacacctggcggtgcctcagcccctctttcctcccaaggaagcgcattgttattaactgggaattctttatagccgggctggaggaagttttggctgtaaactgtcatgcactgcagccttcgctgaaaaggcggagggagtgggcctggtcctgggaaccgaggaacaaagatcagaaaatcagccacagaaaggggaggaaaaataaacgttagaaagtgaagacaggtgacactacacaagtgctggccaaagtcggtgacttccaacctctacctcctccgacgtgggtggttcaattcctgggtcgtactcttcaatgcttcagacattctctctggagagtagaaattttattacgcgtgttagaaacggaatattctttcctgctgaagttgtattcttatttggccgtgcccctcctgttcggaacagttttagagcgatctgttaaaccctccagtcttctttggcgcttcccgactgtgggaaaagcggccg

SEQ ID NO: 175839 - DNA, 293 bp, Homo sapiens
aaaactctgcgtatttggaagttattctatgctaatttaaaaattaattaatataggcaaatagtattaaatgtctttatattttaagttctctttaagtaaattgaatattgatttcagcttctgatgccagatattattttgttagtaatccttaataaagctagatacttggctggttgtggtagctcacacctgtaatcccagcactttgggaggccaaggcaggaggattgtttgaggctagtagtttgagagcagctggggcaacatagtgagacctcatctctacc

SEQ ID NO: 175840 - DNA, 678 bp, Homo sapiens
tacctctaaataaactgtaacttctgaattgtactctaaaattcagaattaggaaatatacaataaaagttcggaaacctttgccatcatctacttccttgaatgtgaaagagaatgtaatcagagaaaaggataaagaagttgtcaaacctgaaatcccctgaacagaaaggagctgccacggctaggctgcagccctagaactctgtacacaaattcagcccagtaccttgtcccctgcctactcccattcctagaagaatggtataataaacgggcagcccggcccacatttcagtaaattgaactgtcacggggagaataaggcaccccaaacagttgcagcgacagtggttaacaggaagtctctctgtcctccaaaccaataatcaaagggatacataaggaactcactgctttcttagaaggccacatgcaccccgggatgtttgctcatcacgtcactctggcctttaaccagggagcaaagagacagttgtgggtaaaaccctatttccaagctaacaattatccttccttatggtagactggggggtgcacggtacactcttgattacacaagcagtcttcttcccccctagaacaaatgacagaccaacaaaaaggagaaaatgatatgctgttgtttatctcttctgccagcctgaactcaagctc

SEQ ID NO: 175841 - DNA, 260 bp, Homo sapiens
tataaatcaagtaggagttatcagccttaaatgctccaaagtccttaactggttaactttagattttaagaatgcatgctgaaatttctaaggtatccatttaaacaagcccagaactataatgtgtaacttccaaactaataaagggtaaaaacctgattaaaataaataaataaaatcattcctttttttttttttttttttttttgacagtgtctcgctttgtcacccaagctgaagtgcagtggtgtgatctgggc

SEQ ID NO: 175842 - DNA, 290 bp, Homo sapiens
attacaggcatgagccaccatgcccggcctaagaggtgcagattttttctctttaatttaaattctctgggaacacatgttttaggtaatgtgtattcttcctcatccctgtggagacttctgggctatgcttaacttttgagagagagagggaatgttttttttttaaagagatggaagtctcacaacgtttctcaggctgacctcaaactcccagattcaagcgattttctcgcctcaccctcctgagtagctgggaccacaggcatgcaccacctcacctggctaag

SEQ ID NO: 175843 - DNA, 185 bp, Homo sapiens
tccgccctttagaaaggtaattctggcttgattttgaaggataacacaatggttagtttgggtgcagggttaggaacagaaggcctctctccactcattgacgggatgtggaagggtaaaccttccttactgattggggtcatgcctctgtgtgtttgttgggactgagttataagggataggaa

SEQ ID NO: 175844 - DNA, 450 bp, Homo sapiens
cccactctacccctgccccaggtaaccacagttttgatttttttcacctcgatgttttatttgctccaatacttcaagttagtaggaattttacagcagctcttctcttgtgtctattctttggttcagcgtaatgtctgtaagattcgtccatgttgttgctcaatcttgatgagtagtatttcatgctatgaacatatcataatcggtttatttgttcattttgttgggggggggggaatttccccccagattggggccattatgaataaagctgcgatgaacattcatctacaaattatcctatggatgtatattttcatttcctttttgtaaatggagatagaattactgcatctttagagtaagtacatgtttaattttacacaaaattgtcaaatcgttttatagttagttgtattatttttacattcacaccagccacatata

SEQ ID NO: 175845 - DNA, 470 bp, Homo sapiens
tggtatgtgggtggaacacacagacggcgtcagcctgcaggatgtcccagtcagtgaatacacttcagagcaacatggccacatctcaagagctctgcttccctttttgtagcctgttgctggtgtttctaagagtaggtggtctccagagaacagaagccagcttctaaaaaagccttaggcagtccaggctccgtggctcacgcctgtaatcccagcactttgggaggccgagccagtcggatcacctgaggtcaggagtttcagaccagcctgaccactatggtgaaaccccatctctattaaaaatacgaaaattagctaggcatggtggtggatgcctgtaatcccagctacttgggaggctgaggcaggagaattgcttgaaccttggaggcagaggttgcagtgagccaagatcgtgccactgcacttcagccttggtgacagagtgagactgtctcaaaaaa

SEQ ID NO: 175846 - DNA, 449 bp, Homo sapiens
catgtacctcataaatatatacacctactatgtacccacaaaaattttaaaagataataaaatttttgtaattgtcaccaaaaacaaacgaacaaaaaagacactgacattaagatatttctgattgggcttcattgattccttaagatccagactcatgaggagctcctagaaatcgctcggacctaacacaactgacaaatgggaaacaaccattcttgaacacagagaaagttgagcgtcaacctccagcctgggcgacagagcgagactccgtatcaaaacaaaattgcaagtctttagtgcaagggcgtaacagggaatgcctggtatggaccagttgttaaggctctgcacagcaacaatggccaagtgttctttatgttgtgagtaggttgtgaatttcattacagtgtgatgaggtttgttctgttcgtggtttttgcata

SEQ ID NO: 175847 - DNA, 476 bp, Homo sapiens
tatcagatgtctcaatagtagtgatccttatttcctaggactcactcacatccttgcccactgacttccccattagagccttttaaaccccctgggaatctaaagctatattatgacccagagtttagatctaacagtaacaaagcttgctaggtttgtgcttgcttcttggttttttaaaaaacaacatttgttttagtaatacaaacacaggtggttaaactgtacagaaaagtaagagaacgatgaacacaaaagtcaggataatcattatgtctggtgaggaggaaagggggtatgatttcagggcagagagtagacaaacagcttctaggatacaaataatgttccatctgataaattggatggcaaattcacaattttctttcttttattttttgagacagcatctcactattttgcccaggctggtcttgaactcctggcctcaagaaatcctccaacctcagccacct

SEQ ID NO: 175848 - DNA, 481 bp, Homo sapiens
gctagtgttttttgtatcctgcataagaaatcttcccttacaccaggtcacaaagatttttttcctacattttctcctatatctaaaagttttatgatttcagcttttacatttaggtcttttatgtctatgatccattttgatcgcatgcttaattttgttctcactgcacaaaagacacagtaggaaaggaagaatctggaataaagatgactgcctctttcaaaagacaggttgtagaatagaaatattaaacttttgttctgtgtattatattatcttcatctaatattgattaagtagtaactgttcagtagtaaaatatatatagattacctactctgagtcaggcactggagatacagtaatgaaaacactagacaatgtccttgctcccttggagtttatatttgagtgggtgaaattgtgtttttattataatgagcctccattgtatatacagtaaagtcaagaaaaatgt

SEQ ID NO: 175849 - DNA, 467 bp, Homo sapiens
ggtcacattttgatggtcagtcaataacttaagcagttaccaaaatactaggtatccaaggagcgagaggtgggcgagcataagaaacacatttctcatggcacagctctgccaaagccctgcagaatcatttacacataggtctttggttagtagcccctggcacagaattctgatcttaaacaaatattgtctataatcaagtagagcaatgcaattaaaaaaaaaaagcacaggttttggggccatgctgaaatcccagccttgctatttgctggctgtgtgaccgtggttccttggtctcattatgctttggttcccgtatctataaaacggacgtaataatgtctccctctcattattgtgaagtcgaaatgatgtctgtaaagtgcccaacacagtactaaagggctatttttttcttccctatgaagatgagatttaataaaagtgatattacaaatgta

SEQ ID NO: 175850 - DNA, 1052 bp, Homo sapiens
gtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatgggggaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgaaggcgctggtggtggcgcgcggcgcggcg

SEQ ID NO: 175851 - DNA, 651 bp, Homo sapiens
  misc_feature (14)..(15): n is a, c, g, or t
acttcgagctcggnncccctcgcgtgccggatcatttgagagttagacgcagacatgatgcccttttgtccctaagtacttcagggtgtatttcctcaaaacaagcacagtatcatgattgaaatcaggatatcaacactgatacagttctgttatctaatatgcaaacttcaagtctcaccaattttcccactactgctctttacctttagcaaaatcaagaacaacatttagagtgattcaaggtttcatccaggctcacaagcctttcatctagtgtgtcctcaatctttgctgcctctcatggcctttgtatttttgaaaagtgcaggcactgatttttttttaaacattttttttcaaaagtttaaaatgcgataaaaatgtgtgacacaaaatctaccatcttaatcatttttaaatgtgtacagttcagtagtgttagatgtattcacgccattgtgcaatagatctctagaaccttttcatcttataaaactgaaactctgcacccaataaacaacaattcctaatttcccccaccgcctgcccctgacgtcccccgttctgctttctgtttctgtgaatctcttgtagtgaccttgtgtaagtggaatcatacggtgtttttctttctatatctggcctgct

SEQ ID NO: 175852 - DNA, 388 bp, Homo sapiens
aataaggattcaagggttttcctctccacggtaaggagattgttcttggcaagttatgctgagaagcctgttgtgtgccttgtcctccctcagtcatttcagccttagaattgaattaactgcaggcccaaggacataaatgaaccacgtgagtcatttttcaaaagtgaacgacagggcacctgtcttctggaattggtgaatccattcagcggagactcttgacaaggctttgtgtgagatgatataaataggccctgacctgcagggcttttgttgtctttgggtgagatagagacatttgtacacaaataatcacaaactggctaaactgtgccacgtgattagcaaacatgcgcatgcccaatcagcgagatcttcacggtca

SEQ ID NO: 175853 - DNA, 528 bp, Homo sapiens
aggctgacccagcgttttgttaatttgtgttcagcatttgctgggagctttgtaacccctgagcaatgaaacaggagcatattggttggactgtaggcattttaattagaggtcctgggaataactctgtgctgtggcagctggataagacctggcccctcaaagtttacccatggcgagcttccctcctggccctcagcggccattaaaaggtcttgctagaggaagggacctgggggagggagtgcaaaatttctaaggagaggaggaagatgcctggtgggctggcgtccaacagcaattagctactcagctgtcagtgcccagagcccttgctttaacaaagtggtggcaaagattgacagaaatggcttgaccccatgatggatcccaaagcattttgtaaaagggtctttttactcttgctaccttttcatcatctggcttaaatacaatgcaacaataaaggcatcataaatcaaaagctgttagcacacatggcccctgcaatttatgggtattaagcca

SEQ ID NO: 175854 - DNA, 287 bp, Homo sapiens
gagcacttactagcagctgccacatttgccagtgtgaattatgtctattgggctttctttgtccctggtttcccaggcagtctacccagatctctgcaaagttaactgtgctttgctattttactttatgtttctggttattttcttttacactatattcaattatatagctctggtgttacccaagtctttgacttgaatccaatataattaaaaatgtacattaattatgagtaagtaccacatcaattatgccacctaatttaatgaaattcagtttttaagat

SEQ ID NO: 175855 - DNA, 193 bp, Homo sapiens
cttaccctggttgttaatgtttcttgtaacttgtagttgttggttgtttgccaatactaataaaatgagctccttgatcactaaatattattatacagactttctattatgatgaattttctcattgctgcttttttcatgcttcactatttgttttcagatttttagtgatatttctatttggtgactgttg

SEQ ID NO: 175856 - DNA, 355 bp, Homo sapiens
catgtgggcatgtgaatgaggcaaagcgtttaaccttcctgtgctttacttccccatttagtaaaaccaataaaacaacactacctaccttgtggggttttgtgagttttaaatgagatatcatcagtaaaatgcttaggttaggcttgatatataaaaaagcactcaacgaatgtcagctgcctttgagacgatgatgatgatcacaatgatattacatgaggttgaaaaattaggcaaaagctacagattctgtgctaaggagttttgacataatactgttggctggggaaattgtgaaggatgttaaaaaaaaatacaattcacagctctatagatttataaactccgtgtc

SEQ ID NO: 175857 - DNA, 435 bp, Homo sapiens
cacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccctttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctg

SEQ ID NO: 175858 - DNA, 318 bp, Homo sapiens
tgctatacaggcttaagccaccgtgcccagccttctttccttcattttagtaactcgtttgtcatctttgctagactgcaagttctgtgaaagctgggtctgtgattatcttcttttggatcagaccttcaacttctggatacatatttgggaactgaatgacttgcagtatatttcagccctttttgcctgctcagaagagatgcccgattatcatttagaaaaacaattggctggtatttcaaactgaaaacagcagaagggtgataatgggataagaagttgaccagcagctcatagacaacaggcaaattgtca

SEQ ID NO: 175859 - DNA, 268 bp, Homo sapiens
tagactgtctccctcctccagactactttggaatttgtctcagaattgcttttaaccagccgcctcaccccagagaccagccaggccctgagtgctggtcatatgtcacccaaccttatggcacattcactaacatttgctcacaatttgtttggttttcctttgatatcagtggcttcaatttcattatatatttcatcctatttagaggaattattggcttaaaaggtcaatatttgtgatcccctatatactacatatatactaa

SEQ ID NO: 175860 - DNA, 308 bp, Homo sapiens
tttcaattttaaggtaaaacttacataacataaaattagccattttaaagtctataattcatgtctacccagttcttgagcccatcaggcccgaggcagcttatatactgggagccccatctccaccagccttaacctgcatgtctctgtgttccaagttgcatagacataggtgcccacaaatacagccttcctctaaagccggtccctgccgtgtttagctctcttcctgccttggtcactgattcgggtctggttggcacttcattttccccttgctgggtcttgagtgctgcctgatctgagct

SEQ ID NO: 175861 - DNA, 435 bp, Homo sapiens
ttcccttctctgaatcctctcccagtgaatggtaccatcaaccacccatgccagcaacttgagtgattccctctccttcagcctccacagtgacaccgcccaagtcccagctcttggagccacctctccactgcctctacctcagttccgagcccaggatcctccaccacagaacagaaccacctactacctggcctccctgccttcagggtgccctgcctccttctcttacagctggcgaaataacctttctaaaacccaaaggtgatcgtgccttcccagcttgtagcccttgtgatcactgaaatgtggttcacagctttggctcagggcattgagcccttctcaatccacctcctcccacattctgtatatacctcacgcttccttttcatcccccaccctgcttgcagttccatgaacacatgtgcagcc

SEQ ID NO: 175862 - DNA, 428 bp, Homo sapiens
gcagctaccttgtataactgtgccattgaagaaactaccccaaattccctttttacaatacagtaaattttatttaataaaagtttgatgaatcaacaataaacaaataaaataatatggctattattaatatgttgaagagaatatgagatgaaaatagagatgagagatgaaaagatgcagatagaaaaaactagaaatattagaagtaaatacatatgtctaaaattaatattcaatagaattataaaagcatgaaatactctacctgaagttaacagctaatagtttgggattgacggaatgttagatccagtagacgatcggattacttgcttgaatatgagttaataaaaaatatttaaagagaagaaacataattggaaggtacaacacgtaagataaaaaccatagtgaaaagttctagc

SEQ ID NO: 175863 - DNA, 418 bp, Homo sapiens
atgctcaattgatgcaagattttagaaaagtctgaattagttgccaatatttaccaatcaggagatttcataggtaaaaaatacaaatttgtggcttctgttgaaaaatcaggaaaagtggccatctgggcccacagttctacctgggcctgatctgccccttttggacagacaccttctccaccgtctccaccactccctattgtccacacactcctggcttgctaccctctttcagtgactgcctgttctctagtgactttaacctgggaagtcacagtaggcagggcccaggactggtggcagtggggatgggaaaagagaaagagggatggatttggcagctggtctggggaaagaatgtaccagctgtggggggatgtcagagctgactctgaggattcagatggggcaggaa

SEQ ID NO: 175864 - DNA, 590 bp, Homo sapiens
cggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgtgtctgtctccaaaaaaggttggtgatgacattgccaaggcaacggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagatcgtcaacattgctcgacagatgcggcaccgatccttagccagagaactctctggaaccattaaagagatcctggggactgcccagtctgtgggctgtaatgttgatggccgccaccctcatgacatcatagatgacatcaacagtggtgctgtggaatgcccagccagttaagcacaaaggaaaatatttcagtaaaggatcatttgacacacacacaca

SEQ ID NO: 175865 - DNA, 351 bp, Homo sapiens
ctctccttgccatttggtccagttgcagcagaataaaaaaagctccacttctggttgagggatctcacatgacaagtatgcaagagctgtttaataccaccacccctggccagtgacaggggcacggcatcctggttagtaatgaaagtggagtgagaaagctgcaggagcctgagatggatggaacagggaaggagcaaagtttccacagaggaaacagaggaggaggaagcgggggacagaataccccacgactctagcggcacacgtacacaagcgaggcagcacgcagagttgacgggcacagatggactggtcacgtagcctggagttagggcaacagatggacaa

SEQ ID NO: 175866 - DNA, 151 bp, Homo sapiens
ccctcagaccccactcatcccttctgctcaagtcacatttgcaataccagcaatagcgtaagttatgaaaatcatacccaaaaaccacatttcatttaacaaatttttacccaacaccatgctaggtatggtcaacatggggcccctaagg

SEQ ID NO: 175867 - DNA, 495 bp, Homo sapiens
cgacctagaggatccccccagtagactaacattggtgaacaaaaaaataaccatagttcccactatcatgtagcttgccatctagtaagggagctagacataaataattgggtaaacaagcattatatcaaatatatagcttcaaattgtgacaggtacataattggcataaagggaaagaatagaatagtataagggagaataacatgagggaaacgtacgttaggtctacctggccaggtagacctaacccaggtagggattattatccccattgtacagatgaggaaactgactcagagtgagatcaataacttgtttaggatcacacacttaggaagtgatggaaccaggatttgaatccaggacccaggcactttgggccctagtccaaagctccttgctcctaattactgagctccaagggcatttgaggcagatggctttggatgctctggtcccacatcaacgcagggcttttcatgtacccttctc

SEQ ID NO: 175868 - DNA, 304 bp, Homo sapiens
  misc_feature (23)..(23): n is a, c, g, or t
ctaacccagctagactaacccanggtagacaacccaggtagacctccaggtagacctaacccaggtagggattattatccccattgtacagatgaggaaactgactcagagtgagatcaataacttgtttaggatcacacacttaggaagtgatggaaccaggatttgaatccaggacccaggcactttgggccctagtccaaagctccttgctcctaattactgagctccaagggcatttgaggcagatggctttggatgctctggtcccacatcaacgcagggcttttcatgtacccttctc

SEQ ID NO: 175869 - DNA, 239 bp, Homo sapiens
tgccggtctgactctagtaggatccccttcgatgtgtgactcagagtgagatcaataacttgtttaggatcacacacttaggaagtgatggaaccaggatttgaatccaggacccaggcactttgggccctagtccaaagctccttgctcctaattactgagctccaagggcatttgaggcagatggctttggatgctctggtcccacatcaacgcagggcttttcatgtacccttctc

SEQ ID NO: 175870 - DNA, 340 bp, Homo sapiens
actctcacacactcatatacactctcccactcagtcccaactcatactcacacacttatacacacacactcatacacacacactcacataatcacacttccacacagtcccccactcttacacactcatacacacactctcccactcagtccccactcacacacactcatacacacactcatacactctcacacacaatcacactcccacacactcagtcccccttacactctcacatactcatacacacactctcccacacacttgcactccacacacttcccactcgcacactcatatacacactcatacactcacacactcatatgcactcccatgt

SEQ ID NO: 175871 - DNA, 867 bp, Homo sapiens
agcgggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgggtcttgcctttgtgctgaccccgcggggctgcggccggcagccactctgcgtctctcacctgccaggcctgcgtggcttagg

SEQ ID NO: 175872 - DNA, 214 bp, Homo sapiens
tggccaatctaattgaaactaagtccaaaagggactttcaaagggaaaagaaactatataaacctgtctagtttgggtggcctaagtctccagtcaggcccaacttctagggttaattatttgaaaccaaaaacgattcttcaactgatttcaggtagataacccaacagcacaaccttccccatttaactatttctcacatactgagttcagg

SEQ ID NO: 175873 - DNA, 247 bp, Homo sapiens
cactgggaaaaaatggaagtttttttcaagaaagagcttagggcgtattgccttttgtcagaggtcaatggtatagagactgtggactaaaatttaggtctgaatatctccagagctcatctgggtggacaaaacacccattttctgctaaaactggatacagtgtattttcctatgacttggtcttgagatttctgcctggggagtggctgtaaactgtagtcctgccctgatgggcctattgaga

SEQ ID NO: 175874 - DNA, 361 bp, Homo sapiens
gagatcaaagggccccccgggttgggtggtccatgagtgagcatgtgataccgcaggagtcttcctcctgccctgacaacttgccttgtactaccagtgctgctcaggatgtctgcagccacgaagcttcattataaatgcaggagctcaggctccaggcccactgaatctgaatctgagtctacagaccgctcctgcactcttagaagtttgagaaacccccctgggctggggtctctttcccatatacagctagggaagcttgctggagggaggactgaaaagaacaagtgcctgatctaccttcccctctgccctttcacaggtgggtggatgcgtgggaagagggtggggcatttcc

SEQ ID NO: 175875 - DNA, 314 bp, Homo sapiens
tggagatgtagggcccagagaggctgaaaagccaacaaggagtctctccgcactcctctgtcacctaagactgaacagggggaactcgcattcctctgccggtacacatttctatttagaacacaaagcaataaacatgatgcatctggccgaagaattgatttgaaaggaagatatgagaaaggattacataataaattaaattgagggtaaaatctcaattaattttagtctgtcaatgaatttttggacagaaccaacatttaatggcacttcctgcatccagtctcctaggtgagttggccttcattctg

SEQ ID NO: 175876 - DNA, 504 bp, Homo sapiens
catcattttctctagctttgaagcaagttgtttttcccctgttctgttatagtcctttttaaggatccagcttttaccttatgttaatcctgtgtagatttttgtcatcccagctatactgtttgggtcttaaaggcaaactttcttgcttagccttttatctgttatcaacaaattcttgtccagtgccttacatgtagtaggtgctcaataaaatacttaagcggcttaaagaacacttagatggctgatgctaaagtagtgtcttttaagaaaattagctatgactggaaataactttctgtatgacacaagatgtttagattggcttttaggatagaagaactcctatgaccaggtgttttgctttctgatgaatggatgctctggcattgcaggttataaaacacatcagtttgatttttggaacgcaaaatgcattcctttatacttgttcataaaattcagtccacatatggggcagtttgattgttgatattctaa

SEQ ID NO: 175877 - DNA, 538 bp, Homo sapiens
gacagtgagtgaattctcatgagagctgatggttttataagtgtctggcatttcccctactggcacttctctctcttgccaccatgtgaagaaggtccttgcttcccctttgccttatgccgtgagtgtatgtttactgaggcctccccagccataaagaaccgtaattcaattaaacctctttactttataaattacccagtcttgtgcagttctttataaaccagtgtgaaaacagactaatacactatgtcattccatctgtcaaaaattcaaggccaggcatgctggctcacacctgtaatcctagtactctgggaggccgaggcgggaggatcacttaagcccagttgtttgagaccagcctggccaacatagtgaaaccccatctctacaaaaaatagaaaaattagccaggcgtggtggcgtgtgcttgtaatcacagctactcaggaggctgaggtgagagaattaccagagcctgggaggcggaggtcgcagtaagccaagatcgcgtcactgcactctagcctgggtg

SEQ ID NO: 175878 - DNA, 208 bp, Homo sapiens
tgtctgcgtgtaaaggcagtgtagatgaagcaggagtggattcagagtgcacaccttgggatcagacagataagagcccaactcctatgtaggaagctgaataatggcctcccaaaaacatcctcatcctaatcccccaaacctcagaatatgttagtttgcacagcaaaaggaactttgcagatgtaattaagttcatgactttgag

SEQ ID NO: 175879 - DNA, 233 bp, Homo sapiens
agaccaagtaaatattgtgataacttcagatctgggaacagtaaacccccaggtcagggaatttgcaaacagtgaattctggaggaagcaaatatgtttgtggaattattctggggagactgcttcattcttaccacaaatgggaaatgactacttctacggcagctgtgatattccattcaggagaggtttgtttcagaggtgtcattgtttgttttagttggcccttatat

SEQ ID NO: 175880 - DNA, 396 bp, Homo sapiens
acacacacatctgcagagtttggcagctcacaatcttcacgtgacagagaggaatgagcctgacactgtggccatggggaggggtgagtgggagcagtggacatgaccatagcatccacatgaccctaaacagtaggtcatctatatgacttcgagggctgagacttccacatgctggtagccagtaatggccaggtgagggaagaatccatgtgagcaacagggttcaggagtccaccatactgtagtgactggaagagctgggcccatcacatgaccataggagcaacatgacaagagaggccacatgacctcaaagttttagagcccttggtgctgatatgaccagtagggccctatcagtagggctcataattgtagtgttcacatgatggt

SEQ ID NO: 175881 - DNA, 326 bp, Homo sapiens
ctttacctgcactttctattaagatgaacatgtattattttaataatcaaagaaaaaaaaaattaggtgccctataaagctcatcacaactgacagggacactctctgtgagaatagctgtcctgggctagtccacagcccttgatgcagtagatgaaatgatgagaacagggatgacttaactactttgggccaggtaaatctaataccctgaactctgacccttgctcctgatgaggcatgaatggtcaacaggcaggtaaggggtacaggaaggttgctaggggtacaggaaggttgctaggggtacaggaaggttgctaggg

SEQ ID NO: 175882 - DNA, 771 bp, Homo sapiens
tgagtacctgagattacaggcgcgcaccaccacgcccggctaatttttttaatttttagtagagatggggtttcaccatattggtcaggctggtctcgaactcctgacctcaaatgatccacccgcctcggcctcccaaagtgccgggattacaggcatgagccactacacccagccaaaaaccttttcctattagaaggatttagcattgattctttcaaaatgatttgtcacgtcatcccttcaaacagcccatccctttaatgcacatcattttttgtgcattaaaaattaagactattgagttcctgctggcaaggattttttaaaaattgagtgattcctaaaattgtgatttgatacaactcttctagaaaacatagcttgtttgaagttttgtttcaatctgttagagagtgatttggtgaaagaaaggtagggctatctgtaggataatggggtattgctttagtttattcccctagggactgctttagtggccttacattctagatatttttccagcaagtgtgagtgagtcatggagtcttgaccaaagcttgatcattgcttattggcaattaataagatcagggtctggatctaccaaaaaacccacagaatctactaattctgttttcttaacttgtgtcctactctcctctatacctcttctcccatttgagagcctctgctcttaaattctctgctatactacctcccttttaatgtccctcagctagaattcagtatgaaaaggaagggatagga

SEQ ID NO: 175883 - DNA, 451 bp, Homo sapiens
tattaagtaggtgttgaggatgtaagggtgaataatgtgttgaagagcttaatttataaaggggaagatataatttaacagtgttaatgtaatatggtaagcagacaacaatatgccatagcaattatgagaacaaagttccaagaacttcacagtgctatctctgttaaaaaaaaaaaaaaagacatcatattcacgtattattaagataaccaagaaaggaagataaatgctttatcttgaaccttactgttgaggatgtaggggtgaataatgtgttgaagagcttaatttataaaggggaagatataatttaacagtgttaatgtaatatggtaagcagacaacaatatgccatagcaattatgagaacaaagttccaagaacttcacagtgctatctctgttaaaaaaaaaaaaggacttctttttcccctctttattgataaagg

SEQ ID NO: 175884 - DNA, 218 bp, Homo sapiens
gttcattgtctggtgaagctgctctctgtttccaagatggcatcgtgatggtgcatcctctggaggggagaaatgctctgtcctcacatggcagaaggcaaaaaggcaaatatgacaaattgtcttcctcaagttttttttataaggacctcttaccccatttataaaggaggagcccttatagcctcatcacctcttaagggcctcacctcttaata

SEQ ID NO: 175885 - DNA, 732 bp, Homo sapiens
ttgcggaagaagaggttcagtgaaagtgacagcagtttaaaatggtccaatggttttaagtccaaagtcctatactatttatgatacatactagatccatttgagttaaggttttgtatctggtgtgaggtagaggtccaaattcatcttttgcatgtgaatatccagttgttccagcagcatttgttgagaccactactttgccttttgaattattctcaaaaaaagcaattgcccatagtgcatgggttagtttgtggtctctctcttttaagtggcaaggtcttgctgtcgactaggctggagtacagtggtgcaatcatagcttactgcaacctcaaactcctgtattaagtgatcctcccacctcaacctcccaagtacctgggaccacaggcacgtgccacccactctcagctggttaaattttcttcttcttcttcttcttttttttctttttgtagagatgaggtttcagtatgttgcccgagctgatctcaaactcctgggctcaagtgatcctcctgccacagcctcccaaagtgctgggattacaggtgtgagtcaccatacctgggctatttttggtttcttaattctgttgatctgtgtctcaaaggccagttccacagtcttgatcacaataggttttcagtaagttttgaaattggggattatgaatttcccagctttgttgttttttaaaattgttgcagctcttctcggttcctt

SEQ ID NO: 175886 - DNA, 462 bp, Homo sapiens
tgagttgaaggtgtgtgtaagaagccattagatctctatttcccacccccaacccggcacagtcaagttttctcaacccgggcagaaaactaatttattttctatagtggctgatccccacttgcttctggactcagggttaccactcgtaggataaggttatcatcctgaaattggggaattcaggcgaagtcctcacggagaatggtaaaactgtttttcccttttcctccactcagctctgacaaccctggctactagctttataccaaccagatggcagactgaaggacatccctctggggatactgcctgggccaaaagaaaatatctgtgtgtattaggaaggggagggaagaatctctcagtgaaacagccctcttagatcatcctacggttaatcccactggtcaaaaagtcatcctctacacacacacacacacacacacacacacacacaca

SEQ ID NO: 175887 - DNA, 632 bp, Homo sapiens
gtaggcagtgatcgagctcggtaccgttggagtgctgttggagatgccaggtcgctgctcccgagattatggaaggagtggttttcaggaatgataaggcctagggcaacttctcgaactatgtgaatttataatgtgcatttccaggggctcttgaagaaatgtagattatggttttagtggtctggagtggacccctgattctgcatttctaacaagctgagatgggaaggggtggaggaagatactgatttttttgtttgtttgtttgtttgtttgtttgaaacggagtctctctgtgtcacccaggctggagtgcagtggtgcagtctcggctcactacaacctctgcctgtcgggttcaagcaattgtcctccctgagcctcccaagtagatggaattacaggcgcctgccaccacgccaggctaatctttgtatttttagtagagatggggcttcaccatgttggccaggctgatctcgaactcctgacttcaggtgatccacccacctcggtctcccaaagtgctgggattacaggcgtgagccactgcatcctgccagatactgatgttattctgattattggcatgataccaaaacctcaataaatgcaacacacaaaaaaga

SEQ ID NO: 175888 - DNA, 508 bp, Homo sapiens
gtcactaaaatgaaaaaatggggtagcggtctctccctccatttcgttccctcatttctctacccattttctgtgcctgtgcaacgtcccctgccttctgctatcggaagtcattcacctgggacgtgctgcccatctccactgccctttcccaggccctctactcagctgaaatgggaagaaaggagacccgggacagagagtacgtattgcgctgtgtgcctggtccatgagggaatcctccacgtcctcatcctcctgcccacctttgctaagaggtgctggtgagcagtcgggaccagctggctggtgagggaggtgtgcgtgagcacacactgcacacattcgtttgaacctgggcttggcaggcagggtggaaagcagtggatcagaggatttgtaagaagatctcagcagggaggcctttaatcttttaggcaactgcttgtacggagaccatgttgtcagagatgaccttggaggcaaaagcagtcagaactattgggag

SEQ ID NO: 175889 - DNA, 354 bp, Homo sapiens
atcttaaatttgttccttgcctcatctagcttctgttggttgccctggcattcctgggcctatgaccacattactccaatctctgccatcattttcatattattttctcttgtctgtgtctgtctccttctcttacaaggatatctgtgccactctcttacaaggatatttgttattggatttagggcctacctggataatccaggatgatcacatctcaagatccttaatttgattatgtctgcaaagaccttttttccccaaataagatacattcacaatccctaattcagggattaggacacaggtgtattttttggggggcccaccatttagccactactggagagtttt

SEQ ID NO: 175890 - DNA, 895 bp, Homo sapiens
gcagagtcagccccagtggtaaaactgaagtcaagggctttgaaggaactctggggaggtggggagggcctgtggaaatggcgggtgacattcaccaagagatagggatgttcagcagaaacagggacacttcagtaaaagacagaatgaagatgctgcaaatgaaaaatacagtatataaatgatctttagatgggtttaacagcagactggacatcacagaggaatggatcagttaacttgaagattggtcactaaagaagatccaaacacagagaggggagggaagacgacagagggtccaagatctgtgggccaaagtcagatggcctaactgggtgtaactggagtcccagagcaggaacaggagagaataaagaagaaatattccaagaccgaatcactaagaactttctgaaattcatgaaagaaaataatccacaaatccaagaatctctgtaactgcaaggaggtgacgtggagaaaaccgtacctgaacacatcctacaggccttaaaggcagctaggatggaaacaggagattcatatagagaagcaacgataggaacaatggctcacttcccaccagaaggccacgcacgcacccacatctgcggtgctgaagggaaaaggaaggtcaacttagaagttcacatacattgaaatattctttaggctggtcacaggggctcacacctgtaatcccagcactttgggaggctgatgcaggtggatcacctgagatcaggagtttgagaccagcctggccaacacggagaaaccccatctctactaaaagtacaaaaattagccaggcgtggtggcgcatgcctgtaatcccagctacttgggaggctgagacaagagacttacttgaacctgggaggggaaggtt

SEQ ID NO: 175891 - DNA, 120 bp, Homo sapiens
caccctgccagtacagagcctttgaagacattagaaaatgtgtgcctttctggatggacacagtccctggcttggtgagtggaccgtgcatgggacttcagctcttatgtgccaccttag

SEQ ID NO: 175892 - DNA, 1826 bp, Homo sapiens
  misc_feature (1432)..(1432): n is a, c, g, or t
  misc_feature (1438)..(1438): n is a, c, g, or t
  misc_feature (1529)..(1529): n is a, c, g, or t
agaaggtgtcttgcttacccttcgcccttctccgtgattgtaaatttcctgaggcctccccagtcacgctgaactagtcttgctttctcacccaatctggagtagagtggtacagtcttggctcactgcaacctccacttcccgggttcaagcaattctcctgcctcagcctcctgagtagctgggattgcaggcgcccaccaacataccaggctcagctcatcatgaagaatgtccatgtgactttggttaataaaataatagatccagtggactgtagtctgtttaactgagacctcacacataatgtcatggttgacagttactggttgaaggaaatccatgttgggcttctgtggatgctggattctttccttctgagaagaaatataacacactgactttgaggtgatggtggagaaaaagtacaagcagaagacttttcccaacttctccatagcctacatgcgtgtggaaacacttcaggttaaccacttgaagcttcagagactgcagtgaggccctggcataggaacatgctcatcacgggcatgttcacagagcaaagcagccagcgtgactgcagcacagagtaggaagggtgtggaaggagatgagagagaatgaagagggaatctttgaacttgattaccaaggagatgggatgataaatccatccagccactccaagaagccaagttaagggatggaagcactgatgaagagcacagacagaatcaagtgtacatgcagaacatatggtaaccatataaagggatgatgtcaaaattctcagcctccttgctcttcagtatcttcttcccctttacctcgtctggatggtgtataatgaagaggcacctagcggtgcctcctgcctctagagtaagattcaagggaggatatataggctcctccatagggtcaagaggttttcaaaggctgtgttgtcccatccagctaccaaaacaagagacaaaattgtgacctggagttgaaactctagtgagtgataaagaggggaagtttcctaaagcagaagttctcagtctgggggctatctgtgtgttgtgtactgaattttgtgtcctcccaaaattcagacgttgaagccctagtccccattgtggttgtatttggaggtggggctttgggagatgattagaattagattagttcatgaaggtgaagcccttctgatgggattagtacccatacaagaagagacacaagatccctctaccaattatgctagctctcctctctttctctctccaccgtctgggatacttcaggaagatgtctgtctgcaaaccaggaagaggtccctcaagcactaaatctgctggcaccttgatcttgggcttcccagcctttaggactgtgagaaatctttgctgtttaagcaatcccatctatggtattttgttanagcagnccaagctgactaagacactgtggataccttgcatgcctgggaggcttgcacatccttggacattataagtaatatttttctgaaaaggggncataactctcatcggagagtcaaaagaccaagtctatgactcccaaaagattatataccactgacggagtggcccttgtgttcttatcctgtagaaccacaagaaacttgaggattggggatcctagtcctggccttcattccgtacttgcatgaccaacatctaagagtactaacaaatatgatgaaataagaaagattcaagaggatacacatattttctttgtccaatgttgctaatatccacctgagagtttattatccataataaaatgtggaatccagtctgtacaccatg

SEQ ID NO: 175893 - DNA, 228 bp, Homo sapiens
caccatgcctggccgaatttaatattttaactaatagtgtccttctaaattgaattctgatcctaattgtagtacttatatttattgtattatcttaatgagtatataaataccactgtgggttctacttaatttctctagtatttttagttcacaaatctctgtagtaatattatccatatattcacagtatgaccaaaacaaaagattctaaaagccagtcatggt

SEQ ID NO: 175894 - DNA, 251 bp, Homo sapiens
gctgtccagtgcacttagaataaaatccaacttgtttcctaaaatataatgctccaggtgacttggccattgcaactgtagcctgtgctcctgccgtgcctcctacctctgccatccagctgctgtgccacaaccacactgaccctcttgtacctgcaacatgccagctaaatatgttcccacctcagcctccaagtcagctggtcaactgcttggaatgctgtttccttctaattttcttgttgcgggtt

SEQ ID NO: 175895 - DNA, 441 bp, Homo sapiens
agtattctgtgcagtgtctattcttccctgtattccttttgattttgttttcattcctctgattttattttcttccagcttacatttcatctctttctgagttcttacatttctctgctttgtagcttttcctcaaagatatggttacttcattaagtatttcccaatttacagcaaaatgtatatttgaaaatttcatcttttccaggccaacatggtttctggagcatgtatcctatctatgttttgctgttcttcattttttcctataaattgagcttgtgctagttccctttatactattcatcactgaataagtaagtttcttagattagctatgtgggagacatgaagatggggtgagcaaggctgttttctgaaggctggacggttttcataacaaaaggccctcttttcttctgctactgcacagatagtcta

SEQ ID NO: 175896 - DNA, 533 bp, Homo sapiens
cagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgttctgggactctgcatttcaagtaagctttctagtgattctagtgttgacccaaggctggagggcctctgttttaatgtgagctctttagctgtccccttgaattcccagaaagcgtggcagggcctgcctagttctgggtgctcatcccgaccccgcctgagggtttacagtgtgtgaattactgcagtaggaaatatggagaagtgattctcctccctttactacggtatgggtgaactctttagttttccctgatgatgttaagtgaacgtgcccagtggggtacctgtcacatatacagggggtgtatgtgagtgcttctctttccccgggtgctctccctaatagcgcatcagtggttatctccaggcagagatgtaggccaagcagtcgtcg

SEQ ID NO: 175897 - DNA, 717 bp, Homo sapiens
attaggtaccagaaattttagaaagaccacattctatgtgataactccttctaaaaactgataaataatgccttggtttatacggtatttttccttagggacctctcagattcttctttttcttttcattttcccccctctatcctttctaattttatgaagaaagttttacagtattctagaggtcaaaatacagacacgttagattctgcacttcttctttgatggggctaagacttaggaattgatccaaagaaccagagaagtaaatctgctacaattcaaaaattcaaattcttattactcccaagcactgttttattaaagtcgcaatggaaaccaaaaaagccagatggaggtcattttgtctcactgatggtaaagcagcagcagtatctaatgagtcatactacaataaaactacgggcggcattgggatccaaagatataccggttctcaaatcacaagcatctctttagagtaggatttgggggtaaagataagaatggccatttttttaaaagagttaatcagctttagaaagccgatgctgcaagggcattagcaggaacatggtttgaatacaaggttcacagagggaatctgtataagaatgggtcgggagtggcagaatgggactaattaataagggctgacccagaataaaatctgtgctataagaacttaaatctgtacaaacatatgggcaggaatga

SEQ ID NO: 175898 - DNA, 354 bp, Homo sapiens
ggaaacaacagacttacaagttagtaacaataatacaaggtgataaggtcacagatacttactgtgtacctgctatcctagtcactcagaacacaaagactgtcaattccaaagactgtccatgcccttaaggaatgcattgtctggaagaaatgacagatacataaataattacagtgcagtctggtaagtgctgcaatcagaataagacagccacaattaacaggagaggaactaatatttcaccactatcactggaaaaacaattcagagaattgaatcctaccattcgttacataacttattactcagaataaattatagtttttcttttacttagttttataaatctga

SEQ ID NO: 175899 - DNA, 127 bp, Homo sapiens
tgctggactgcgggctggcggcgctcacccagctcctcacccgtcccgcatcttcctgtttttcttccctttctggttgggcagcaagagttgagaggaggcagatggcttccatcccagaaatcgc

SEQ ID NO: 175900 - DNA, 382 bp, Homo sapiens
tcagctatcattagtgtatgttatgtgtgcccaagacaattcttccaatgtggcccagggaagccaaaagattggacacccctgcatatcattgttcctatgggaggtatttgtacaaattcatacacacaaaagattatttcattctcaacctacatcaagaaaaagataatggctttcatactttcacaaattaacttctgaaacaaagctagggattgcatgcaatttcttctgaattcagcagaatctatggaggactaaaaaaaacctacaaattcctttttaagtggaacggcatgaaaggaaacaacttggttgcagtaagaggtctagggttttcagaactgacacaagtgaaatcttagtgcttttcatctgt

SEQ ID NO: 175901 - DNA, 166 bp, Homo sapiens
ccagcgaatttgtggtaatttattatatagcaatagacaactaatacaatcaatccaccatagattaccataagtgagatccaaatctcctgagaattagtcttggcaatttgaaagggtagaaggaggcagaaactagctcactggatagcaaagggtgtaagta

SEQ ID NO: 175902 - DNA, 309 bp, Homo sapiens
aacccaagctacaccccactgggtctgggatagttttttacatagccatagaaggctagaacatgcaccatcttgaactgggcttgtttactaggctcagccaatggaaattaggcttgcccttctctggcctggtcatctcgtgccttattcagtatttgcgtcctcagaaactcaactccacaggagtaaggacaatgaataaccctggaaccccaagagttagggaccaggactgcaaagtgtagtgactgatcaagactgggagaaggagagcactagttgatcctcttagttttcatcattgac

SEQ ID NO: 175903 - DNA, 577 bp, Homo sapiens
tgccctcacagacaagacaggtcccccaaatgagagatgcaggcagggtgtaaagtaacaagagacggtaatgaccatggttacatggggggcacatgcttcatctagccaccaacctccagataatggccactgtgtaggaggtatgatgcagttatgccaaatctggtatttttgttttctgagagagaagccagaaatctggatttttgggtaaaaatctccaaaatgttaaatatcagtaactaattaaaacaaaatactgtacagccaaacaaagcatattcttgtgccagattttccctatggcctaccattttgtaacttctgatgtacagaaattctaagcttattggacaaaattaataccttgtcataaatataagaggaacaaaattcacatcaataatagtgtataggacctcatgaatgtggcagcaatgtaaatggtgtgtggagaccaattaaaataatttaaggtaacatatttagtgagtcacattatttcctggctcttaagtaaatgtatttgtaacttggatgccaatgaattgacttattctaaaacttctcacac

SEQ ID NO: 175904 - DNA, 210 bp, Homo sapiens
caccgtgcccggcctcataactgagcttctaaccctcaagaatctggggttattcttggttacaagcgtacactagccttctgctggggtactgagctgtcagaaacaatgagaactgtgtttacaattgagcagatgagggtccagaatataggaataggacctgctcaaaggcccagggcaagaaagaccacaatattctccttgggg

SEQ ID NO: 175905 - DNA, 954 bp, Homo sapiens
ggggcatgccaggttgggggtggggactgcaatgctggatagcatcaccaggcaggtcgccctgagaaggtgacctctgaggtgagggagggacttttattagttgaaaatccctttttcttttgtttaaaaattcattggttaaaaacattacattctataaggtgttaattataaacagaactccacatacatcaccctgtctaggctttcataataagattttacaatctagtaaatttagaaatgatctaaaacagagctaatgggaagccactgtctcatgacagtgggcagatctgtatttctttgcaaggtaaacattttttttcttgatcatcacaattcaagtttgttttagatgctgattttatttacttactgtggaacatcatctatattcttttaacatcaataaaataatttatctcttttaagaaccaatatgttccagccacagttctaaatactcaaattatctcatgcaaatcatcacgacaactctgtgaggtaggtacattgattgtccagatttcagagataaggctgggttacagagattaagtaacttacccgaagtcacttagagggtaaataggacaactgggatttaagaccaggcctttctcaaaacacaaagtccatgatcttaaccacaacactgcattgcctcaaagataagagcggttatgtcatacagcatttcaatatgcctgcttactaactgttcaaatataaacttaataagaaagtgacctaacaaaagttttttcttctaattcaaacattaagcaatatgaactcataggagcaaaatacagctcctatttttaaagaccatcttgggaatctattacataaacactgagtagtgatgccagggtctttacgatagggaaaaggaaataaaatgtactgataaaagtaaaccacatccttctgtctctaagaatg

SEQ ID NO: 175906 - DNA, 190 bp, Homo sapiens
aaaataatttcaaaggaggtccaatatataatatacttagcctagctttaagagtggtagcagagggaaccactgtttccacatcagcttcctgaagtccagtgttaaaagattgattaaatgaaatctgttaggtaaaatgcatttcagttcataaaagtcatgaggcttcttgaataggcccttagaa

SEQ ID NO: 175907 - DNA, 486 bp, Homo sapiens
taagctatgtggtggatgtgtgtctcctccaaatctcattgtgaagtatgatcccactgttggaaattcaaggaacgcagcattgtcaaaaccatctggaaaagtaagaaccaatttgggtcactcacacgtcccagtttcaaagccacagtaatcagggtggcatggtgctggcttaaggacggacacacggaaaaacggaacagagtagggtccagagacaaaccttcacacttgtagtccgttgattttcagcaagggtgatgcacattcaatgggagagaaagtctatttgacaaacggtggggggtcaactgcatagtcatgtgcaaaagcatggatttatgttccacctcacaccagatgcagaaattaacttagatgaatcaatgacctaaacctcatagaaaacacagaggcagccatcatcaggaccttggattaggtaatggttcattagcaatgacatcaaaagcacaagctaca

SEQ ID NO: 175908 - DNA, 555 bp, Homo sapiens
agaatccgactatcttcaaaacatcagtaaagccagtcactgtctaatatttccatatgggtctttcccagatgctcagggaaggggtacaagagggtcctttagctctttagttactccattctgctttatctgctaacatacctcagaggaataagatgactccaaccccacagtaagagaaggattttattcaacccaaacaaaaccatgaggggcttccctcagtggatgtgcagtagtctgtcctaagtgctggtcagattgccatgtgttaacagtaaaacagcatttttccccctaataggttaaatttttacaaaaaccaaagctctaaagcaagcatggtccagtgacaaactcattatttttatcattacaagtgtggttactgtcactattatcaatgtttaaatatgatggaactaacacagtacagagctcagtggaaggaaaagtccatctcagtgaactgtgctatagtagtttggatgtatacactatgcatcttaacctcaattccttggtatccagctgtatgttacaagaggaact

SEQ ID NO: 175909 - DNA, 684 bp, Homo sapiens
gtcacccaggctggagtgcagtggtgtgatgttggctcactgcaacctctgcctcccaggttcaagcgattctcctgcaacagcttcccgagcagctgggactgtaggcgctttaagtgcttttaatgtattcataaagttgtacagctatcacaactctctaattctagaacatgtttatcatttcaaaaagaaactccatacttactagcagttactccccatttcccccttttcccagcccctggcaaccactagtctattctctgtctctatggactagcatatgccaaataccagaaaaaacagaatcatatgtgaccttttgtgtttggcttcatttatttaccatgttgtcctgattcatccatgttgtatcttgtctcagcacttcattgctttatatgcctgaatcccattgcatgagtatactgttttgtttatccatttattagttgatggatatttgagttgtgttcattttttgactatcattaataatgtactgtgatgagattcatgtactcgtttttgtgtggacgtatttttacaattttctttatgtatctaggagtgggcgtatggtaaatctatgtttaaatttttgaaaaacttcaaaactgtgttccaaagtctctgtaccattttatattattaccagcagcgtacggaggttccattttt

SEQ ID NO: 175910 - DNA, 389 bp, Homo sapiens
cttaaacccagccacatcaatagtaacagtaaattaaaatgggctaaaaattccaattaaaaaaacccattagactggataacaagaagacccaactacatctacattctgtgtacaagaaactcaccttaaacataaacacacagaccagtaaaaaatacaagaaaacaacagagcaagctgacactggtcatgacaaagctgagtgactctgttagcaccaatgagaccgcgtcaactttaagacaatgagcatcgctagagagaaaaagggactgctgtctgtgctttgtgggtcacctccatcacaaaccatgactcccgtactcccccgaaccctgtaccccatgctaagtcactgaaataaatgactcatttaagcctcacaa

SEQ ID NO: 175911 - DNA, 744 bp, Homo sapiens
tcctgcctcagccccccgaatagctgggaccacaggcgcacgccaccatgcccagctaatttttgtattttttagtagatatgaggtttcaccatattggccaggctggtctcaaactcctgacttcatgatccgcccacctcggcctcccaaagtgctgggattacaggtgtgagccaccgtgcccagcctgttcctgttttaaggtgaagaaacaatggcttagggtaaactgatacatctgaagtcacaacaacaagaattagagctgagacttaactgtaggtcttttggttctgagttcaatgattctggtgggaaagagtatcctctgagaggggatgctaaaatgacttccctgtgggaatgaaggtaccaagagaagcaaggaaaacagaagcccctttatagagagaaagagggagtcctctgtgaacatcaagtccctctcatttttccctccccattcattttcctggattatcctactaatccttaattttatttgagatgagacctttacacagaagcctttccagaccatccaaggttaagtgcccttccataagactcaagttttaacattattatagtgtttatcactctctgtcttagtctgtttgggctgctataccaaaatgttataaactgggtcatctataaacaacagaaatttatttctcacagttcttgaggctgggaagtccaagatcaaggtagcagcagacttgttgtctggtgagg

SEQ ID NO: 175912 - DNA, 309 bp, Homo sapiens
tttttaaaatatctaattagactattgtttatttaatttccatagaaaatgggaaattcctgatttgaatactctatcaagcatagtttagtctctacaaatataagactcacaattactctttttaaaaatataaaatctgaagacttcataatggcctgccaaaaaggactttgtttttcaagggagctaaataacatttaaattatgcacttaggagtattttaaacccctggaaaattttaaatattataattaagaaaccattcttttatagcatgtcactttgcccaatgttggggccctata

SEQ ID NO: 175913 - DNA, 791 bp, Homo sapiens
caaatggtatacagaaaaggtaagtctatctcccatctcttttcccctgttaccacctgctcattcacccctacctccttcatttgtcattactgggttaatatcctttaaaaactaacaggacctccgcttctgggaagatggagtagatgtacttttctctattctttctgtcaagtacaactaaaaaccctggatattacataaattataaataatttagtaagtatgtaatatataaaaagcctcttaaaaggcagagagaagaaggcagaccagctaaggacctcaggacccaagaaatggtgcagtgatgagttctctaggttttctttttgtttcttatgtcccagacttggagttgaagcagccggcaacccagaaataccagtaagctcagacgcaaaaagccccaacaaaaatttgctctctctagccaaatgaccagtgcagtaggacagaacaagtgggtttgttccagggatataaggatggttcattatttgaaaattaatctcatccaccaaattaatgaactaaaagaagaaaacttacatgatgctctctatcaatgcagaagatgcaaaatttagcacacatttatgattttaaaaatctcaggaaaaatagacatagagggggattttcctgaacttgataaagggtaaacaccataagccttcagctaacatacttaagggtgagactgaatgctttgtccctaagatggggaacaaaccaaggatattagttctcaccgcttatccaacatagtgctgtaattttctagc

SEQ ID NO: 175914 - DNA, 310 bp, Homo sapiens
tgtggtgccggcatctgcttctggtgagggcctcaaaaagcttaaaatcatggtgttttattttttgctactgaaattaacttaattatttttcagaagaataacagtatactttcctgtattctgataatcgatgtgatattttaagtagcttacaattacattgacaaggcttctgctttctcacacttagtagctgggactgtcaaacagatgcagaacgaacaggtgaataatttgtttagttagttatttttcatttccttttcaactagattgaaaagtagggatatataatcctacattttag

SEQ ID NO: 175915 - DNA, 470 bp, Homo sapiens
gatatgtcaggaacagccaagagtggcaccaagataaaatatgacagtagcgactgccagcttcagcaggcacaattcatactgagtccaaagctctatcctcacacagactagctctgcagaggcacactcctcttagagcacaacaggcaaagtcatagctagctctgagtcatccaaatgcttcaacatgactatcctacggttccttcatccagaaaccaaatctgaccagtacacacttagagaagtccagaaagccaattttcccaactatatttaagaaagtctgtctgctccatgcttccttgttttctcagcagaatatctcattctcttacttgcagagataaagacagagtggaggctctcccttcctccatctaaccaaacaaaattcaactcatattggggtgaatgagatgttatgcctaatgggaagaaaaagaagaggaaaaaactgcattcaa

SEQ ID NO: 175916 - DNA, 257 bp, Homo sapiens
tgaagagaatatggccaacaggaagctaggtcagtctcctaggggttcagaatcagctgtcacaccaatgtcaggaacttctgagataaagactgggagaactttatagaatagaatgcgagtttgcccagagggtggattgctattagagaagcaacccacagataccagactgtacttctggtgccattttccccttcttagtccacttgatagcttaaccaaccctctgcctttgtaccacttgtcccatcaaa

SEQ ID NO: 175917 - DNA, 454 bp, Homo sapiens
gagttctgtattcctttatggccaataagagctgaaactagagattcagagtttcataaatgatctatttttaattttaattctttaagatctgaatactatatatgtaaagatatgctagggtgatttgaataacacgataaaataacagccactaatttagagtaaggcagagagaagaatccattctacgtttaattttatagttaaaatagcctataatgtttaaaaaataaagggttctataaatcaattattataaaagaaagcttaaccacaccaataggcaactacttgcctcacagaagcgaggcctgaattggctgcttctgaaaatatcacactaaaatgccaaaggtaaccaactcatcagtccccgtccccacagctagtcccagctgacctttcctccctgagtctctaattttatctcagcacttctgtgccttgctat

SEQ ID NO: 175918 - DNA, 588 bp, Homo sapiens
tactcagctggtaccaccagagtgactgcagctgctcttggatcaaagatacaaacatttttaattaactccatgcagatctgattccttctttccaagttacaactctttctttctttgaagatgcttagataattagactttttttctaaaaaaaatatttttctggggtttatatttgctttccttgaaagatgtttgttaggaaatcagttctttactacagaaatgggaattatgcattgatttaaaaaatatatatctaaaggcaatatggtctcactgtaaaagagttttaggctatttgaatgtgatatttaaatataactcaatttttgttgtaaaacatttctaggattgcttaagtattcccgatagaggccaatgctatagcaaatgaggtgtttacctaaaacaaccatctccttaatactggtggttgttcaagtaattttttcaaagacatacatagttttataatgaagaaaataaacatgatgtgtcctgatttttctccatagctttatgtcagcctcttcttacttgaagttacatttagtaatttaaaataataataaaatccattta

SEQ ID NO: 175919 - DNA, 471 bp, Homo sapiens
tttcagtgaggtgtctgccatcatgttatctgcttccactgtgtcagcattttaacgtcaaattatctggcgaatttgagcttggttgtagctcataatggtctttagattcttttctcctaatttaaaaatatacgtattttacacaatttctctttattaaaaaaatatgaacaggtgatgcagtctcctttggaaagccctctcaatcccattcctttccccaggggtcaccgtgttatcattttgatgtatatcttttaaaatattttcctgaaaaaataaagaaacaaaaatgcatatttggcccagtgccatggctcacgcctgttatcccagccagttgggaggctgaggtgagtagatcccttgagcctaggagttcaagaccagccacctgggcaacacagtaaaaccctgtctctacaaaaaatataaaaattaggcgagcgtggtgacatgcatttgtcc

SEQ ID NO: 175920 - DNA, 467 bp, Homo sapiens
aagaagccatacatgtagcaaaatagagctagttagaacacagcagtcttggaagcaaggagatctaaagaagatgtttttaaagtttctactgtgaagtctttaatgcagacaaaggtaaacaagctagcatgctgaactcccatgtacccatcaccagcttcagcactgaccaactcaagcccatctggtttcctctatcccccttcccctccaccttggcgcccttcaggtgcgggcagccaagaagttgtgtatggtctttcggcgtgtgcaacgccgaatctccaaaccaaatgtcctcagggggggaaaattgccccagttgagaaccagtgctctagtcataaaagccaagaagagatatgaaaatgttcctaattgaagaagatgaaagagatataacaactaaacgcaatacttgatcctggactgaatcctgtcctggagggtaaagaatgctataa

SEQ ID NO: 175921 - DNA, 1037 bp, Homo sapiens
agacaggagaatcgcttgaacccaggaggcggaggttgcagtgagctgagatcgcgcctctgcactctagcctgggcaacaagggcgaaacgccatctcaaaaaaaaaaggtttagtaacttgctcaagatcaccaacaggtgttgcatccaggactggagcccacctagctggattcttgcatctacactcatactagctgtagcctggtctggctctgtcctggcttgttaatccatctcagggccccagagtgccctgttgacagctgggcttgagagttaccatttattcttaaaatgggtgaacctgatgtggatctcagggagagactttgctaaggagccttaaccagagaagccggtgagatcctcatggcagcttaggagattgtttgtctttgtatcactaacagtgagaacaataactggcacctggtgataatggtgataaataatcatgattgtctttaaagatccttatccattgtctgtcacgtgccaaacactattgctcatcatatttttatggcattttgcaaatgaggaaactgaggccgagagacaagtcaagtgacaagctcatttttccactatggaaaaaaatgtgtatgtgtttgttgttccacccaaacatgggattgcataccacacgattcacgattccctgtagtagataagctctccataaagatcattagaggacactgagtcaagtctggctttgtcactttaaaatagtaagtgggactgggtgcagtggctgacacctgtaattccagcactttgggaggccaaggtgggtggatcacctgaggtcagaagttcaagaccaccctggtcaacatggtgaaacaccatctctactaaatatacaaaaaaattagccaggcgtggtagcaggcgcctgtaatcccagctactcgggaggctgaggcaggagagtcgcttgaacctgggagacggaggttgcagtgagtcgagattgtgctattgcactccagcctgggcaacaagagcaaaacttcgtctcaaaaa

SEQ ID NO: 175922 - DNA, 292 bp, Homo sapiens
cccttcgtttttttgcatcaggtcactacagttcatctggagtttaaaatcattatcactgtcagttaaaagctttgcttgaaggtgacaaagttcttcttggagttgggctgccccatgctgcacccactgtggtcgccagctgctctttccatttttttcttccttccttccttccttccttccttccttccttcctgcttctgccggttccttgtcttcctgcttctgcctcctgcttgcttcctgcttctgccgcttcctgcttcctgcttctgccgcttcctgcttc

SEQ ID NO: 175923 - DNA, 523 bp, Homo sapiens
gcatcctggagccacattctggctctgatcccagtctgagacccttgggctttggcttctgccaggagtttctttggcaaggagatggaggcccagaggaggtggaggcccctcctctctggtcctgccatggctgctcctctctgctgagggctatggggctctagggagagtctgggtcacccctgggatttctccactgctcagtgtgaggcctaaaccatggggtcccagctcagccttcctcactggctctcaactccaccccacccctctattcaggcagggggacatggctctggagtgaagtggggtggggcgtgccatgagctgtgtttctacaggtgggatatgaaggaagacaaggaggagctggaaggtcaggaggtaggtacttgggtataggatggggcaggctggggacgcgagccctggattcatcagccaccggggctattctcttgtttcagggaagccaaagcaccagagagactcccagtgaggaggagcaagcccagaagca

SEQ ID NO: 175924 - DNA, 680 bp, Homo sapiens
agcgattctcctgcctcagcctcccaagtagctgggattacaggcgcccgccaccacgcctagccaatttttgtatttttagtagagacaaggtttcaccacattggtcaggctggtctcgaactcctgacctcaggtgatccacccgcctcgtcctcttaaagtgctgggattacaggcatgagccaccgcacccagcctcacggtaaatggctttctgacctcaacctatgctgaattctaaaatatttacatgcaaatatttacatggctggaagccccacctctggagccccagagacattttctaccatggaaaatgtcaggctgaggcagccagagatgcaacccctccaaagtcagctccagctctccggggagacaggtgcgctttctagcggggagtgagctgctgtgggcagctgtctccactgtgctcaagccaaaactcagatgtgcagtgctggctaacttcagccctgcgcctctcccacttgattaagagaccagagaaagttctcaaaagtgattcccattttgcactctgccctattaaactaggaccttcccataaatcgcttacaggaagaaatctatgacagtctcctctctgagtggctatgatggatctcatgagaagtgaagctacggagattctgccaccacctacgcgaaaccac

SEQ ID NO: 175925 - DNA, 291 bp, Homo sapiens
tgacgacggcaggaatcgagctcggtacctgttggagtgttgttgtgtggatccaaggtgataatcattcatgagtgcaataattgccatacttgtcataataatccagcaaccattgtcctgcagtcgtccaacatgcttcatccatgtaaagggcttcgcccagtgcctgaaatctatgactctcattattatgattctctatcagggataatctcagagagtcagatgatcagttaagaggtcagtgatttaggccaggcatggtggctcacgccggtaatcccagcg

SEQ ID NO: 175926 - DNA, 525 bp, Homo sapiens
tctcatgtacctcataaatacgtacacctactacatacccacaacattttttttttaatttttgaatggccaacttagtagaaaactaacgaggaaaacccagtcagaaatttaaaagagagatcctataactgaaatagtaatagaagggccaaataagcactccacacatccctggctgactgggaaactaggcacatgtgcagggaagaccagtgagggcctggtggaaggtgaaattgaaggtggactgagaactggctataactttgaaggtgctcccaacccacacacagagcaactggcagagggtagaagccctatagactcaaggtgtttaagcacaagctctgacctaatcactgattgagcactaagctatgtagacacagggacaaccagcaggaagtgaggctaataactacaaataagagttaaaaaactgagtggagacatcgacagctacataccacagagaagatctattcggcagtataagttaggacagttacttttgattttaaa

SEQ ID NO: 175927 - DNA, 463 bp, Homo sapiens
gggtttactatactattttatctaatctgcacaggatgaagctttccataatttttcttaaaacagtatcttttaaagattttttttcaatatattaagaatacattctccaatttggttttttcttcagaggttgagtatctaaatcaacctatttgttgttgggttatgtttttttgaagacatccaggccaaaaggcagccctgatgatatttggaattatatttgaaaaagtacatgaaatgataatcaggatttaatagagtcctgagaactgattctattttatttattccagcatagctgaactaagaaggtaggatttcagcagcttcttgaaggaaggatgcaagtcctatttataataatttgccttcctatttgtccattgcactcctagctaataccattatcaatttcatttagaaaacatatattctggtaatttttaaaatacaagca

SEQ ID NO: 175928 - DNA, 2546 bp, Homo sapiens
  misc_feature (21)..(21): n is a, c, g, or t
  misc_feature (40)..(40): n is a, c, g, or t
  misc_feature (42)..(44): n is a, c, g, or t
  misc_feature (88)..(88): n is a, c, g, or t
  misc_feature (119)..(121): n is a, c, g, or t
  misc_feature (168)..(168): n is a, c, g, or t
  misc_feature (355)..(355): n is a, c, g, or t
  misc_feature (419)..(419): n is a, c, g, or t
  misc_feature (424)..(424): n is a, c, g, or t
  misc_feature (479)..(479): n is a, c, g, or t
  misc_feature (494)..(496): n is a, c, g, or t
  misc_feature (593)..(593): n is a, c, g, or t
  misc_feature (611)..(611): n is a, c, g, or t
  misc_feature (645)..(645): n is a, c, g, or t
  misc_feature (1221)..(1221): n is a, c, g, or t
  misc_feature (1361)..(1361): n is a, c, g, or t
  misc_feature (2064)..(2064): n is a, c, g, or t
atggagagaggaacgggaganctagaggggcggaagggangnnnggagggaggcagggaggcagggaggcagggaggaacggaggganagacagagcgacgcagggactgggggcgggnnngagggagccggggacggggggaggaaggcagggaggaaaagcggtcntcggcctccgggagtagcgggacccccgcctccgggaaaacggtcagcgtccggcgcgggctgagggctgggcccacagccgccgcgccggccggcggggcaccacccattcgccccggttccggggcccagggagtgggcggtttcctccgggacaaaagaccgggactcgggttgccgtcgggtnttcacccgcgcggttcacagaccgcacatccccaggctgagccctgcaacgcggcgcgaggccnacagncccggccacggaggagccacacgcaggacgacggaggcgtgattttggtttccgngtggctttgccctcnnnaaggcggcctgttgctcacgtctctccggcccccgaaaggctggccatgccgactgtttgctcccggagctctgcggcacccggaaacatgcagggnagggtgcaagcccggcanggtgccttcgctctccttgccaggttccaaaccngccacactgcagactccccacgttgccgcacgcgggaatccatcgtcaggccatcacgccggggaggcatctcctctctggggtctcgctctggtcttctacgtggaaatgaacgagagccacacgcctgcgtgtgcgagaccgtcccggcaacggcgacgcccacaggcattgcctccttcacggagagagggcctggcacactcaagactcccacggaggttcagttccacactcccctccaccctcccaggctggtttctccctgctgccgacgcgtgggagcccagagagcggcttcccgttcccgcgggatccctggagaggtccggagagccggcccccgaaacgcgcccccctcccccctcccccctctcccccttcctcttcgtctctccggccccaccaccaccaccgccaccacgcctcccccaccaccccccccccccaccaccaccaccaccaccaccccgccggccggccccaggcctcgacgccctgggtcccttccggggtggggcgggctgtcccaggggggctcaccgccattcatgaaggggtggagcctgcctgccngtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattncggccggggctcaccgcgatggccctcccgacaccttcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagaggggntctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcaggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctag

SEQ ID NO: 175929 - DNA, 1101 bp, Homo sapiens
gaacaagagaatcttgcccaggctccaatgctgctttaggtgacctttaagatcccttcttactccaagacattcatattgaagcccttcacgtaggcataacatgtcatagagtattctctccaaaaggaagaatacaattggcaagtttagcttgctcattcaaaccattatctcctttataaccaaagaacaacttattttagtgagggtcggggtggaaagtaggtatcattagataactgtactccctgaagtgttaagttttcttagatgtaagtttttctctatcttgttttttaaatgggcttcacagaatcaagaaacaccatgattaacaaaggaaaagatgtttctttagggcagaacttcagagcctttcattgtgaatcccgaaaaggggcaaaatataaggtaccatcctcaaacttctttgaccattatatgtacttgtaaagatcaggggttctaccaaacacactctgggaaataatgtgatggagatcagtcctagtcaatctgctgaagttcatagcactgcaaagcaggctcatcatgattaagagaaactaggatcagagacgacgagagagagagagtgagtgagtcagctgggtcctgctttctctggttaacatgccacccaactttctctcttggaaagagcagggacattcagtgtacgcacttaactttcttgagtataagtggaagaaaacgaggtaaaattcaatggccttaaataaggaaaagccataatacatcagcagcagtaagcagaatttctattcatatataagagagggtatataacacaactggtaaatcactgcaaatgtgccacaattagacacctgccaagataaaagggttatatatatattagatgtagattgcctttcttaaggatgttgtccatttcagtataaaagatatgatgcttacaatttcttttactggtatttaggaaaaggaaatatttgaaatataaattcgtgtgccccaaactaatacaactcaattcatttaaattcacagatgaatcatatattgaccaagtgaccaaacgtaaagaaattaaagtttagatttttccttttg

SEQ ID NO: 175930 - DNA, 599 bp, Homo sapiens
cccctccggtggcgaagcactgctctgcgcagtcaagtagcttctgattgggtcaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtaaccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatc

SEQ ID NO: 175931 - DNA, 730 bp, Homo sapiens
aaaaaaaaaaaaaaaaaaaaagtgtaggttagcaaaagtgcctacagttcaatgcttccatgctaaacgttgtatttcttccggtctcatttgtgatgagagtcataagattttgagaaatacaaaacctttccagctttataggatgataatggcttgccactcaagtagcttctgattgggtcaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtaaccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatc

SEQ ID NO: 175932 - DNA, 416 bp, Homo sapiens
gaggccctttccatattccgcttcattctcccctcctggcgtgcctcaaggaacgaccactgtccccaggttacaggtgcttcttcaccccaacaaggctcaatcaagtgtgttcttctctgggaagctgcagacatctgaccccaggccacagagtcatacccagtctggctcccacagccctcccaggctgtctggtgtcagtgcagtgctgtggatgggaacacacctctaccatgttgagctgctctgaggtttaaatgcgttactgctaattgggatcttggaacaactcctggtgcatagacacacacaggacagactggaataaatactggtggtttatcacaggaaggctggcctcagcttgggagagtaagcgtgcatgcatacacagccagctgatttattgtgac

SEQ ID NO: 175933 - DNA, 665 bp, Homo sapiens
tcctgaccttgtgatccacctgccttggcctcccaaagtgctggggttacaggcatgagccaccatgcctggccctggccagctatttattactaattcaattttggagcttgttactggtctattcagggattcaatttcttatttgttcagtctttgcaggatgtatcattgttccaaggttacaatcctcaagcttggccctgacgaactctctaattatattcatgtttcctcagttttttccttttaggtagacatattaatagaatgggctagaggagcctctatgaagggatctctcctttgattgtactctgcttgctgtaacacccaagaatgcagagtcaggctaaccccacttagaatctgcacatagggtcaggcctctgcctgggatttacaagacagggccagactttcaattgtgaatgtaatgaaaaccaacaaaatgcattttctgcattgtgagatgtcaacatagacatcttaaagcccccctttgagagtgtggctttttaagcttttcagatcttgtttagtgacctgctacagttatatgagaggctccaggtataaatagaatctgatgacagaatctataagtgtaaacaagcatcttaagagtgagggataaggccacaaagtatccagagctatgacca

SEQ ID NO: 175934 - DNA, 547 bp, Homo sapiens
aagtagaaatacaatgttataaggctctcacattatatgtgaagtggcatcattttctatgaagataaactgtggtaagttaaggatacatattgtaagccccctagcaaccatcagtaaaataaaacaaagaagtatagctcataagccaaaacaggatgttaagtggattacaaccaaatatactatatattcaattagatttatcacttttagctaaaatctttcttatgagtaacatgatgaacttctacagaaggatgtaatatacaccagcgctttgcctatttcttttcactcaaacattaattatacagttttgccatgtacaaaaactaaagcacctcagaatactgacattccaaaaattcagtaattaccattctgccaaaaaaagcaatagattcttacttagataaaatataaaatttttgacaaatctaaatgatagttttcagcagtcagattggactatatcaaaagaatggtaattctaaaatttaaattaagattaagaggtataaatcttttctcaaagtgtgagtta

SEQ ID NO: 175935 - DNA, 425 bp, Homo sapiens
tttgctgttcttgttgttgttgatcttgatggagtctcactctgttgccaggctggagtgcagtggctgatattggctcactgcaacctccacctcctgggtttaaatgattctccttcctcagcctcctgagtagctaggactacaggcatacgccaccaagcccagctaatttttgtatttttagtagagacgggatttcaccatgttggccaggatggccttgatttcttgacctcgtgatctgcctgccttgacctcccaaagtgctgggattacaggcatgagccaccacgcccagcctctgtttttttttttttttaacccacttttagtttgtttccacagtaacagtacttagagtgatttgcttttgtttttcttctttgttcttttctctattttcctacattccttcctgcaca

SEQ ID NO: 175936 - DNA, 842 bp, Homo sapiens
gtccgaggaggccgcctaccaggggaaggagtctcatctccatcctagacaaaaaaaggatcttttgagatgcattaagcaggggagtcacagattggatttgtgttttgagaatctcctgcttacctagagaagaagggcatctcctgggccctcactgttgccttaaatgatttttattgtgtattacttaaacatgtgcaagcataaaatgagatataaactccttgtagctcttatacaagcatcagaccaagacaaattgacccatcacgtacaaaatcgattcaaatcagattaattttatgtgacatgttattatgccttttgtctgaaaccctgccaccacccacagtgcaattatggcccaaccactgtggtgttctgaatttgtgggacagagaatattggccttttaaacacgtgcatgcatgcatttgcgtgtgcgcacacacacacatcccaaatgattttttcccactatatatgaagaactcctacaaaccaaaaagaaaaaggcagacaattcaagagaaaaatgggggagggcttgcattaaagtacttcataacaagagtacttaggaggccaacaaatacacgaaaagctgctagcttcatgactcatgggggtggcttggtcagttcaggatactgtaacaaaataccttagactgggaaatttataaacaacggaatttattgctcacagttctggaggctgggaagtccaagatcaaggcagcagtagatccggtgcctgagcccgttccctgcttcaaacatggcaccttcttgctgtatcctcacatggtggaagggggaagacagttctctggggcc

SEQ ID NO: 175937 - DNA, 1146 bp, Homo sapiens
taagaaccaatgataatcccactaccctttgatgactctctttttggactcagcccgcctgcacccaggtgaaataaacagcctcgttgctcacacaaagcctgtttggtggtctcttcacacggacgcatgagacatttggtgccgaagacccgggtcagcgggactccttcgggacagcagtcccctgtcctcaccttcactccctgaagagatccacctacaacctcaggtccgcagaccaaccagcccaaggaacatctcactgattttaaattggactctcttcacacgggcgagtgtgacatttggtgccgaagacccaggacaggaggactcctttgggagaccggtctcctgtcctcgccctcactccgtgaggagatccacctgcaacctcaggtcctcagaccaaccagccgaaggaacatctcaccaatttcaaatgggcttagcggctgaagactgatgctgcctggtcgcctcggaagccccctggaccatcatggacgccgagcttcgggtaactctcacagtggaggcctgtttggtgactttcttcgcaccgacgtgcgtgacacaatgtttgcagaatatgaaggtggctgtcacgtggtctgggcttcctggaggtttgagctgggagctgaagccccgtaggagttctgtaagtcaaaagggaagagaagagcattccacgtagagaaaagaatctgtgctccaggcgcggtggctcacgattgtaatctcagcacttggtgtcaggcctctgagcccaggctaagccattgtatatcccccgtgacctgcatgtatacatccagatggcctgaagcagctgaagaaccacaagagaagtgaaaatagccagttcctgccttaactgatgtcattccaccattgtgatttgttcctgtcccacctttactgatcaattaactttgtgacatttcttctcctggacaatgagtctcatgatctccctacccagcaccttgtgacccctgcccctgcccgcaagagataaccatctttaactgtaactttccactacctacctaaatcctgtaaaaactgacccaccccctatctccctttgctgactcctttttcggactcagcccgcctgcacccaggtgattaaaa

SEQ ID NO: 175938 - DNA, 140 bp, Homo sapiens
gacttgaagcaggtcacagagtcaactaaaagccaagcagagtctccgtgggtcttggcaagggctcctgcagactggtcctgcattcatttgaataatctgatactggaagctactctttattttctgtcctattaggt

SEQ ID NO: 175939 - DNA, 399 bp, Homo sapiens
tggctggtggggactcgggagcctttgttcctgtgcttcttagcctctttgagtccttgatctttttgaggctctgaaaaagctacacacaatcttcccaggcaaatgcactgactcacgcaatctcacaggcaatttcggagggttcacaaagcccctgaaacccagctacagactccaagctcagaatctctgctccagtccaataccacccttctccctgctgtgacttgctccaggctggggatctggaaacagggacctgacccgggtgcatgtgtggcagttcacggtgggctgaaggattgtggctgctggtgccacttcttctgaatgcccctcttcagcatctaagatttggagggcgtctctccagcttgtcacttgctggagaggtat

SEQ ID NO: 175940 - DNA, 970 bp, Homo sapiens
ggctaaatgaatgactattattttaaagtgacctctgttcctattttggttaagtgttttaaacctttgatgtatttgacaggcttttcaaaattaaatttcaagttcaaaattaagtctttttgacctcaaaccaactttgggatgttacagagggcccttgcagcatccaaaagagagataataaactttcttgtcaattgtgtctttaaccatgaccattttgagtcatttccacagtgagttgcctaattttgatgcatttctgaaaactctttataagcaagtaaaatcctagagaattgtgccttcaaggagactcatggaaaggatggaaagaactcttgaatacatgtttctgatagctttatgatcatatcatttggactgggtaagaattcccagaactcatgaagagactgactatttattaatccaagcaggaaaagaattaattgaataccaaggaaatactgtgccagagattttcatgctaaatcagtcagcaccgaaatcgttaagatgtgtagtttgaatgaactccatgatcctagtcaaatttcctatgatgacccatttaataaacagtgctatgcacctgaattggagaaacagaattgatacttaaatccaatgttaatcatagattcatggaaagcctaaatggctgcttgggtcttcctgagcccttaaagcttccattattaaaggctctgcactttataagttatcactgaagagagaaaatgatccagatttaaaatacacatattggtgtggtgaatgttctaaattgcgaaaatggtttatgaccaacatttggtttgtcatgctcacaatcctggaaatacattcaaaacttcaggtacatttctgctacctgatgggctatttgaatatatagagagggatttcattcaattgccattttcattgcatgttttttggttgtatagaagctttcccatgc

SEQ ID NO: 175941 - DNA, 1069 bp, Homo sapiens
gcctgcgctacctcatggccggcatcagcgacgaggacagcctggctcgccgccagcgcaccagggaccaattggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatgggg

SEQ ID NO: 175942 - DNA, 229 bp, Homo sapiens
tgcagcttctcagcagggtccatcaccacctgcacagtaattcagtgcaggccatgcagcttctcagcggggtccatcaccacctgcgcagtaattcagtgcggcccatgcagcttcccagcggggtccatcaccacctgcgcagtaattcagtgcagcacgtgcagcttcccagcggggtccatcaccacctgcgcagtaattcagtgcggcccatgcagcttcccag

SEQ ID NO: 175943 - DNA, 289 bp, Homo sapiens
tctacacaccctcgggctggcgggactcactcaaaaaggcttggtatcccaggcttgcttaacagttccagggacggctccaggtggcttgctttatttttgagacagagtctctgctgcccaggctggagtgcaatggcgccatctcggcttactgcaacctccacctcccgggttgaagcgtttctcctgcctcagcctcccaaatacctgagattacaagcacccaccaccatgtccagcaaatttttttatttttagtagagatgggatttcaccatgctggcca

SEQ ID NO: 175944 - DNA, 444 bp, Homo sapiens
cctcatctccatcatatacaatcagttaacaggttacagtccggtccatttgtcatgataccactgcttctctttttaaatgtgtattgaaaaaaagaaaaaccaaactctttgagtggaatgctttaaaaaagataattacaaagaaaaatgcctggtagctaaaatgcaaactaattgaaataaccaagtcaagtaatccaaaatacagcccatttcagaagaaaactgttgctttatgtgattagggaaaagactagatcaactctagaatacttgatttttattaccaaaatcagctaagtacatcaatggcactcacagatatgaacatccagtttttcaacagaagggactaaccagaaaagagcaacatgtaaagaagaagtctaaagacaagtaggttaggctagtttgagatgagactacaggcaagaaaacagc

SEQ ID NO: 175945 - DNA, 543 bp, Homo sapiens
accaatcaaaacctgtacccaatacatataaaaatgcctatgaatcaataaaagataactcaatgggaaaatgaaccaaagacttactgaaacaacttgaatagaaatgtcataaaggagaaaagtccaatactcaaacatatggagaagtgtttaacctcactggtaatcagagaaacaccaaaccaaagtcacagtcagatatcactttccatcaacaaactaacagaaatgttaaagtctgacaattccaggtgtgggcaagaatgtgaagcaacaggaatgctcacacgctgttggtgagcatatcagctggcatgacacattggaaagaagacatgcatagcatctaacccagcaattcgacttctatgtatatacccttcaaaaacatatgcacatgtgcaaccagagacagatacaaggttagcagcaattctttaacagcacaaaactagaaacaacttgactgtacatcaatagcagaatggatagattgtggtctactcatccaatggagtatcatattgcaaagaaaatgaa

SEQ ID NO: 175946 - DNA, 384 bp, Homo sapiens
aggcgtggtggctcacgcctgtagtcccggctactcgggtggctgaggcaggagaatgatgtgaacccaggaggcagaggttgcagtgagctgagatcacagaactgcactccagcctggcgacagagcaagattgtgtctcaaaaaagaggaaaatttaaaaaacaataataataaaaacatctagacttgccctcaaacacacctttaaggccaagtgaagccctttgtgtaaacagtattgttcttggcttaactgggtgggatttaaaatattaacagttcttttctcctacatattaaacagtgcatgttcattatatagacaatacactctctagagagcccagcaccaaaacagacacacaaggcaccacagtggct

SEQ ID NO: 175947 - DNA, 143 bp, Homo sapiens
agaaaagccaatcttgtccatataatggcatgaggaaacaggaagcgctgcagcatgactttattatccttcctctgagcagggccaccgttcagctgggaggaccttacctttgttcctacaggtttctacaggttacacac

SEQ ID NO: 175948 - DNA, 831 bp, Homo sapiens
gcttaacagagaagccaccaaagtctccttgggtccatcacatggatgggcctcctgggcccctcagaccctgggcttcccttgaggtcctggagctatgtgggctccagctctgggaaggtggacccccatgcatgtgtcctgccgtcactgtctctatggagtctggctcacactaagtgagccataaggccttcttcaaggtcatctgtcccactgatttcagactcagggcggagtgtgaaatcatctgtcccccacagtgcactcagaaccctgtctggactagggcacacacacatgcatgcgcatatgaacacacatatgcatatgcacgcacacatgcaaggctgcaagtctcatgcacacacacatgcacacacatgcacatgcatgctcacatgcacaggcactcaggcacctagagccttctcatcctgcactttgagtcccccctccccttgcccatccttgcccatccttcaaggcctcagtcaaaagccatcttttacaaattgtctctggttgactttcctttttttccctcttagaagaagcgatgctgtcctcagtcatcaagcgttcactaggcgcttggtgtgtgccaggccccgatgtgggtcttgggcatgttccagttctcacgtcctcagggctccttggtgagtcgagggtgaggaggacacagaggccaggaggcctggggccggtctgggtggccctcaggctccagaagctcagcctccctgctgagtcagggcgagcaggatacacctgtccggagctcgcggggagtgggcccttcggggtcccccgggtgggcacacaagg

SEQ ID NO: 175949 - DNA, 444 bp, Homo sapiens
atgaacacccttcctatacttcgtgtatctacccttctctggtgtcgcacatggtatttatctactttggctcctataaaccctaccattctttctgggctcagttctgaaggcgtcctaaactttgctgatccagtgtttgggaaactcttaactgttcatacttagtctttactgtcaattgctgcattttgctccccccattcaccttgtagcattttgttttgttttttatttttctgctctaaaattgtcttggcaattacctaagtaacatcagttgttcctcttcaacttctctgtatcttttctcataggcaactattatgtcagaaagtcaaattattgaacatctactgagtgccaggttcttttccagttgctcagagtatagcagcaaataaaacaagattgtgtccacatggggtttacatagtagaatgt

SEQ ID NO: 175950 - DNA, 372 bp, Homo sapiens
cagtttcggacattcggtggaaaagcgaccagggacagaaggcgccgccataaaggtcacctggcccgagcagacgccaggtcgctgcttcttccttggctgctgacattttaacagcgcccaggcagtctgtttccgctttccccaaacaagcaccctggagaccctccacctggcggctcttgaggcgagaaaaagggcctagcccaggagccggtggccgcgacctcgggtctgcagtggcgcactctgcatcttgggaagggcccgacgcacaggacagggaccgggcaggaggcaggggcggccccaggagaccgggcagcggacgggggagaccgcgggggacccgccaggggacgggggcggccg

SEQ ID NO: 175951 - DNA, 794 bp, Homo sapiens
tttagaacctattatcagtggtgtctcagagaaaagaacatagagagatctctctatatatagatgtatccatatatagaggatatatatggatctctatatatctatatatggatatagacatatctctctatataggtatagatatctatatagatatatagatatatctctctatataggtatatatatatatatcaatatatatctctatatatcgatatataaagatttgttataaggaattggctcacacaattataaaggctgactagtccaaaggtatgcagttggcaaactgtagacccaggatagcttctagttctagtctaaagacgggcaggctcaagacccaggaaaagccaatgttttaattgaagtcaaaaggcagaaaaaaaattccagtgtctcagcttgaaggcagtcaggcaggaagagatctctgtcactcacggaggggtttgcccttttgatctattcattcccacagctattgaatgaggcccatccacattagggaaggcaatctattttattcagtctactgatttaaatactaatctcattcagaaacacccacagaggcacacccaggataatgcttgacaaaatctctgggcaacttatggctcagtcaaattgacatataaaattaactatcaggcttatttttaaaaagaggcctggccacacagggtgtctcacacctgtaatcccagcacattcagaggcataggcaggtagattgcttgagcccagaagtttgagaccagcctgggtaatatgatgaaacc

SEQ ID NO: 175952 - DNA, 524 bp, Homo sapiens
aatatactagttgtatattaaaatgagggtggcggaggataggctggactattacctaagatccagtcctttctgaatgcaagacattgcctcatcatttaaactcttcacatgatggaaaaggttcagcagttgtccactatgactatcttaatgcacctggattaattaattcttttctttaattagttattaatttgttcatcaaactactattcaatccatatccctagcccttcattcaacaaacaagtaccatgagcacctactgtgtgccagatgcaagactaggcatggtaggcattgcagtacactagacccatgtggctcttcactttatgggtctgaccatctcgcctagcttgagtgagttggatccaactgtcagagctttcaaaactcaaacaagaccatttgtccttaaaaatttaaagtgtaagacatgtatgacataactgaacaccagttttaaaataactgcatatagtttcagccctgacacaagaatccctgtgctaaatgga

SEQ ID NO: 175953 - DNA, 355 bp, Homo sapiens
tggaacaaaacttacgacagatcatggcagcaatgtgttttcagaattaatttggcagatacatcataatccattacaacaacacaagttattcgcaaatcacacctaagcgtaagtgtcatcttaatttggttgagtatagaaaaatactatacatacaatatatagtacatactatgtctatgtctgcattagtttaaacagctacctactatcacttccttcttccacctcttcccttcagaattgtgttactgaattgtttcagctttgtttgtagtattaacattatacaaaaatagcttcacagattgcaggaagatgtggccaataacagtggaaattaaatagaaaa

SEQ ID NO: 175954 - DNA, 178 bp, Homo sapiens
ggacattgtgcagaaaactgccttgtttccatgcacagaaactagctagcctttctcctggtctggcccttggcagaagacatgactttatccatgctttcatccagccatccattcatccgctcacccacccattcatccatccacctacccacccatccatccatccatccatcca

SEQ ID NO: 175955 - DNA, 473 bp, Homo sapiens
aaaaaaacccctcagcccctttagggccatgtgttttctctgagtaattgtcacaattaattaaaatacatgtgtatgcctttttagataaattccatcagaccagtttctgtctggttggaaagtaataactgcctatttgctaagtgcccctgcccccatactatgttccagtgaactaaagacctctggcaatcatagatttacaactcagcaagattaaacaatttattgttatttatgacatccaagctggatcttctgtattatattccacattaacatctatcactttacatttgggagatcctgtccaaaaaaagattatgcctcctaaccaaacattcagcagggctgcaggaacaagccccctgaacaaacatcctgccaaagtactttaaagcaccgtgagctcccacagctgtgcattttcagacgactcagcagattagcgtggagtctcctagcctctg

SEQ ID NO: 175956 - DNA, 444 bp, Homo sapiens
tcagttcaaaagcatcaaccaaggcaagaggaccagtgttgctgactccatgctgtggttgctggagaaatattcccagaacctggaggacctgattcaggagcagactgaggaactggagctgaagagagagaagacagaaaggctgctctgtcagatgattcccccgtctgtggctgaagctcggaaaatgggggcaactgtggaaccagggtattttgaccaggttaccatatacttcagtgacattgtgggtttcaccatcatctcagccctgagtgaacccattgaggcggtgggcttgctcaacgatctctacatgctgtttgatgctgttctgggcagccatgacctgtataaggtgagaataccaggaggctggcattccattcctccctttactactgtgccttgatggtacaattacttccattcatttattta

SEQ ID NO: 175957 - DNA, 1425 bp, Homo sapiens
gccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 175958 - DNA, 779 bp, Homo sapiens
cgttgttaaacggcgggccagtgaattgtaatacgctccactatagggccaattggggtcccgggcccccccctcaagtttttttttatttttatttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaagagcacagaaatttagctacagctccatggtgagccattaaaaggaaagagacactttacctgtgctccttggcaaggacctgccaaatgtgggagctaaggtttgtgggaacggaaagagatatggctgaagtagatgagtaagactcttattagtgatagtcttgaacctcaaactaaggattttagactgtatcccatggagataaaaggactagccatggaggcaaaaagacctggattcaaattctggctctgcaacatac

SEQ ID NO: 175959 - DNA, 1611 bp, Homo sapiens
gccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaagagcacagaaatttagctacagctcctgtcggctagtcggtagggtcctcta

SEQ ID NO: 175960 - DNA, 1589 bp, Homo sapiens
gccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgagggagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaagagcacagaaatttagctacagctccatggtgagccattaaaaggaaagagacactttacctgtgctccttggcaaggacctgccaaatgtgggagctaaggtttgtgggaacggaaagagatatggctgaagtagatgagtaagactcttattagtgatagtcttgaacctcaaactaaggattttagactgtatcccatggagataaaaggactagccatggaggcaaaaagacctggattcaaattctggctctgcaacatac

SEQ ID NO: 175961 - DNA, 1825 bp, Homo sapiens
gccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaagagcacagaaatttagctacagctccatggtgagccattaaaaggaaagagacactttacctgtgctccttggcaaggacctgccaaatgtgggagctaaggtttgtgggaacggaaagagatatggctgaagtagatgagtaagactcttattagtgatagtcttgaacctcaaactaaggattttagactgtatcccatggagataaaaggactagccatggaggcaaaaagacctggattcaaattctggctctgcaacatac

SEQ ID NO: 175962 - DNA, 653 bp, Homo sapiens
cagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatcagctctg

SEQ ID NO: 175963 - DNA, 326 bp, Homo sapiens
aggtaacataggaagtcaaggagttcgcttcaccgcccctccccccaccccaccctttttttttcctgcaagtttctattcttcccgcagctcctacctcaaagcagcatggattcataaccacaggctcccctcattagggcttggggagggagggtgttggaatccacactgccagagtaatccagactaaaacatcaacaaatggtcccagctggttcaccaaggaacacttggcaaaacaaagaaatcctgtctggagcgacacggacacagccacaaaccagtcaccaaattcccagcaagtatgtgctaagaagccaaaa

SEQ ID NO: 175964 - DNA, 150 bp, Homo sapiens
ctgccggcgactctatgaggatcccatgtgatggtctggaaagacaattacattcattgagcactcaagcaagcagacataagtgcgatgcagaatgcaaaggaagattcttgatctcctttatattaaacaaattttatagttttatca

SEQ ID NO: 175965 - DNA, 782 bp, Homo sapiens
gggcgcgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagaatagagggttacattctcagtacttttctcagattaatgtaatgctgaatgcatttggtaaactggcactaatggtgaaactcactctagggctggtccctcgagggactgtcatgggctcgcttttgggaaaggtgctgtgtttacagttgagcctggatgatcatgttgttgccgtgtgtgctggaaacaaaatattcatgctggatattgaggtaagattgaaattcacgtggatttcacggaagggtttagctgatggggcctcccaggttctg

SEQ ID NO: 175966 - DNA, 544 bp, Homo sapiens
tgggacatgagcacatgtgtctctcacaggctctgggtggagtatatctgcattttgctggtgataggtccatggtacacactaggaccagatgaccttgcctgccattttttctttcacctgtgtggatttgcatgacgggctctgcatcaggctgcagctgctgcacatgtccgggtcttgggaacctcctggctgcttgtgggtgtcctgtcattgcttagtccctggaggcctgggttggataggctcctactcctttccttccaatcaatgttagctgaacctatacatgagggtggacatggggttggatgtgggtgagaagcatcgaaacatgcagtttgatgtgcatgattctcactgcacaggtactgcagcctccagagaaaggcatcttcgtgtttcgatgctgagagagtctctgcagggaagtgctgcattccccaggttttcagaagacttctgtatatccagtatttttgatattcttaaagaatcaaaatcacatcaaagctcattgtcattctctcagtaattttag

SEQ ID NO: 175967 - DNA, 1091 bp, Homo sapiens
gggcgcgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagggctggtccctcgagggactgtcatgggctcgcttttgggaaaggtgctgtgtttacagttgagcctggatgatcatgttgttgccgtgtgtgctggaaacaaaatattcatgctggatattgagcagcgattttctgtgacatacatagaacgtcctgatgttaataaccgccacaaagtcccaccaccgaccttcctgcacacattctctcagactcaggctgttcgggccgagctgcagggccacct

SEQ ID NO: 175968 - DNA, 1211 bp, Homo sapiens
gggcgcgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagttgtggaagctgatcgaggaagcctaagcaggctctgtgaagtgggaatagtggtatttgagtcaaggtttgcttaactggaaagcccgtgagaagaatggagcagttgagaatgtggaagctccagagttttcggcaatttctcttcttttttcttgggatgaggagaggtgaataaatagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagggctggtccctcgagggactgtcatgggctcgcttttgggaaaggtgctgtgtttacagttgagcctggatgatcatgttgttgccgtgtgtgctggaaacaaaatattcatgctggatattgaggtaagattgaaattcacgtggatttcacggaagggtttagctgatggggcctcccaggttctg

SEQ ID NO: 175969 - DNA, 204 bp, Homo sapiens
agtgagcgtagggtggatgagtgacaggataaggtagaaggaactgacccatcatagatggatgtcacataaatagcagcccagaatcaccaccagcgacaagtcctcctaccgctctaggctgaaggatggacaaggttggtgccaggactggctgggcccccaaataccaatgatgctcattacatcatcctaccccacact

SEQ ID NO: 175970 - DNA, 650 bp, Homo sapiens
atggtggcatgcgcagaggtgaggcatcctgttcaaactcaggagtcagggaagactgcctaggtcatgttgcagctgattttttaagttgggtgaagaagaagaaagggctccaggaacagcacttgtaagggaatgaagagctgagctagcatgatgcacgtgggaatcaatagtggggctgtttttcagggggaccagcctgagttttcatttccctaggcattctcctaccacttgggtatgtctgttgtgttgcattggtggggaaaatgtggcttcccgaaagaggattaagtgacgggattatgaattattttgagtgtacttaatacacatgcatgcgtgcttgtagtctcgtaaagtgaatggcaggatttgacttttccctttgtctctatgcttctctaccacaaacacacgctgtaattgttccaagcacggtatttccatagtttggatttgtgtggtggtccattttctgtaacctcattttgaggtgactggcctcaaaatccagttttagcatttatgctgtttttagctcattatcattttgaatattggcagtgctgcattgtgattttttgtactccccttgagaaagagtccatgtaggtcagcctttgcaggtaaagagggcgatatcc

SEQ ID NO: 175971 - DNA, 354 bp, Homo sapiens
atcttgaatctcctctccctgagagaatggcagagaaaaattctgttgtgaatattcaaacaccaggattaaagacgcttcaggagttcctgttgtaagtgtaatgtcttaagctgcaactagcacacaatggtccaggtcttgatggctttggtcaagcagctccctgggtcacgggacactgaggctgtttgaactgcaagggctgcaagttcccagagaaggagccaggcccagccacagtgaagaagcctgcctctccctctactggctgttggacaacaacactgcctgtagcgtttgctcttggcagtcatggaaccaagtaattaatgaaagggttgaggttaaaag

SEQ ID NO: 175972 - DNA, 306 bp, Homo sapiens
  misc_feature (1)..(1): n is a, c, g, or t
ngctagagtatcccctatctatactgacgcttcaggagttcctgttgtaagtgtaatgtcttaagctgcaactagcacacaatggtccaggtcttgatggctttggtcaagcagctccctgggtcacgggacactgaggctgtttgaactgcaagggctgcaagttcccagagaaggagccaggcccagccacagtgaagaagcctgcctctccctctactggctgttggacaacaacactgcctgtagcgtttgctcttggcagtcatggaaccaagtaattaatgaaagggttgaggttaaaag

SEQ ID NO: 175973 - DNA, 261 bp, Homo sapiens
ctgaaattgtagaagagaaaactgtaaatggctggcatagcaaaaattaaatcattaataaaattctgtttgcagtttctgctggatggtaacctttttttaaaaaaaaattcaacttatatagtagagggtacatgtgtagatttgttacatgggtaaattgatgccgatgcttggggtcccaattatcccatcacacaggccataagcatagtacacaacaggtggtctttcagcccatgctccccttggcctagtgat

SEQ ID NO: 175974 - DNA, 468 bp, Homo sapiens
tataaatgggcaattcacaaaagacgaaactcagacggccactgagtacagaagagacactcaatcacactagaacgcagagaaatgcaatataaaacaatgagatacaattctgtgccaatcggattagcaaaaattaaaaatctgataactaagaggatatgggaaaccaccaatggaagcataattacaactgctttggagagcaatttggtaatgtccactaagttaaaatgtgcacgttctagaacctagccatttttcctctgagtactggctctagacaacctctagtacatatttctagatagatatgcacacagttactactgtatcactatttgtaataacaaaaaaggtgaaagcatctgaactttctctcaggtgaacagatgaagactcttgatttattcgtatatactggaatcctatggagcagttgctatagtttggtttgcttgtcctctc

SEQ ID NO: 175975 - DNA, 222 bp, Homo sapiens
agagggtttcctgcatgcctacgctttgcagggttcacttactgttcaggtgttcatgattagttcttttgaagtaatatacttttccattatactgatgataattttttctaaaaattacagacatgaattaataagcttcagttagaatctataattgatatttctccatgattatttgtggtcatacagtgtaaacatttgttaattgtatgaacaatc

SEQ ID NO: 175976 - DNA, 381 bp, Homo sapiens
acttttcctatactaatccttgtttgtaaccacattttcattgtgtgattaacaactgattattgtctgtctcccctaaacgccgggaaacatgtctgttttgcttatgggtttaaaactatatacccagtgtgagggacagtggctgccacacaggtacccaaatatttgctgagtaaacgagtgagcaaagtctcaaagaatttaaaaatctattaggcacaacatccaaataagcaaatagttataatgattaccaaaatacaacagatgctattataagaataatacaagtaaggatttaaacacgaacgctggtttaaagttcaagtatcggtcacgttaaatatagacattcctatgtaaggatggatgctaaat

SEQ ID NO: 175977 - DNA, 394 bp, Homo sapiens
actagttagaaaggaattagataaccctactctatagttatccctactttttaaaaaattgcctctattttataatgtcacaaaattaggactagaagtagtgtcctagataagtatcatttatgccagttacactgtgaatttgaattatctgatatactgtgtaagcaatttaagatcagtttcttttcttcatgttacagaatctgacagttcctagttatttcttagaaatgttgatccttaaaaggaatctaacagatttcccagtacttctacgtattacttggttctttctcttttcttcatgtctgtgatgtataattaatcatagattacttcattttgtttcatttcatttacaacatttatgagcttcactttgtcagtatga

SEQ ID NO: 175978 - DNA, 434 bp, Homo sapiens
cctatgtggacaagcatctcagggtctgagcatggtgaaaacaaccctccttatattcccagtgactatattatgcctactcccaacttgctcatctcagctgatacagcttctatcactgctgctgctaaggccaaaaaccctagggttgccaggcacggtggctcgagtctgtaatcccagcactttggaaggctgaggtgggtggatcacctgaggtcaggagttcaagaccagcctgaccaatacggtgaaaaactctgtctctactaaaattacaaaaattagccgggcgtgatgccgtgtgcctcctgtggtcccagctactcaggaggctgaggcaggagaattgcttgaacctgggaggcagaggttgcagtgagcagagatcatgctactgcactccagcctggtgacagaacaagactccacct

SEQ ID NO: 175979 - DNA, 187 bp, Homo sapiens
caacttttgctttatccttgacaggagaataactattctgtggtacaatgcttacaaatttaaatatcacctaccaatagccactgcagtgagattaccattttaacacaaaggaaaaaactgacaagtttacctctacacggtacaaaagtttaacacattccaaacaggtaaattcaaatccttc

SEQ ID NO: 175980 - DNA, 252 bp, Homo sapiens
taagtggagtgattaaagatttacatgaaggctgggcactgacgctcacacctgtaatgccagcactttgggaggccaaggcaggagaatcacttgagcccagagaatagcctaagcaacatagtgaaaccctgtctcttcaaaaaatataaaaacgatctgggcatagcccatgacttatagtcccagctactcggggatgcttaggtaggaggatcctttttttttttttttttttttttttttgagatg

SEQ ID NO: 175981 - DNA, 220 bp, Homo sapiens
acagcacctctgtgatttgatgtggttctgtttcatgtttatgcatggtactgctgggaatacagcatatcttctcggggtgtcaggagtgaaaaaggcctgaggatcacgatccagcccaatccctattctacagaagagggggaaagtacagttgctatagcctgatcctctaagtactgcccaatacaacatacgagggagttttgattaatttcct

SEQ ID NO: 175982 - DNA, 340 bp, Homo sapiens
gaccaagatgtgagtggagaaagggcaggggaggggacgagggccacagacaggtgggtcccacaccagaccctcccagggacacacaaagttgtggagttgacttggttggccagagtcttaaactccagggatgtgatcaggaatccaaaatgtttatttccatatggatggaataactgtgctctctaagtcagcccaatgcaggcccctgccccactcccactccaccaggcccagattccagctggaactccagatggtccctgagagtctgcaaagaccaaaggtcaattcagagccctgtccccaaaataaactgagcaaaagtggatgggga

SEQ ID NO: 175983 - DNA, 588 bp, Homo sapiens
tcttttatttcttttttcttttttctttttttttgagatggggtctcgttctgtcgccaggctggagtgcggtggcgatcttggttcactgcaacttccaactcctgggttcaggcgattctcctgcctcagcctcccgagtagctgagattacaggcacgtgccaccacgcccggctaatttttgtatttttaggggagacagggtttcaccgtgttggccaggatggtctcgatctcctgaccttgtgatctgcctgcctcggcttcccaaagtgctgggattacaggcgtgagccaccgtgcctggccaacattcttatttctaatgctgcatagaggagtggttaggagccagggtgctagagccacattatctgtatttgagctgtgtctctatgggcaaattacttctctgtacttctctttagtgccctgttcccttcagtcatgaaagcaatgaaggaagacagaacttctaatattatggtttctgaatcatccttaatgagcctgtcatcaataaaatgagaaactgcaacctatttaaacactgtttatcagattataacacacattagagaattta

SEQ ID NO: 175984 - DNA, 233 bp, Homo sapiens
cagtcagtagccccaataccagccttgtatatcacagaccaccgtccaatttaagtaattttttttaaaggagtgctttgagattatagaatctgagcttatggcagaacccgcataggagatcatgaaaacaggcatggagataagccaacattatgctagccactgtccatgaaattcttgaggcttcttgtataaaataaagtcttttcttttctttttttttttttttt

SEQ ID NO: 175985 - DNA, 635 bp, Homo sapiens
agtagagacagggtttcaccatattggccaggctggtcttgaattcctgacctcaggtgatctgcctgccccggtctcccaaagtgctgggattacaggtgtgagccactgcgctcggcctattcaatccattttaattctcataacattatatgggtacctacggatgttatccttattttgctagaaatggaggctcagagaggttacttgcccacagtcactgagctagtacttgtggagctggtgtgatatggctccggggtccagacccttcactttggtgctgcatcgctaactggtgggcagaatgaggcgggagtgtcagaaccaggatcccaaaagatctcaacagcctagcataaaaaataacatgtcagctgtcagaactgcccagagagcaccggactcccctggggctgggattcatgtgcaagtgctccaccaccatcagaaggcttggacacctccatcatcgctgatgagtactgaatgttgggttcctgcggtccagagctgtctgcttctgacagaggggatggccgcacggacgtgactttcaaacaggagccggggtggggctgggcaaatgccctggtcccttgcccacccatcctgttctatctactctgggt

SEQ ID NO: 175986 - DNA, 417 bp, Homo sapiens
atgccttgaatttaaacagccctaatttcttcaagaaataaacacatttcattaaaaacaataacattactcctcttattactgaaacagcactttaaattaattgggtacacatgctataattccgaaccttaatttaacttcttctaccaagccagctcactcagaagtttttaagtggcaataaaaatgtaagaggttagaaaatgcacgaggttagaaaatgcacaaactgaattacacataattaaatttacaaaatgaaattaaatctacacacatttactgaaaggctacacaaagatggataagacaagtttgtcatccttacagaatttgaataaataacacggaattccaagtcaagagaacattaaactcataagcgattatttgttttgtgtgtttgtgtgtgtg

SEQ ID NO: 175987 - DNA, 335 bp, Homo sapiens
gactcctcctttcaggataccttggtagtttccacattctttcctctacaccaggagcgtgtgttctctcgcccctctaccccctattctctcccatcctccctgtttctctttctttctcaaccaggtctggtctaacaaaggttcctagcttacattgtctttggctctaggctccacttccagtctttctgttaatgagtactttctccggtggcctgctatatttttttttttcaagttgtgtttttcctcatcccttcccaacaaaacagcgcaaaaaatgaagagccttaaagttgtctggacatttcttctcacccgctcataaagtg

SEQ ID NO: 175988 - DNA, 579 bp, Homo sapiens
aaaatacgtcccaaattttttaagtagacccttttcagtcttcctactacctaactctttacatcagctacacagtcctcctccctacagtcaaccaatctaatctgcttcttgtgtatacttctccagaggaattccatacaaatataagcaaaaatatatttcttgtgtaaatgtgtctttttatataaatggttccatagtgcactgtcctataatttgctttttttttatttaacagtattatgttgaatacatattattgtttcaaaaactagtatatgtatagtttaaatttccagaacaaaaagtattgggtcaaagagcatgtacacttgtaaattggatatcataaaattgtccttcacagaggttacacctattaacatcagtatctagaagtgcctatttccccattctcttgctcagtgtgttgtcagatttttggattattgcataattgataggttaaataaaagtcagttcatgatagttttaattggcatttcttttgtgagtgaggttatctttccatatgctaaagagccatctttatttcctctttcaggaaaattcgtt

SEQ ID NO: 175989 - DNA, 334 bp, Homo sapiens
cgtagttggacatgctagtgcgttaggggtgaaattggaaaaacatcagttatagagacggaaagcaagaagagaaaaaggaggaggacagagatgacagaggtcggcagtgcccggtcagttgttgaaagcttggctagacattgaagattgtgctgtctgaggtgacttcgtgataagactcctgtggacgcttatcttccacttgctttcaagcacatttattcgagtggccgagtggccccattctaaatccgtcccggaggggtgaggggctgtggggaagaggcagcaggtgctttttctacttcccaacacgggtgtggggctcagg

SEQ ID NO: 175990 - DNA, 930 bp, Homo sapiens
agattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaatcatttttattgtgctactttaaaaattctctttgtcttacctttaacaatttaattataatgtgtctaggtgtagacttctttatgtttaacctacttggaatcttttaggattcctgaatctggatgtctatgttcttccctcaatttggatagttttcaattattactttgttacatatgttttctgcttctttctctattctccttgtgggacttctataatgtgtatattggcttgcacattcatgtctcccaaatcctggaggttttctttttcattctttttttttctcctctgactggataatttcaaataacctgtgtttgaggttgctgaatctttcttcttttgatcaagtctgctgttgaagctctgtattgtattttttattttactcatgtattcttcagctctataatttctgctttttttgtttttgttttttgtttgagttggagttttgctccagcctgggtgacagagccagaccctgtttcccataaaaaaaaaaaggaaagacagaaaaaatttaagggcaacaaccaatttaaccacaaggggacagca

SEQ ID NO: 175991 - DNA, 476 bp, Homo sapiens
ttaataatgcatttgcttcaggcgtgactcaatttaataaatcatataagttacaatacattttatcacatatttatggaaagagatattccaatttcttaagcactgcttttctaagtattaagaggcagcttaatataaccaagggacaaaagaaggaaaaaaaaaaaagtcatatacaatgaaaaactccagggaaatgcattaaaaacacctctaaaccatgagtttttaagttcatatgcatgaatatgtctttaaattatatgcagctgtttgtgtgatgaacatcttaatgaggaaagcatccataaatttcatcacattatcaaattagaaattggccgtgaacattttttctatgtgatgttgccgtatcgactctcacactaaacccagcaacttgccaagggtacacatttgggattcaacagaggttatgtggacagagacaaggagcattggtcaagaatata

SEQ ID NO: 175992 - DNA, 1229 bp, Homo sapiens
ggcaggagaatcgcttgagcccaggagtttgagaccagcctgggcaacatagtgaatccctgtcactattttttaaaatgtattttaaaaaagaaaatgttctatggtgaataaaaatgaagatacgacattacaaacactcacggtatgtagttatagcagtgcttagagggaaatttatagttacagatgcttatattaaggaagaagaaagatctcaaatgaatgacctcgcccctccaccttaagacactggaaaaagagcaaacctacttaaggaggcataaggaaggaaataataaagatcataaaagaatactatgaaaaattttatagcaatataattgtcatatgtcaaatgtcagaagcagtagacaatctgaatagatctatatcaagtaatgagattagtaatttaaaaactaccttcaatgaaaagcccaggctcagatagctttacagtgaattctaccaaacatttaaagaactaataccgattctttacaaactcttccaaaaaacgggaggggagggaactgctgttcccatatcattttatgtggctggtatttaccctgacaataaagccagacaaagacgtcacaagaaaactccagaccaatatctcttatgaataatggatgtgaaaatcctcaacaaagtactagcaaactgaatcccacaacatatttttttaaaaaacaaactgtatcatacatgatcaactgggattttttccaggttgccaaggctagttcaacatttaaaattaattaatggaatatattaatagaataatttttaaattacatgattatatcaatagatgcagaaaaagcatttgactcattgaattccctttagtgatagtaacactgtagcaaactaggaatagagaagagtttccttaacctgaaaaggggcatctatgaaaacctcgtagctaacataatcagtgataacagactgggaatttccccttctaagactaggaacaagacaaggatatctgctcttgctatttctgtttaacattgcactggagactctaggtaaggaaattaggcaagataaataaaaggcatctagtttggaaaggaagaggtaagactgttttcagatgacctgatcttatacacgttgagcatcccaaatccaaaaatgtaaaatttgaaatgcgccaaagtgcaaagtgttttgagcaccaacatgacgctcaaaatcctcat

SEQ ID NO: 175993 - DNA, 610 bp, Homo sapiens
tagaagtaaacccatgtttaggtatacttggatacatactgtataaatttccatagtacatgatgctaaaattaaagacactgagtactaaatgaacttcatcctagtaaataattatgaaccaaattattctatatagtttcggccttaagtatactaagagcatacaatataataaaatccagcttctctgggccttttgttttcaatgtgtatttttctaaatctgaaaatacctattcggcagcaagtataacaaaagcaaagacacaaattaaaactattgattattctgtttaaggccagggtttctgagttttagtctgattttaaaaaacctccgtctgtccctctctccctccctccctctcacggtaacagccggagaggcaagtatggtaaggtcgacctttaaacgtttgctggatcagcactgggtggggataagaaaagatcaagggcaaacagaagatatttgcgaaagggatctatttgcacactgaagttgatttaaaagtacgtttaaaaatcaagttggtcttaattcgtctgttctattttccatattcgtggtgacaaagggaaaaagaatctctggctgcccccaaac

SEQ ID NO: 175994 - DNA, 738 bp, Homo sapiens
cagcatcctccccccacccccatatatatagatgccacttttaggtagtaatttttattgttattcaccaacttagaagtgaatccatgttttagtttactttggatatatactgtttaaatctgctctgtcactgacatttaaaaatttggttacgttaggaagatcattttaatttccatagtacatgatgctaaaattaaagacactgagtactaaatgaacttcatcctagtaaataattatgaaccaaattattctatatagtttcggccttaagtatactaagagcatacaatataataaaatccagcttctctgggccttttgttttcaatgtgtatttttctaaatctgaaaatacctattcggcagcaagtataacaaaagcaaagacacaaattaaaactattgattattctgtttaaggccagggtttctgagttttagtctgattttaaaaaacctccgtctgtccctctctccctccctccctctcacggtaacagccggagaggcaagtatggtaaggtcgacctttaaacgtttgctggatcagcactgggtggggataagaaaagatcaagggcaaacagaagatatttgcgaaagggatctatttgcacactgaagttgatttaaaagtacgtttaaaaatcaagttggtcttaattcgtctgttctattttccatattcgtggtgacaaagggaaaaagaatctctggctgcccccaaac

SEQ ID NO: 175995 - DNA, 377 bp, Homo sapiens
taaataagtcaaccacagatgatctctgaagccaaaatgagagggaaaggaacaattaagatttttcacactaatgcatcacaaagtacacttaagtcaaatcttcagatattctaatttccaaaagttcaaattttgcgatctaggcataaaatatatctatgggaggtataccaggaaaaaaatacaatgcaacatatcctaaatttaaatttgtacactgtactgacacaatctaggattcaatgaacatctagctgcttttaaagagggtttcaaatttccaaatatagctttgacttttctcctaggatggtctagttcagtctgtgtaggtgagtgacaagaaataagcagacactgtaactgcagtaatc

SEQ ID NO: 175996 - DNA, 278 bp, Homo sapiens
agtttcagtggagaaaggttgggggtggggggaattcgacctatagctgagcaagagccagtgagagatgaggaagtgaaaatagtgagagttaggaagcttgactttgaggtgaagaagaatgctggggatagtaatggtggctcagagtcaaaggcaaattttgtattattttgtttttattttttaactgagaagtctcaatcacgcatatatcctgagaagaataaatcaatacagaggctaatggggaaaagtgatcaacagataatgtcagt

SEQ ID NO: 175997 - DNA, 334 bp, Homo sapiens
ctacccacgaagtgtttgctgttcagggatcagaaaagcagctaaaagagcacttccaggaattcagaaaacccacggtttgactggtaaggaggcgtggtcaaagtgactcaaaaggagagccaggggcttctggaagactaaagagaaagctgctggcaacttcttgggcagaggacaagacgctcctagaaagatcaagtcacttcctcagcagccatcggatggggcgtgctctagagccacctctgtgctgtgggtaacaccaagcctgggcttcctttcttataaaacaggaggaacagtccacaccctgtgcacttcgtgggcagct

SEQ ID NO: 175998 - DNA, 481 bp, Homo sapiens
aaaatcacatttgccagaataaatattttgaaaaaatcatcgaaaccacttaagatattttcttccttttttagaaaaattatttcaataaatgcacatacacaaaattctgcacacaagactcaggtgttctttgtttctaacacaaacttggtacggttatcaacagaaatcaagtctaatatcccagccaaagcacaaccaacttcctcctctgatcctaaaattgctccaaaaccctaagctctgttttatgaaaaagaaatgagacataatgtatatgtaattcttcccaaggccaaataaataatgctcaattttcaatcaaatctgtcctcctacaaatcttttggccatttttgcctatccaatagcatcaccagggatggaaagatgagactatactgaatccagtccatttggctcttattagcatcattggtgaatggtttgctgtgtaacaactggcaatccctatact

SEQ ID NO: 175999 - DNA, 258 bp, Homo sapiens
ataaactcaatgatccatcaacaagcaccatactcccaggtcctccagtgtttacttcccattctatacatgcactatccagacattcccattctcttcaaattccaaaatatcctatcacctcccctccccatacacacattctacttcaccaacaaaaaaaaaggtaccagctgcgcacggtggcgcttgcctgcagtcccaaagtgctgggagtataggcgagagcaactgtgcccggcgaagcagcatctcttt

SEQ ID NO: 176000 - DNA, 388 bp, Homo sapiens
atttagaaagaactgtgatcttccataaatacagcaaaaaaggtagtaaaaggtagaaaatagtacataaattgcattatgaatcagtgcctggactgcagagggatggctactgttttggtttattgcaactcgctgagtctctgagccagaaagcagacagggaggtccaaagcctctttctgattagtttcaggctggcagatttgctcggatatagaaactgcacaaaatgtttatctcaatccaaacccatcaatcttgcagttcccaacaggttgcagttgtaataggttcacccattctgttttattattatgagtttttattattctcagtgccttaatttcatatacaatgggaaaagagaatatgtaatttagtatta

SEQ ID NO: 176001 - DNA, 332 bp, Homo sapiens
tctgtcacccagccctgagtgcagtggcacgatctcggctcactgcattctccatctcctgggttcaagcgattctcctgcctcagcctcccaagtagctgggactacaggtgcacaccaccacacccagctaatttttgtatttttagtagagatggggtttcaccatgttggccaggatggtcttgatctcctgacctcgtgatccacccgccttggcctcccaaagtgctaggattacaggcatgagccagtgcacctagcctacattgcaccttctaatgcagaggttgtcaaagtatggcttacaggccaaacccagttcttgacct

SEQ ID NO: 176002 - DNA, 261 bp, Homo sapiens
agcctgagggttgcatttaaaattggcattaattttgtttttcacaggcttagcttttttccctgaggcttctaacaaattctagttggcttctgtctctattattgaccatgtgtaccaagtggaatattgtctataaaaatttgaaggcatctgttgctttgcaaagactatgtgccttttatgccttaggtaagcttatcaattccagtcccctttaagaggaggctgaccatgcccatggttgcagaggtgaaaata

SEQ ID NO: 176003 - DNA, 685 bp, Homo sapiens
taagaatgtctaaaaggtcaagtaatttgaccagccttttgggggaagtccagtgaatagtagaataatatttagagatgaattttctgtcataggcatgggataaactctatttcagtagaaaggcaagataatgagcaggatcttatatagacaaatcgttcattccaaacatgctggctctaggaggtgttcagtgtgtttgttgaatgagtgttacagatgaattgaggtcagatggaattgaggtcagatttctccatgagtggagggattttttttctctcatgtcctgggcacctaacaccatgcctggcacatgcttgtcagctgtcctttgttgaatctgcgaataaatgtgaggccgactcaacaactattacctccttgtggatatgcatataagctcttctagagtattttgggggaagaaataaccagaatgtctgccctctcttcttcctttgtgaaactgttttctacagttacatttagtgtcgagaaatgagggcttttttgttttgttttaagtggcttttaaagttgctccaagattcatgaggttaaagtataaaactttaatactttagaaaaataaggacttaattctggattctgacctctggtggtgaagaagaaacacctattactcataataaaagatcagattctcatatgttctgta

SEQ ID NO: 176004 - DNA, 537 bp, Homo sapiens
caaggatgccaagatgcttcactggggaaacaacagtcttgtcaacaaatagtgctgggacaacaggagagccacaacgaagactgacccttaccgcacaccagggcaaacaaaaagcgaaagctataaaacacttagtagaacacaggcataaatcacggcaatggttttcgctaggacaccaaaagcacaatgatcaaagagattgataagttgaacatcatcaaaatttcaaaagttcgtgcatcaaatgacaccataaagaaaataacaagtcagtgcacagattgacaaaaaaaattcaaatcatacctttggtaagagactggcatccttacgtaaagaactcttacaactcaataatataaaagacaactcaataatataaaagacaactcaattgaaaaatgggcaaagatggctgggggcagtggcttatgcctgtaatgccagcactttgggaggccaaggcgggtggatcacgaggtcaggagatcgagaccagcctggccaacatggtgaaactctgtatctact

SEQ ID NO: 176005 - DNA, 395 bp, Homo sapiens
ggtgcggcacgaggggcagccacttgccatgtgtggttatttaaagtaattaaatttaaataaaattaaaaattgagttcctcagttgtactagccacctttgaagtgcttaatagccacatatagcttctgcattagccagtccacacataaaacactgacatcatcgcagaaagctctttgcacagtactgatctggggcctatctttctgtctcattccctgacagacccctcctacgtaccctaggctccagccacatgaaacacaagctacagatcactgaaatgcctcgcattccttggcattagcagaatgaacctcttccttgtgttgtcagttgcattcctaagaatcaatgctgacacaaatcaagcatgagtcctcggtgagtt

SEQ ID NO: 176006 - DNA, 140 bp, Homo sapiens
caacaacaattgccctagtcttttctcccaagatgatgggaattgtgaactttcatgccaccaaaatgacttgcccaaacactgtgttaaaagacttgtcccgattttagcctggcttccatttacactagcctatgtcc

SEQ ID NO: 176007 - DNA, 371 bp, Homo sapiens
tgaggactgtggttctcaatgcagaaaatttgaccttggtttgtactttttattaaaatggagctttccatgttgcatgctaggcagaagttagaactataaggtcatacttcaagtagcttaatccatctaacagacctggataactcaaacagctagctaatgtttgtgtttcccagtacaacatttaacatgatactatttttcttacctatgttatttatgatatgtagtgtggtttatacttggtaagcaagtgaataaataaatgtcccagaggccaagtggagagaattattggattatattaggtcagatggggtggggaaggaaggaaggttactttgtgaacaacaagttgtcgtttctgt

SEQ ID NO: 176008 - DNA, 414 bp, Homo sapiens
cccagtgttctccccgatgccctccagccccaaggcaccctgaaaaacgcctttcacagcaagcctgcgtgcttctgccttcccgagccccacccccacttccctgcttttttctgatggtgggagagaaggaggagggtcctagccccctctaggctgctcttcttggagtcaaactggattcatttccagggaacctaatgtgtgattacacacgcagctagcttatctcacaggtgatagcttaccaggtttgtgtactagctcagcgcacatgtgtgtgatagcttatatgctttcctgtggtctcccatgcttatttgatagcaaacatctatggagcatcaccacacaccaggcactgtgtgaggcagcagggatacagtggaatcagacacagacaccacctcacta

SEQ ID NO: 176009 - DNA, 444 bp, Homo sapiens
cctaggtgatgaggatgatgccctttctcccaaacttctccagaacccttattttgtgactgtcacacccactgaaaaaccaacaaggggaaaacagagaagagaggatgtgtccttgggcgagaggaaggtctcaatcttccagaagaatgagggcagagaatgttttttaaagctgcgtgatccacaagtgatggggatctgaaggcttaaataaaacttccatcttctttgaagtttttgatctttaaagagaatatttagttcccattacacactattcttggtagttttgttttgtctcctgcctttgtgttttcagctatggctcaagaagtttagaagcctccttccctaccctcctcctcctcttcttgagtctgcttacaaggcaccagcaggtaccatgggggataaagaaaaataaaagtacaaagcagatcc

SEQ ID NO: 176010 - DNA, 500 bp, Homo sapiens
gaccaagaaaaggatccttatatatcgcaggagagctgaaacaagaagtcagagtgacgccttatcagatctcagcatagaacgtgtgtgttgaatgatataaagttttcacccctttgtgctgatctgtgaatgaccgtgaacatactacaaatactgatttgggggttaaaatacattttagtgactacgcaaatctgcaaacatagaactcacaaataacgaggatcaactgtacgtctaaagttatgatttcctaaaagtaaatttcagaggcattgttttcatattatctattcggcttagaatagattgaggcaggcagagcaagcaagctgatctggggaaaggaaatgatgtatcatttctttggaattctgagaagttgaaatatctgcagtatgtttctacagagtatatattgaaacaatgcctatcattaaagtgagagctagaaagggaggaactacagaagaaaccagaatagcaagatgtctatt

SEQ ID NO: 176011 - DNA, 664 bp, Homo sapiens
acagcttgttcacccttcttctgtgtatgggcatttgggctcctggtttgggaccattatgtgtaaggatgtcatgaatatttatttatgtatgtagcctgtgagcttgccttcatttctcatggttcattcctaggagtgcagtggccacatcatgtcatggtaggtctgcatcgaccttgttaaggaatcactgtcccttgtgctaagtgtttggtccattgcctgctttctctcttgctccctctgatttagtcatacaaacctcttgtatccttcaccctccagggcaataacttcttagcataccgcctttctttacacttggaatcaccagctccttctttatgtgctggctctgattccctcactaaatttgccctttgtgccccatgtgtgacccattcccattgatacaccctatgtatgagagggctttgggataagagactgtttctgatgagtatcgagtactacaatggctctgaatggaagaaagatgactgggtgggtcttgtcaaccattgtccctggagctcatctttgttgttacaaataagtctgggtgtggcctgggcatatgttcaagtactcgcaaaccttttctaaatgacaactggagaccaggccatgggctggaatgtgagtatgaagttacttggaa

SEQ ID NO: 176012 - DNA, 656 bp, Homo sapiens
gctttccaatgtaccaatatttaacatgcatttatttactttgtctggagtcccacggatgatctttgaagtcttaatatttaattacatttccaccttgtgcaaaatgtttgagaaaggaactttacattacctctcaacagaatgccaatgtcatagactctctaacaagggaggcaggatgaggaaacaagattattagcttctcctaaattgtcctcactgttttgtgggaagtttgtttctgaaagatcatacacacattttgaagccaagtggaaattttgttgttgtgctttacaaacacaaagtacttaaatacttaattaagtaattcatttatcgtttggattatccaccattcattgtcctctgcttggacaactgaaaactgactgaaaagggctgatgtgactatagacattaagtaatatataactgaatgctttaaagatgacttttcattttcaaagaacttgcttatattacagaactagtaaaataatctagcattttcaaagagaaaacaaagaaagaacaaaaactcttaatatttatgccaagtaataaaaaagtatttgacagaaatgatagagatactgacgcttcatcctattagctgtggtaggctcaagaactgatatattggtaattac

SEQ ID NO: 176013 - DNA, 393 bp, Homo sapiens
tctggtctcaagtaatggagagaagtgagaaaaagtgagctcagaggaaacatcctcttccggccacatcatatcctctctctctcttgtggccttaggcatgtcgctggccttcctgggactcattatcctcattgtaaagagacagcaatctgaagctcagaaagagattggggagcatgaggtgggggagtaccaaggctaaggagaccaaagcagtgcttgggggcctcccactctttaccttgggttctaactgccacccatctcgtgcttaatgggtccttctgactccagggtgagaaatgttctccttagcatcaggagacgctgcacatgagcagttcctccccctgggagtactggttcagtgagcaaaacagcaaggggctg

SEQ ID NO: 176014 - DNA, 341 bp, Homo sapiens
ggctgtgaacaccttggagagcttcagtgtgtaaaggttgagggaaagtaggtttaaattataggtcagattcccaggccaacagtggtactgaaatgagggacgtgtttctgctggattgcatgtttttctagcacctctggcaatcaagcaccagaacttggaaagacagaggagtgtgaggtcgagcagccacacgggcagaggcaccttcttccaagcctgacaggttttgctttattagcagaatatcatctccgggtgggactagcctgcagtcagtgagggagagtgcgtaacaggaagttgatccagggagagcggcagtggccagtacccgt

SEQ ID NO: 176015 - DNA, 479 bp, Homo sapiens
cttaatcagaatgtaggtccatccctgtctcaaacggcttcagctgtggtctctaaagatctgaggagaaataagtgacagcctccctagaggctgggcctctgagtatggaactctcatgataaaagcatcacttttcatctagaaggagatatcaggaagaaagaaaaaaaggagataaaaagcatcactcttcaattcaaataagcccttgattgtgccttcgtggctttcctggatatcgcttagtgttttctctcatctttgcagcagccagccatctcttcgtcccatcttctgcatcactctgtttatatctttctccactaaattaagctacttgagggtaagtataacagttgagtcatcaccatacatggctcccctaatacatactttcttcataaggttttactttgaaataattatagattcacatgaaattggaataaatatacagaagttataagtgcctatat

SEQ ID NO: 176016 - DNA, 326 bp, Homo sapiens
tatgcctggcaatgggatacgaaacaaataagagctagcccttgtgaatcaaatagctttggtgacagaaatagatgtactaattattatatgatgtagtaaatgctataataccagtattataaccaggctatagaaacatggaaaagactatggtatggttaaggaagaggctgggttaaagaaggtttcacggagacaatgacatttgagttagaccttgacagataagtagaatttcacaaagtggaaaagattgtaaaggcatccaggaaaaagaaccagaatgaacaaaaataccaatgcctggtgacccattgcaaatc

SEQ ID NO: 176017 - DNA, 349 bp, Homo sapiens
ggttgtatgctccccgctcctctctcccctcccggactgaagggcaggtctctggccctacatggtccacctctgtcagccgccaccacactggctccgcctgggaaaatcctgcccgccgatgtgtaagtgtgtcactgccaataatagtgcgaagcctccaaatctgagggcctttctaggatcgtttcctgattaattaggtcagcatctccaaaatcaatttccagcgaagtcgcgccacctggtagcgccgttccctgcccagccaggcgagggagttggcacgggaggcaattccctggcctctggtgcagttcaggtcttgtctctacctcatctcttctgt

SEQ ID NO: 176018 - DNA, 540 bp, Homo sapiens
ttaatgtttgtgcctaaaacaaaatagcatgtagtcaacgacccttgaacatttttaggaagaggccgatttggagagggagcaacatatgcaaaaactgagagaatttggcttcgggtaggaaagacaagtagttcagtatgtttaagactgtctagtggcccagagagaaggttggctgcattaatgggggttttgaatgtaagagtgtggacttgatgctgaaaggaagctattaaaacatttataagccggaagtggcaaaatcagacttgcattattaaaagattattatagcattaatgtgtttaaaagatcatcatgacttcattgtagagattaaggttggagacctggagaccatttaagaagttattcaggtaatccaatctggagatagataatgaatattgccctgggcagtggcagtgttttggagagaattccctgggcagggtgactgcagggtatttacactttaacctaactgggctgctggttttaaccattgccctctctgggaacttgactccctataga

SEQ ID NO: 176019 - DNA, 293 bp, Homo sapiens
tccttcccagaatttcggatgactaaacaattcgcctttaaagagatctggttactggcaaagctaataagtcaaagaagttaaacaagaaaaaaatctccatcaccagggatgccaataaatctaggtagaaaggggctcctaaaagaagaaataccaatatagctacgaaaagcaagaggaagccaaaggactaccaaatgggaaaaagatatttcttattttttaattctaatgttatattctcccagttgtgttttggaatcatgtaaaatgcaaccttccaatcacat

SEQ ID NO: 176020 - DNA, 179 bp, Homo sapiens
aagccagtaactccatccgggggtgagggtgagagggagacaggtgggaaagccagcaactccatccggggctgagggtgagagggagacaggtgggaaagccagcaactccatctgggggtgagggtgagaggcaggacgtcctggaaccacagaggcttgacatccagcccagatca

SEQ ID NO: 176021 - DNA, 432 bp, Homo sapiens
gggacctccacccccacccccactccaatttgttggtacctacttataggtgtgttctcttgtcaagctggttggcttccccacaggataatgtgccagtctgatttggcttcttcagacagggaatgttcggttttctgctgtggtgagggagagtgaattgcctaactgcacagagtgcgggaggcaatctggagtcttactgcttctttttacagcctttcaaccagtcttcctctgtttgagagactcagcacctccagttcctgagccttctttgtgaatctgcctgtttctgagctcctttacttagatttcaatttattaggtctgttacattggttctcattatttatctgcttttcagattttaaaaaatctattctgttttctttgtcctcatgtgtttatgctgtgtgtgtgtgtgtgtgt

SEQ ID NO: 176022 - DNA, 111 bp, Homo sapiens
ggtcgcaccattacgctccagcctgggtgacaaagtaagactccgttgcaaaaaaaaaaaaaaaaaaaattatagacatctataataataatcaacattgtttaatattag

SEQ ID NO: 176023 - DNA, 330 bp, Homo sapiens
aatcgggcatgtgattgtaagagctgggggtcaaagagacgaaattggtttaataaaacaaaatggggccacctgggtatttaagtgtgagaccaggtctctctccaaagacaacaaagttctacatctaatgccccagggttcctttgttcaaattcagccaatctcttcatgccacgggtcttaaaagatcctgaagttacagacttcaggtacttggtgtgtatgcgcacaggtacttcatacacttcgtgtgtgtgcgcacaggtttccaaggagagggaccttagctttcttcttttctcaacagatccctcacctcctcaaata

SEQ ID NO: 176024 - DNA, 591 bp, Homo sapiens
ttcacagcgcaggttgaactcacagccttgtgcgcccgtccctgtgcatcaatgattttttaaaaatcatattcatagggctgtgtaaccatcaccacaatctaattttggaacattttttgtccccctctgcccccactgccccggagagaaaccccatacgcattagctgtcactctaatcccctccctcccaccaggccccagcccctctggcaaccactagtctacttttggccagactctgctgagacattagaacaggatttatttatttattttattttattttatttttgagacggagtctcgctctgtcgcccaggctggagtgcagtggtgcaacctcggctcactgcaagctccgcctcccgggttcacgccattctcctgcctcagcctcccgagtagctgggactacaggtgcctgccaccacacctggctcattttttgtatttttagtagagacggggtttcaccgtgttagccaggatggtctcgatctcctgacctcatgatctgcccacctcggcctcccaaagtgctgagattacaggcgtgagccactgtgcccagccttagaacaggatt

SEQ ID NO: 176025 - DNA, 384 bp, Homo sapiens
aggaggctggggcagactccagaggagggacaaggacgcctgaactacagaagcccgggtgacgctggagcagggctggaaggagagacgtgaacatcacttgggagtaacttattaggtgttatgggagacggagaaggacaagttgaggaagattcccaggtttctggtttggacaatggggtgagtgatgttgctgcaaaatgaaataggcattgagggggtggagcagcttggtggggggatgatgatgagcttgtctgggggaatgacagacaagctggaggaggtgtccagcagacactagggtatctgagcccagagctcaggaaagcactccaggctggcttcagatgcagatttgagccacggtgtactcagaat

SEQ ID NO: 176026 - DNA, 494 bp, Homo sapiens
acccctgaccccgactgagccaccattgctctccaaatgcacacgaagacggtccatgtacccagcccatacctggctctgataggtcaggaggatgcttggagaaaagccctggcccagctgtgatactgctgcagaccctggcaccagctctgccaagctgacagccttggcccccagtggggctgcccctcctcagccctccttgagctgattctgaattgcccccaaacagctggggtgatctggcatccaggccccttggccttcttcccctcaaaggctgcccagcctgcgtgcctccatcctagaggctgccccactcccagtagcttggagccatgagggctggcagctgccagagtgcagaaactgcagacagtagcgtttggggatgttttccttgccttggcactttcctcctcctgacctcaccataacccccatgagggcatggctgggtgcaggctggcccatttgcaggttgaaactgt

SEQ ID NO: 176027 - DNA, 357 bp, Homo sapiens
gagaccactttatctcccctcacctatgtagtaatttcacaacattacctgaatcccaatgtattgaagaaaaataatagattatcaagattcagaaatgtcattgcaatatgatggtgcaataaaacacgtgcaaaatggcatgtgtttttctcatcagtctatcctggaatagagcaaacccactccagagtaggagaccactttatctcccctcacctatgtagtaatttcacaacattacctgaatcccaatgtattgaagaaaaataatagattatcaagattcagaaatgtcattgcaatatgatggttcaataaaacacgtgcaaaatggcatgtgtttttctcatcagt

SEQ ID NO: 176028 - DNA, 154 bp, Homo sapiens
tttttaatgcctattgtccccgactaggctgtgtgctccatgaggacaagaagaaggactattctgttcacatctcattactcagcaccttgtttacggcacatagtgggtataaataaatgctcaataaatgatgaataggccgggtgtggtg

SEQ ID NO: 176029 - DNA, 453 bp, Homo sapiens
ggctcctccaacagccccatcccttagcacaggcggggctggcggagcactgcaggggccaggtgcagccaccgtgcagcaaggcacagctgcctgatcaaaccagatcaaaagccattcgatcatccaaggactattttcattcgatatttattgatttctaccactcgctggggctgtacagggccctgagcttgccgtgaggagcacatttcagcccccaccccctcggggctcacagtctggtagaggaagcacatgaaataaaagaatttgcacatgtaaatatctcattacaaatgcgcaagagccatgaaggaaaaaaaaagaacacgatgggaggtaatcacaaagtccacttattttagacaaagtggttggcgacagccacatttttgccaagacctaaaggatgggcaacagtaaaaataaaaatcatcatcatcgtaatag

SEQ ID NO: 176030 - DNA, 337 bp, Homo sapiens
gaggagagaagaaaacttaagttatggcaagataagagcatgagaacaagccagagaagggaaaattgagaaagtggaagtaattgttagtgaaataataaatacagaagagtgtactgtagtagtggagacatcacccacccagacacagatgcactaaatagatcaatctgcttagcaaataaatgcccaggagaggaaagcaaggcaagaagcggatctcatcaaccactggaggacacaaacagtttacttccaccaaatgtactgaaaagatctcaataacaagagccatgattattcctacgttaaatatgcaatttacagattaactggg

SEQ ID NO: 176031 - DNA, 290 bp, Homo sapiens
cctgctcactttagggcaccctgggaggtgggagctggctcagcaggcagtcttataagggactgagcttcaaggcctctgtccctccaggagggaggtgcatgaccagagagggaggcctgaggatcttcttccctgccccagagggtctgctgcctgagctctgtgatagcgcagagagtaaaaggatcaagcttgattgaggcctatctctcaatgcgaaagtttgctagttaagaggagagtgggaagggcatttctggcaaagagaaaagtgtgacagcgcatgg

SEQ ID NO: 176032 - DNA, 533 bp, Homo sapiens
ctggagtaggaattgagaaatgcttattagctcaattcctctttctgatgtaaggaactaggcgaatgcgaatggctcttggctgtttctttgctgtcagagaggctgacattccaaagatgcttccctcacccattgcctactggtttatccgtttttctgagctgcagaagagctgggatgattcagcgtcttggggtggggtggagaggagacccaggacaggcagctattgggagcttaatggtagaggtggatggactttttgttcccaggcagaggagggtgtattcgggccagtggcggtccagttagtggaggcctgtggacacggggcaagtaagctgctctctctcaagcaaggattcttccccgggcagtttccctgctccagattcccggggaggaggagacttcctgagttctcaatctggataaggcactcagaaaactggtcctacatatgttctgcttgagggctgctgcttgtagggtgcagttgggggaacagaaggataagcagatagatacac

SEQ ID NO: 176033 - DNA, 133 bp, Homo sapiens
aaacattgattttgtcaacagaatacctttcatttaggaataatatggagagagattatctcagaggctgagagcacgagacaccaaatattcagaggataattaaagtgttcttccagatgttttcaaatat

SEQ ID NO: 176034 - DNA, 237 bp, Homo sapiens
agatatacttaaaatttattctaagatgaagtcttcaaaatcaggtgtatatatcatgcttacaacacattatataatttatggctcctgcctagcaggggtcatcactgttagttcaacttttctttggcaagtctactccctgtgccccaccgtacactgctacattattgtttgtatatgtgtgtgtgagactgcatttaggcaactgtaataggttgaatttggttatttaat

SEQ ID NO: 176035 - DNA, 1212 bp, Homo sapiens
gtagtttggaaaaagcaggcagaaatgaggacacacaaaaataaaattgaagccaaagaagagaagaaattcatactggataagagaaattctatttcattttgatgaagtgttttcgaaggcctagagagactttttttctaacctcccatgttatatttatctcgtgtgcttctgaggtaactaagaaaaagaagataagaggagagaacggagaaatagattttcttttcctcttgaagcctgtttcttggtacatataaatgtaacacaatagccgcaagaatcatcacactttaagggcaagtggattttaaaggaccaaataaatagcttttttcctaagctgtatttccatctcatcaacagtaaaatggtttctaaaatgaggtgttaaaaaataaaaattaaaacattgccagatgcttttgagaatgcatactattgtgatttgagacctcataggacttaaaatatgcctttttaaaaattattcttttgctgtgagagtttgtagcttaaataattcagagtatatatttcattttacatggcaaaaatgacatgcgttttgatgatcagaattctatagtaagtcagataacacacaatataaaattacttaatgcaacactgctgcttatcaacccctccaccttttgttcatctctccatccagcaatcactgggtaagtctcttccaggactgatattttgctcaatgctggggatatcataatgaataatattttcccattttctagaaagctgatgttttaataggaggtgattactggggttaggaaagtgaatattttgtctttgatagatcctagggattatatctctgtggagagtgacccttttctttgccaaataaatctaggcccagcccaacctctatgaagttctttttcccttgattacctggaattaatatgcttgtcctgattttcatagaccacagtaatatatattcaagtctcttgctcacctactataactttgaaatttttttagcaaaaattttaccttgaaattatctcaaaacccaacttgtcctcaagttgctgaaataaaggtagcaaaaaagaaattatacagcgaatctatcagacctccattttaattcttagagttaaattttgacataattccttcccaaaatttagtagcatttttttctttctttcattttggtattcggatagc

SEQ ID NO: 176036 - DNA, 430 bp, Homo sapiens
tcgctcatcttgcccaggctggtcttgaactcctgggctcaggtgatcctcccaccttggccccccaaagtgctgagattacaggcatgagccaccatgcctggacactgtttttaaatagtgaaaaaaagacttgaagtactctttgtgaagattgagacttcttgctacataggatttggaatcacaggcttctagagacagaagggggtcttaggaattcacattttaaagaaggaggaactgacacccataggagttaaatgtcttagctaaggctactcagtgctctggtgagagacaaggcttccatcttctaggccagtactcttacccctaggctaaaggttcaaaaatgtgcaggcgctggctttagtaaaatcagctatactaagcattgtcaaatgttttagccaacaacaaaacaatc

SEQ ID NO: 176037 - DNA, 745 bp, Homo sapiens
ccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtgagtaccaccccggggctgaagttggggaccagttgggggaggacatagttccattctactttgataaggaagggtgagagttcaacaatgaagatggaaatgggaatcctggacaggaaggagtagcccaagcagtggtgtggaagtaggcaggcaagcccggagatgtctggggatcagtgaagaatggcacttggctggagtagaagataagatgcattttggagaacag

SEQ ID NO: 176038 - DNA, 482 bp, Homo sapiens
cttcaccaccacccctcttacatcttcaggataccatctcctgggctccttccccaaggctggaaaacagcctccacctctgtgattctataagccttccttctattttattaccctttacaattctatctctctcctcttctccatcatgcatcccaaaagaagggtctgattattttcatcactcttcctatatttactccaactattgcagccagacctctctctgcttcctgcaaggtgcctactgatttccaggttgccaaacgcaatggctttgagctttctgttctacccttctgaaacccactctgccctttgattctgtggtagtgcaacatcctggtgctcctgggaccaggatggtctatctgtccattcctagacccttccagtttcctcctcttttgcccatcccataaatgagagtaatccccacaatcaaaggtggccacatttagcaaaaaaagacagaaagccca

SEQ ID NO: 176039 - DNA, 532 bp, Homo sapiens
tggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttc

SEQ ID NO: 176040 - DNA, 248 bp, Homo sapiens
ggaaatgaagcttgagactctacttagatatcaaatttagtgctattctcatcatctttaatgtgttttctttcacaaatgactactagtggatgtgtttaagtccaaaaaaaaccctctgatgaggtttaagatttggggctttaagcatcctgttgacttctattgttagtttcactatattaaatttgagttaggctaatagtaagttttatttttctgtttttcattagtttttatgagttaag

SEQ ID NO: 176041 - DNA, 468 bp, Homo sapiens
ttaagagattggggtatccaagaaggaatgcatatatgacaagagaatctgtatcacaaatatataaaacaacctcagtaaaggtggtggggaaggtgacaacctagataactatggaaatgagtgaagtctgtaagactaaatacgataggaactgcatataagcactgtactctagttgataaagatgttttccatgaggatatggattaacaattctaatactactatgtatctatactggaattgaacaattaagtaaatggatgatgcagggtacgagccagttttctcactgctggagtgagaatctacagataagctggaagaggagattagaatgatctatgtggtactgtataagagttggcgacatatgtatgaactcatgtttagctaaatagatctacagatagttgcaagcagaaatatttatagatacatgtattgcacaggttagtacacaca

SEQ ID NO: 176042 - DNA, 167 bp, Homo sapiens
taataaagtgatgtctttttgatgatgtggaagaaatgctaaagtttttctgctcatttccactctacaggctgtgtgcatataccaaatagttttttttttaatacaatgtggaagaagtaaagtcctaatataatattctgtaactgtatattcagtcatcctcc

SEQ ID NO: 176043 - DNA, 283 bp, Homo sapiens
gacaaactcagcggtattaaatatgtaaagtaaaactaagagccaaacaaataattatttgcatgtgggccagcttcatatgtccttaagctacaatacccataataatgaatggtaggtttaaaaaatcctttccagctgggtgtggtagttcacgcctgtgatccccgcactttaggaggccaaggcgggaggactgcttgagcccaggagtttgagaccagcctaggcaacaaagtgagacccatctctacaaaaattagctaggcatggcgtgtgcctg

SEQ ID NO: 176044 - DNA, 512 bp, Homo sapiens
taatttaattgtagattttaaaataaccagaagagtataattggattgtttgtaacagaaaggataaatgcttgaggggatggataccccattttccctgatgtaattactatgcattgcatgcctctatcaaaacatctcatgtacctcatgaatatatacatgtacccacaaaaattaaaaataaaaaaaaaagaaaattttgctatctcagcaatggatttcctagttgctgaagagatctaggtatacacttctatttcaaatttaaaatgttaaaaaaaaaaagtctttacaatcattttgatgtcaaaacttggtttttaattaaaaaaaaaaaagcattcctgaaaaggtttattaaaactggttttcacacctcttatgaaaaagaagtggctcacacttataatcccagcactttgggaggccgaggcaggaggttcacttggggctaggagttcaagatcagcccgggcaacacagggagaccctgtctctattaaaaaaaa

SEQ ID NO: 176045 - DNA, 245 bp, Homo sapiens
cctcctgggcttgagcaatccttccgcttcggcctcccaaagtgctgggattacaggcggcgtgaactgccacacctggtcagaggatacttccatatcaaaaatcaaatataatataatgccatcatttgcaaataactatagaatattttaatgtttatttagcttgacctttggggattcttgttcctgatttatcatacttgttttagtcacaccagagataatgatcaaacattaaataa

SEQ ID NO: 176046 - DNA, 1795 bp, Homo sapiens
  misc_feature (1000)..(1000): n is a, c, g, or t
  misc_feature (1745)..(1745): n is a, c, g, or t
actgacttgttaatattcaatctggagatcgtatacccatggagtgttgtaggggcccctgactttttctctgaatagtaactctgaattcgtaatggctgtgtttaaatttttagttttctttctgtaggaaaagttctgtgaggatggctgcattgtgtcaacttctaagccaaagtttgggaatcttaatgaaaccaagactgtagatgttaccaggaagttcactcagagcaggctctgatgtgatgataggagctctgggagccactcacctacttcagcttatttcatctagcaattctctttgacttagtcggaaatttctgggatgcaaggaacggaaacttattcaaatcagctttaataaagaggttgttattgttcagagatgagggatgtcacagaaggaagaattgaaggaagcagatctggctgtcacaggagtagaacgtcatcaggcagctcccttctctctgcattgtcttgcctctgcttctctctgcagctcaggcaggccatcttcagcaaggctcttggtttttgcacctccatatcttggcttctatggcttttggttgccacagctttgactctggcaccagtgctgtgtcaccttgcaggtgatacaggcatgagccaccacacccagccccacttttaaaacattactgggtgagcaaattccttaataagaacatctctaaacccaagttaagtgtaaaggaaggggaccagcatgatgagaatctagatccaaagaggaccagttcagggaactaagcatgtataggctgggcataaaaatcttgaggtgaacatagtagccatcttcagcatccttaaaaggcaaggagtgattttattctgtattactccagaaaatgaacctagaatacatgagggtcattaccaaggaaactgccaaggccaggtgcagtggcttacacctgtaatcccagcactttgggaggccaaggcaaaaggattgcttgagtgnaggagtttgagaccagcctgggcaacatggcaaaatcctgtctctataaaaaataccaaaattagttagtcatggtggcatgtgcctgtggtctcagctactcaggaggctgaggtgggaggatcacttgggtccaggaggtggaggctgcagtgagctatgattgtgccactgcactccagcctgggtggcagagtgagaccctgtctcaaaaataaactaagtattgagggtgactttacacaatagaacaacatgcaaaaaatacttcacagcataagagtgaaggcagaaggaatatattttgtaaaatagaatggagctgagtgagaagctggtttgtgaagcacctgccatgaaatcctgtggccttgctggtggtagtctgcagggctgcctcaggtttcctagtggccagagaagggaaaggataagtcattgcatctgtgagagaaaataagccattagctcagaagaactttaaagatttctgcctgagagaataggaaaaatgtgtccaggcacggtggcccatgcctgttatcccagcacttggggaggctgaggcgggcagatcacaaggtcagtagatcgagaccagcctggccaatatggtgaaaccctgtctctactaaaaatacaaaaattagtcgggcgtggttgcgggcacatgtagtcctagctactcggaaggctgaggcaggagaattgcttgaacctgggaggcggaggttgcagtgagccnagatcacaccagtgcactccagcctgggcgacagagagagactccatctc

SEQ ID NO: 176047 - DNA, 1565 bp, Homo sapiens
  misc_feature (1000)..(1000): n is a, c, g, or t
actgacttgttaatattcaatctggagatcgtatacccatggagtgttgtaggggcccctgactttttctctgaatagtaactctgaattcgtaatggctgtgtttaaatttttagttttctttctgtaggaaaagttctgtgaggatggctgcattgtgtcaacttctaagccaaagtttgggaatcttaatgaaaccaagactgtagatgttaccaggaagttcactcagagcaggctctgatgtgatgataggagctctgggagccactcacctacttcagcttatttcatctagcaattctctttgacttagtcggaaatttctgggatgcaaggaacggaaacttattcaaatcagctttaataaagaggttgttattgttcagagatgagggatgtcacagaaggaagaattgaaggaagcagatctggctgtcacaggagtagaacgtcatcaggcagctcccttctctctgcattgtcttgcctctgcttctctctgcagctcaggcaggccatcttcagcaaggctcttggtttttgcacctccatatcttggcttctatggcttttggttgccacagctttgactctggcaccagtgctgtgtcaccttgcaggtgatacaggcatgagccaccacacccagccccacttttaaaacattactgggtgagcaaattccttaataagaacatctctaaacccaagttaagtgtaaaggaaggggaccagcatgatgagaatctagatccaaagaggaccagttcagggaactaagcatgtataggctgggcataaaaatcttgaggtgaacatagtagccatcttcagcatccttaaaaggcaaggagtgattttattctgtattactccagaaaatgaacctagaatacatgagggtcattaccaaggaaactgccaaggccaggtgcagtggcttacacctgtaatcccagcactttgggaggccaaggcaaaaggattgcttgagtgnaggagtttgagaccagcctgggcaacatggcaaaatcctgtctctataaaaaataccaaaattagttagtcatggtggcatgtgcctgtggtctcagctactcaggaggctgaggtgggaggatcacttgggtccaggaggtggaggctgcagtgagctatgattgtgccactgcactccagcctgggtggcagagtgagaccctgtctcaaaaataaactaagtattgagggtgactttacacaatagaacaccacaccttgtctcatgccgtttcttaactccctaatagctccctagtccacacagttggctcaagccagattctgcaagtcatccttgataccgtcctcttcctcattcccttcaatctgtcatcaagacttgtcagttctacttctgaaacacttcttgaattcatctatttatcttcatctccatcactaccacctgagtcctggccaccatcttctcacctctggactttggcaacagcttcataaactggtctccccacactcgtgctgcttcttccaatccacccccgagagagatattttatttt

SEQ ID NO: 176048 - DNA, 437 bp, Homo sapiens
tttttttttttttttttgtagagatgagagtctccctatgtcgcgcagggtggtctcaaactcctgggcttaagccatccccccaccttgtcctcccaaagtgctgggattacaggcatgagccaccacaccttgtctcatgccgtttcttaactccctaatagctccctagtccacacagttggctcaagccagattctgcaagtcatccttgataccgtcctcttcctcattcccttcaatctgtcatcaagacttgtcagttctacttctgaaacacttcttgaattcatctatttatcttcatctccatcactaccacctgagtcctggccaccatcttctcacctctggactttggcaacagcttcataaactggtctccccacactcgtgctgcttcttccaatccacccccgagagagatattttatttt

SEQ ID NO: 176049 - DNA, 171 bp, Homo sapiens
tctatgctcctcaatgcccttaatatgttcccataagcaacagcctgtaaattgtcacatgtaagtcatctaataagtttagaacaatgaacaactcattttctgaactgggacaaacaaggaagctaaattcagtatctgatccccatgggatgtcatgggacattaggt

SEQ ID NO: 176050 - DNA, 550 bp, Homo sapiens
gtagaaactccaggctcagagagttaggttcctagcccaaggtcacccagctaagaagtgatagagccagaattcagagccagcctgtgccatttcaaatgtcccacatgttagccaagctagacagtaagcacctgggctttctctgggtcagctacctgctgtgtaggtaagaggaagactgagtctgaacaaacctgggatggagggtcaggtctgggagggctccacttcaattcacggagggtcaggcctgggaaggctccgcttcaattcacgtccaccttccttacttcttaccccatggctttcaagaaatcaggtctgcccctgaccctctgtgggtctctctggatctgtttcctggatggggctggagaatctctcatcccaggaaggaacttccagccttaaaacctgaggactccttgagtcagggtattagggtgcagtggggtggcagtgggtgtgtcatagcttctgcgtctgcttaggctctgagtttgttcgtttttgaggaaggaaagagaagcacgagtcttgttgttta

SEQ ID NO: 176051 - DNA, 384 bp, Homo sapiens
tataaccgtacaactgtaaatgttgtcccctctagtctggtgttgaagatctctgcaacaatcagccttcacagccctgctccactggcccccacttgttcccacagaaatgaaagacttggcatatttgttaccattatacagtaatcggacaatcttttgttcaatgctcttaatgttcttagaataaaaacattaaaaatgcacttaaaaaaataggaatactcattacacacaagcaatagtttttaattgagaaaaacagtctaattgaaattacatttgttatgcagacactaccaataattatcttggctttaaatatgcaaacacaaagattccttttgaattgataactcttttcagaagtggcgactactagtt

SEQ ID NO: 176052 - DNA, 516 bp, Homo sapiens
cagtgccaaaggaagccaaacccaaggcccagccgccggggttaaaggtctgaacagctcgtgtgccctgaccagttcagatctcttccggccactgctttccttcttcccaaacccctcccccaactactttatggattaagcataaaaatgcctatgggcatccacgtcctgaatctgactccttgtagtgctgagcacagatttttaggaagagagaccaggcaccccttatagaaagagctttttgatcaagagccatcaggcagcgcgtggagggcctcacctagttcttcctcctgggcttgggcatgctctcctccctgcttgcctctgctgaggactgtatttccttgaattctgcctacctactcccagcggggctacaggcgattgtctgcaccagtcctcacaggagggtgctccctgccttttggcagtcagtgctatttctctgagctaggtagcctgctctaaatcttactaggtttacaaagagaatcctccatcccacct

SEQ ID NO: 176053 - DNA, 382 bp, Homo sapiens
ctaattgataagtgggaagagagggaagtaaaaaacctggttatttcatcccaattaagaccaacttggagggaccattctagctcctgagctgctgtggtatcagctgaggctgtcctaagttttgtttgcaactccacctctcctacccactcctgcttccttttctgtcctttccccttcacggttgttgaccctagagacatttcttaataagcatcctgcatgctaagcgctaagctctgctttctggagaacctgatctgcaaaagaatcatatttttgtagaccccagtttagacctcagttgcacaggttctcttttattcatcttctcatcactttctttgccttggtcacttctcatcttttctccttagat

SEQ ID NO: 176054 - DNA, 939 bp, Homo sapiens
gacaagcaaaatgaggccagttacctgcgggaccacaaggaggagctaactgaggaactggccacgacaatcctgcagaagattatacgaaaacagaagagcaaaagttgttcatgacaagtgaaagagatgtttataaagagctaagctctgtctgagatgtgacactaggtctcagtaaacattatttcaatattctgtgattctttagtctacatcagaccccttctctggatcctcagtagttcttcccacatggtttagttcaagaaaaatgtgattaaagccatgaattttctccctttaaaaatgcacttgtatacacacacatactcacacatgcacactcacacatgcacaaacatatcacaattttgcttttgcttacaatttcagataattcatgggctcccaaccagactaactttatattctctaaatacaccctgctcattcccagccctgtgactttgattgtgctatgcccttgcccttgcctccacctcttctggtgaagacctgcacatcactgtcaactcaataccaaaccttgtggagcccagctgccatgccctatactcttagtttggccagatagtgtcccctatggctgcagacaactcacgtaggtccaaagatatggtccaagatttcaccagtgtcttctacaagatcttctatgaatgcctcagccacatccctggtcctgaggcccccatgaagacaattgaggactcaggtcctcaagtcatagaatttggtatcagtcctgattgacctgctaacatattgcctagaaaaggtattttatttagtccaagcttcgttttctcctctgtaaaacagaagatcattaaaaatctgtctcatgggattgttatggtcttagaataaaattaaaaactttggttcaagtgtgaatcattattgtctagctca

SEQ ID NO: 176055 - DNA, 438 bp, Homo sapiens
gtaggtgggtcctggcagtgggatggctgcagtttcctggctgggcctggtgcagggactctggcaagtagcaggtgaaacatggggagtgtctctagcactgtatcttctgtgccttctcactttagacttttgtgccctggggacccatgcagagggaatgcatcgcactgcttgcttgctttgcagtcactgctgctagctccatgccctacgctgtcccttgcatggtgtacctgtcaattacttctgagaaaccaaacaccccaaaactctgtggcttttgacaaggatctttctgtcttccacagccaattctccaacaccaactgagaagtgaaattccattctgatactaacttcttcctggagttagtgcagaccccacaagttaagggcccagtcccacaagactgcccctacttcagacaccagcca

SEQ ID NO: 176056 - DNA, 465 bp, Homo sapiens
atccacccgaagacaagtcttactaaaactgtttcactttaaacataaaggaaaaaatctccaagtcctctaggcacaaagaccaaacaacttataagagcaaaataattttattggcactagacttgcaaagtcaacttaaaacaaggcctcctgaagtgctaggattacaggcatgagccaccgcatgtatagctaaggtaataaagggaattgaagggcagtgtgttttagtgcagtctggctgcttctcctttctagtaattttggtgcagtgcagtgtttagaatcatggccttgtcaccctggcttccaaccctagctaattgtgggtcttacgtcaagtaatagttctaactttgttgagcgtgttaagtgcttaacacagtgtctaccattattgatgcctagcaaccaaagactacctggaacacttttggtcaaacagaggtttattagattatg

SEQ ID NO: 176057 - DNA, 719 bp, Homo sapiens
aatgaattactcactaacaggagagagtgttttttaaagctttttgtatacatcgtcataattttactgtgggagttatataagtttacatggctaccagagatatattatcaatgatgttaaatattttttgttgccttaaatttctttttttgcatttgtttaatgtcttctactgaaatttgttttttatattggttatgtttttgttatagttactgcttttttctaaagtttttctgttttacttttttaaaacttatttttaattgacaaataatagttacatatatatttgtgagtcacaatttggtgtgtctatacatgtataccttgtggaatgatcaaatcaggctaatcagcatatcgattatctcaaatatttatcacttctttctgatgataacatttaaaatcctctcttttggctatattgatagctaaaatagggtattttagcaatacattattattaaccatagtcactacattatgcaatagaacactagaagttattcctcccatctaattgaaactttgtacttgttcaccaatgtgtccccttgcctggtcccccacacatccccctttccctagcctctggtaacatccattatgctctttacttctataagtttgacttttaaattctttttagaagtgagatcatgtattatttatctctttgcacttggcttatttcacttaacatattcttc

SEQ ID NO: 176058 - DNA, 422 bp, Homo sapiens
cagacacaaaggggcagctgaatggagccaaaggacacccccacggtggggggatgtgggcagtttctgaggttgatgagaggatgaaaggaatggcctggggcataggggcaactgaggcacgacagatgagtgtcagcattgagtgtgcttgaatgctccctggcatcaggtaaactctcagccctgatccatggccagtctaggggcactaagaagacaaaaagaggaaggctgtgaccatggcctggctgtgtgaaaggcaaatcagctacctttgtttttatcggctgtttattatttatgactaattaccatgcagcaaaaagcggctacatatataattacacggcagattgattttgttattagcttcttttaattatgctgctgatctctgtttcctaaatcttcactaccca

SEQ ID NO: 176059 - DNA, 536 bp, Homo sapiens
agttttcaccaggtgtccgtttttctgctccaggacctcatccatgacacattacatttaatggtcctgtctccttaggctcttcttggctgtgacaatttctcagattcttcctgggttttgatgactttgacagttctgaggagtactagtcgggtattttgtagaatgcccctcaattttaacatttggctgacagtttttctgggatgaagacttttcactgtatacctttgaacaggttttttaaaaacatacttgaactatgttaatctataagctatttaaatgttgacgtaccttaatttaaaaggcgaactgtaggaattagaagaaaagggaggagaggaggggaggaagagggaggagggagaggaagaagggaagttggggaggagaaggagaaagagagagagaaagggggcaggggagcaggaggagcaggaggaggaggaggctacctggaggggctgggctgatcctgccttgggcccactctcccggcgacctcccggctcccagacctggctgagccc

SEQ ID NO: 176060 - DNA, 467 bp, Homo sapiens
tcttacccagccaactgtttaatctttcccgactgcctaagatggattcagtacccagctgtaacaccctacttagccctatcccagtgctatcccctatcagcaagtggtacaattgcttgaatgtttgtctgacttccttattgagttgtaagatctctaaagataggaattttgttatagtgttcactattccatcctcaagggcttaacagattctaaaatgtagtaacagttctaaaaatgtatagacaaaatctttgatccaccatccaattccccctatatataatcccattaccagaactcaggagtccactcaacaacccaggaaacaaacacttactctgatggcatctctagtagtttatccaaaagacaggaaactttctcctaaaaacagaaaaatccccacctataaaatgatggatgctcttggcacaaaacattccgaatcctaccctttc

SEQ ID NO: 176061 - DNA, 487 bp, Homo sapiens
acatccctcaacaaatcttttcggctctgcctcaacatatgcagaattacttcaacatttctctgatgcctatcatgcttcaaatcatctgttaccctgctaatattatctaacatgcctgcttcttccttgatctccttcattctagtctcaacacagcagccagcatgagagttttagagtcttggtcagataaagccagtcctccacttaaaagcccccaaaggactctcatctaatccagagtaaaagtcaaaagatctcacaatggtctacaaggccctgcacaatctgactccccacgctacttctcttatgatgttttctccataactcagctcctgccacactggccctttcagttctatgaacatgctaagcacattcctgcctctggggcttttgcactcactgttccccgcatcagcaatgctctttccccaaatatctgcctttgcattcttatttcttttaagattctattcaa

SEQ ID NO: 176062 - DNA, 123 bp, Homo sapiens
  misc_feature (19)..(19): n is a, c, g, or t
cattgccattgcttccagntttatcaacgaaagaagacagcatatttaatttagaatgtttagcttggacagaacattagtctcataaatgcgaatttgtgagtagtcaccggggtctgcatg

SEQ ID NO: 176063 - DNA, 323 bp, Homo sapiens
caacaccactgacacacacatacaaaactatccacacttgatccacactggctgatgctctgacaatgcagtgcctcccagatcgtgaggatttcaaatttccaccagcatatcctacaccatgccctccactcaagaactacccctaaaggaggaaaggaattctgagaacccaacagctggagctaagcagggaaaagggttagggttagaacaaacaaaaattcgccaccaacaaacccaggccaagtggtgttgtccagcttgtgcactgccggaagccaaggagctctattagttagagatacagccaggaccagtgc

SEQ ID NO: 176064 - DNA, 705 bp, Homo sapiens
ttgtacagcagtggcttgaaaggatataactatatttaccataaaacaagaagtagtcatttttaccttacacaatttataagaatttttagaaaaatagaaataactcacatgtaattcaggtataccaaactttcctgtcttcctactaaatggaactagaaaagcaaaatgctgattttttccaggtactccaaaaatacctttataattttaaccgtaatttgtttagtctaaaaaggtactgctccaataccagaagctacaggtgaaaaacatatctctcaactgaagacaacttcttgaataactgtgtcactgacaagtttactctctgagcttcagtttccaaactgagaaggaggaataactgccctgcctgtcccacacttctggctgctgaaataatctcaatcaatttcttttttctttctttcttttttttttttacaaactacatgcaaatttaatttttccaattcataaagtaaaaggggtccaataaaacactatcatgtcctacctcacaggttactgtaggtattgttttcaaaatgtgaacaatactacagactgaaggtggaaaaaaaaaaactagttgaaagtagaatcagtttttaagggcatggctaaggcaaaattagaaatatatatataaggctgggtgtggtgggctacacatgtaatcccagcactttgggaggc

SEQ ID NO: 176065 - DNA, 404 bp, Homo sapiens
tattttgggtagaatacaacaaaatagacaacattaaaagtatactgagcttatagcctttgtgtaatctttatccaattagtcaaatgatgtctgggaatctttacagaatttcatgataccatgattaataccaatcatcagtatcctatagaagtatagaaatgccagttaaagttttctggttgataatgataataatgttgatgatcataaaagtggtgaatatttggacagattcattcgagaaagattaacgagtgctttctttgtaccagatgaatgatgttcatgttctttctcggagaatgttgtgggttgaattgtgtcctcacaaaatttatatgttgaagtcctaacccccagtacctcagaaggtgaccttatttgaagatagggtcttt

SEQ ID NO: 176066 - DNA, 281 bp, Homo sapiens
gagcatccccctatcaaataaattctagagagaattttgaaagttttaatgtttgtctttttaactggcctgatgaaattgaggcatatgtaaaaatggaaatgtcaggctctgatgtgagggatgaagagcaggaaatcacaaatgggtcacctgtattcaaatcacatatttgtggctatgggcaagttcccaaacctctctaagtaccagcctgctcacctgtaatggtgataaataatattgacagctgcataaataggattgcagggattcagtgc

SEQ ID NO: 176067 - DNA, 642 bp, Homo sapiens
ttcctctcctcttaaaagaccagtcttcttatatatttttttatatgtactttccctggataatgtaattcactgacattacaagtattcccaatctctgataactaccaaatgtgggtctctaactagaacacacacacacatacatatagacacacacgcctgcaggaacatgatgattgatgattgtgcttttgaatgtcagaccattcgtcaaatttatttaatcaaaatgattcaaaatattgaatcatgaagtaattaaaaaacctgagccgccttcctcactctcgataaaaaaccttcagaagtcaatgggaaataaacctttctttaaaagtatactcaaaaaaaaaaaaagaaaagccaagttacaggagagccatgttgcacaactctgatttctgcagggtttaatggaagtaggttggagcctgttctgcttcctgctggtttcctttctgtatattcagttcatcgttgcctctccgtgcttgctttattcacatcttttttggtatctcaaccatattatttacccaattcatttgttcagcaaatgtttatcgagtgtttctttggaagatctggtttagaaaccaggcatatggaggttgcagtgaaccgagatcgcaccaccgc

SEQ ID NO: 176068 - DNA, 468 bp, Homo sapiens
gtgtgtgtgtgtgtgtgtgtgtgtgtgtgtgcgcatttactaggtataattcaaggggactcttctttattatgctcatatttatcatttttgcattcagagattctcaaattcatataatcagggtcaagggcataccccatggtaatggttgttaaggatttaaggatcctgggtttaacatgagcctgaattaactccttggctgtgccatgggggtgccatagatattttcctctataaccataaggatcagaatcttctttttttggagcagaggcctagccagcagaagcagaagcagaagtgtttaaggcatagggtgttgttgagccatatgttcctggaggagtggacttcagcacgccacttggtgtctacttctcctccacatgagtgatgggccatgtatcacacagtgtattggtcttctctctgagtgttctataaaacaggggctaccatctg

SEQ ID NO: 176069 - DNA, 491 bp, Homo sapiens
atttaaaaatcagagtatttctacctaaaaagagatttctttggattcttttgtagggggtggaaaaggaagctcttaggctcacaggttttacactcctatgtgacaattggctggaagtgagcagcagctactcctttagatagaccctctcccctgtccagttcagcgatttacctgcctggccttgctgctccttgagctgtagcccctcaactgtactgggaactgcctgtgaggccgctctggtacctggcatgatgctggctgggctccctgtaagtgcttggaaatgctcagccactatgggggaagcttgtgatgcagcagctctagtcagtgagccttaacaacagtcctgtgacaagacttgtggctgggcctgaggtttggtccttaccccaacccagtcagagtgcagcaccctgggccccaaccatgcttccatgcactatcaaaacgcaacatcctgcccattctcctctgaaaat

SEQ ID NO: 176070 - DNA, 734 bp, Homo sapiens
gaagcaagcctggggccccacccctgtctggcccagaagcactgctctcctgagtctctgtccctatctggagccctgccctagactgacctgcctttctgcagctgacacaggtgaattcatgaagaccgggaagggctcctaatatttccatctgaagcgggatctctgaaatttcatagacatgcggtcacgcacacatctttccaaggtctcagaagcacaacagctattcacagcttctctgagaacagacaaggggcttgcaggtacatctggcacaggagggtcaaggtggccagcacgcacatggagatgcacagctaacactggggaaaaccagactggaataatcctctgagccttctccttagaggcagcagtcaaagcaatgggagtgaatgcaattgatgagaaaaaataatgaagaaccagagaggaggacaaggaaagggggtaaaggaatcatcttgtagaaaactcatagctaagggtcaagaacggagaaggttaagcaggggagtgatcaagaggttggttgatagctctgctctgtagacctttaatttgtttggaacttggtgccaccctgccatcgtagctggcttgctaatgttccaaataacctccagcttgcttgtctctacttttctggacattatgatgcccaagtaacagaatactgttgctgagaaagatcttttacaaaatctctgttatacaattagagcttg

SEQ ID NO: 176071 - DNA, 718 bp, Homo sapiens
  misc_feature (624)..(625): n is a, c, g, or t
aatgtcttcctgaaagcggacagacaccacagccccacagatctcctccccaaccatgaactgttcccccagcatggccaaaatgagattctcccagcaacgggaggccaagcccttccgcagccgaataatccacttgccaccatttttatttgcatcatcctcccacatgggtttaattccttctttgaagagatggaagtcactgtggcctgtcaggtccccagtgacttccttctttgaagagatggaagtcactgtggcctgtcaggtccccaggacgtaccatgtggctataaaacctccagaactgctccacagaggcaaaggtgccaatctgtttgatattctgttcatagctctgtgagctcgtgggacggccgggggttctcctggagtaccaaaaagtgtagttgtactgcaggggatgctctgccggtccaggacaacagcctttctcttgctactgctctgattcttgtctcgttccgttttttccttctcaccatctttctgtgtgctgttttcttcattctgatcatggtccccactgtcatcatctttcaaagcgtcgaacttgtgttcatcctctcgccgccgctggtgaaattgacctgccgtgannggcggcatgacacagcagacgagaagacctatggggccgtcatgctagattcccaggtcaaagcgaataaattcattgggcatattggcagga

SEQ ID NO: 176072 - DNA, 490 bp, Homo sapiens
ggacattttgatcgtctggaatggagaggtgagaatatgctggaaggatataaatcatgagactctgcagtattcatgttaactatgatttactagaggaatagaaagaaataactaattatcttatgtttagtttgtcttaagtaatttagatgtttctaatggtagtcttgccatgacaagattaattctttactgttgtagtgtgcagtcaactgtggaattttttttccttgatgattataaggtcgtttgatgcacttttttaagaaggcttttcatgttaaagtcagtgagaaacctctcaaatagatctgaattaaccagggcacttggagccgcagttgattttaatgacacaatttagaaaatgagaatcaacacaaaacactttgggtttgttcatctatgttaatacgtgcattctgtcatcttcctttagactggcacttatttaaatattaaaccatcctttacactgtgtatatgg

SEQ ID NO: 176073 - DNA, 488 bp, Homo sapiens
gcattgctcaacagtttatataagaatgctaatggcagcgttaaatgtgttgtagaatacctataccttagaatacattgtagctattaaaaatgataaatctgtattaatgtgggaaatgttcacaatatattaagaagcaggttattcctaattttaaaatggacaaagggcctgaatagacatttctcaaaagaagacatacaaatgcccaacaggtatatgaaaaactgctcagcatcaccaatcatcagggaaatgtaaatcaaaaccacaatgagatatcccctcacacctgttaggatagcttttatcaaaaagacaaaatgtaacaagtattggtaaggatgtggagaaaagggaacccttgtacactggtgggaatgtaaattagtatagccattaaggaaaacagaatggcagtttctcaaaaaattgaaaatagaactaccatatgatccagcaatttcacttttgggtatatatca

SEQ ID NO: 176074 - DNA, 196 bp, Homo sapiens
cacccgtgccccgcctaagggatggtttttaagatccttcttaaaataatccttttttaaaagaccctcttaagggtctttgattcttaaatgattccactgaaagttaagtcaaattatctctgtttgcagatgacatgattgtatgtttagaaaatcccatcctctcagcccaaaaactccttaagctgataag

SEQ ID NO: 176075 - DNA, 491 bp, Homo sapiens
atttgagttttattactacgtgagtttaacctgatgcatgcccataacaacagggaggtaaaccgctgaaaagtaataaatgtgaagatgattaggatcaccagatatctggcttcccatggagatttttcacttgtcctggaattgctttacatacactgagttaaaagctactctatgacagtgggttcccagaggaacatgagatcctcccttttccaactatatagctgtgtgaggatggattttttaaaaatatacacttcaaccaaaacaacgtttcatgacagattgaatgcaggagcagacatccaaatccagctgtctcctattaagccagacagtaaagagatttgcaaaagtgtaaaacaatgtcactctcctcactagttggttctgttttaaaaaataattaaatataaatctataatatgtaaatatatagttatgttgcttatgttaacagtaataaaacatcacatttttcaata

SEQ ID NO: 176076 - DNA, 337 bp, Homo sapiens
ctgtttgcccaaagtcaaatgcctataaggcagaacgtaagacggtaggaagcaaagtctatagggagctatataatagaggctgcagattcatggcagattctaaagcacagcagtccccaacatttttggcaccagggaccggctttgtggaagacaatttttccacaggcggcaagggatggggcgcaggatggtaatggtcttgggatgaaactgttccaccaagaccctggcagaagcaggaagcaggcctagtagaaatggtagctgagtctgtagaagtaaaactatgagttggaatcagggaagatcaagaaacagggtataaaagtga

SEQ ID NO: 176077 - DNA, 316 bp, Homo sapiens
agcctagaggatcgatacaccagcgcgatcagatgggggaagctaaattccacccacaccagcacacttcagacgggggaagcctaaattccagatacaccagcacaattcagacgggggaagcctaaattccagatacaccagcgcgattcagatgggggaagcctaaattctacataaatcaacaggtctcaggtctctaaattccacataaattaaatcaaatttggatagattgattcccagacgttctgctccgagcgttgtgtgcagcgtggaagtctttctggcctgctgtgtatgagcgggaatggga

SEQ ID NO: 176078 - DNA, 273 bp, Homo sapiens
aagctgagcttagtagtttgtggtggattttgcctgttggaatgggtagtgttgctgccagcgtgttttaagagccggttagttccaccgtttttctatggttgttgctggtctttcagatttgctcacaattgaggtcagttaagcatgcacgagtgagtgcaaatccaccatcatgcaggcttccacaagcctcgttcacatcactttgtatcaaagatggtgaaagtgtttttatataacaagttaagataatgagctttgtttaaattt

SEQ ID NO: 176079 - DNA, 472 bp, Homo sapiens
gctgtggatatacaactttagaatgttgctattgactctgaaatctctatgtccttgtgaatcttaggagtctcccaacaccactacccactttatgtatttagtatcttagacaacagccaatgttgttgaaaacctggagaggcagccctggctgcctcctgccctgctgtagatgatcctgtgaacagggtccccctccagaccatgcccaacaaaggcaggttcacaggggagcctctgagctcagagcctctctgggggctctgcatgcacaaggacagcagctccctgccttggttgtgggttgaggtagggaattcaggtcttttaaaaaaggctgagtttgttcaaaaatgattctgcttgctgaacaatgacaccttaagactttagattttacatcgtgatatttctccttgattttgatttaatttgttgtgcaaatgtcttaaatgcttgtgtataaata

SEQ ID NO: 176080 - DNA, 560 bp, Homo sapiens
gggggtgaagtgttaactaagatggtgacaatgagaatgaaaagcaggggacacatttgagagggattataaaggaggaatcggcaggtttgggggatggatctgaagggaaatccaagtggaagggatgaatcagagaggattcccagcctttgagcacatataactaggtaggtaatggtactaataacaaatctccaaattttagagttaggaaatatgtttcaaatcatccgattccatgtttcttaaataggctgtaagggagtatccagattggaaaccattatagaaataattgtcaactcttctttatgacttccttccttttgcccttttcccagtggtattttccatggttctggaaatgacctactttatgccaccactatatttaggctgcaaatttcccctgtccatcctgaccaaggtttgaacaatcccatgtggagaggaacttaattgcagaataccctttgccatgcgtctttttattttccctatatgccgggggtacttttggggtgagaattgaaaaggaaaaaatggtaatgtgtggg

SEQ ID NO: 176081 - DNA, 647 bp, Homo sapiens
tgagaaaagatactaaatgaacaatatattgcatgtcagatggtgataactgctatgaagaaaagttaatagaggaagggggctaaacatgttgggagttgggggtaataaaggaaggcctgatggctaatgggacatgtgagcagagtccttgaacttgggaggaatcggcaggtttgggggatggatctgaagggaaatccaagtggaagggatgaatcagagaggattcccagcctttgagcacatataactaggtaggtaatggtactaataacaaatctccaaattttagagttaggaaatatgtttcaaatcatccgattccatgtttcttaaataggctgtaagggagtatccagattggaaaccattatagaaataattgtcaactcttctttatgacttccttccttttgcccttttcccagtggtattttccatggttctggaaatgacctactttatgccaccactatatttaggctgcaaatttcccctgtccatcctgaccaaggtttgaacaatcccatgtggagaggaacttaattgcagaataccctttgccatgcgtctttttattttccctatatgccgggggtacttttggggtgagaattgaaaaggaaaaaatggtaatgtgtggg

SEQ ID NO: 176082 - DNA, 268 bp, Homo sapiens
catctctggagggcagaggccatggacagcagaacgacactttgctccttcacagaaggaaggacagaatccaagcggttcccattttcccaggctgagatccctctctcaatgaggctggctctcggtatcttcctcaggtctcattctgccccgccccacttgcccctcccctgccactcaagggcggcaggacactgacccaagactcatagctttgggctcccagagtccctgttcaaggcgcggttgcctgtgggaaaggctg

SEQ ID NO: 176083 - DNA, 504 bp, Homo sapiens
ttatgcctttagaatattatgatcttaatatatttaggttaagtgcttataattataagctgtactttaagccacttgctgccttcctccatcattcactttaaagaaaaacttaagaaatgaaagaaaggggcaaagataaagaccacatgtccataggaactattagcatattaatctactgtgtttctatgtacacttccatcaccaaagctatgttaaggaagaggttatgccttaatcaacagtgcttgataaatgcaatctgggtgtatttcttaagtatgttcaaatttcacaagtcttacttcacagtaggggttccagttcattccatacttttacgccataacacctctgatcaaggaagaaagtctttaaaagaccccaaataattagtttccagaactaaagtcaacaaaaagcataattaatgagtacattagttgtctatctccaaagcattaacattcatgcacattttaaatgaaggagattgaagga

SEQ ID NO: 176084 - DNA, 360 bp, Homo sapiens
atgttggtcaaaaatgatttcttagagcattttaaatagaggtagataacagttggtgttagattttttaatgtcttagttttttcaatattttgatgttttaagctgcagtagaatttgtcttagcagcctactcttgggattccatgaattccatccatgtttacacagggggaggagcaaccgtattttttattaataactgtgagtgccgtttctgtaagactgctgctactgccaagctgtcacctctacccctgagtcctgactgtgtgatctgctctggatggtttgctcgttaaacttcacttcatggaatgtgaccagactgtttacttgacaaattttgccctcacattc

SEQ ID NO: 176085 - DNA, 517 bp, Homo sapiens
tgtataactagatattatgaaacccacatgacagagctgttgttataattaaagatctatttcatgccaagtagttacagactttcctgtgcctggcatttagtaagtgctccataagcaattgttattatgtttagggaatgtagtgagtttctatgacacctactgtgtgctagcactgatagaatgctgataagaggatagatgcttgcctttaaatggttttccacttagttgaaaagctaaaacttacacaagttaaactataggaagaatattcacgtgtgagtacataccagacatcactcaagtatgttagtaatgaccaagcgtgatgctcttcataaatcaatcacatattcattgaacactaatgtgtaccttaagctgcagcagtcacaaaaggttaagtcttgacttcagtggtttggaatataacacattgctagaggaaataactaatgaataatatcaaaggtgatataattaagcattataaatgggtgtttctatctca

SEQ ID NO: 176086 - DNA, 362 bp, Homo sapiens
ggcatacagagtaggatcctccttctgaagaatataaggattttagaatgctttaacttaactcatcccccttttgttttatgtgtcattgttgtctagttgatcccaagttatattttaaacttccaaattaagtaatagataaataaatgcacacatttatcaaatgcaacaggcactgttctagattctgtggatatagtaatcaacaaaacagagttttatctcttttttgtgtttgtgttctagtgtcaggagcaaaacagtaaacaagttatatatagtacatcagagggtgatgataagtgctatggagagtaatggtggggtactgctattagtactctgtatgggggatctcg

SEQ ID NO: 176087 - DNA, 361 bp, Homo sapiens
cttcccattctctgattcaagcatccatgcagttcctcaaacacttcaagcctcagcacttgcttcctactacctagaattctcttcttccagatatccaaacagcttgctctctacttacttccttcacatctttgttcaaatctcaccttcttggtgaaggcttctttggccaacctatttaaaactgtgataccaggccaggcatggtggctcaataaatatttgttctttctaagcatctatgtttctgtttatctttccacctacttggtggaaagataaacagaaacatagatgcttagaaagaacaaatatttattgagccaggctctgttctttttctttttttttttttttt

SEQ ID NO: 176088 - DNA, 217 bp, Homo sapiens
atcatctgcctcactcaacttgtagatgagccccatgacatagggacatgtctgcattattttctactgaattcctggtacctcacagaatatctggttcaaaggtagggcctaataaatatttgtcaaatgaatgaatgacaaatgacttgagcagggtcctctgaaaaggaacgcctgtgctcggcgttgtaaggaggctttcttctcactccat

SEQ ID NO: 176089 - DNA, 282 bp, Homo sapiens
aattgtcatctgtagaacattaaattcaaagaatccatgccaattaaaaaaatttagcagaagaagctctaaagttggtgctgtttacgcctttcttagcccttctgcccctctacgcttcaaagaccagcctttggccatgatttgattagaagcatttatagaacagaacaggatctggcattaaatacaatgaaaacatgccattggaaaataaacattgttagagactacgaagaaataaagattgtattaattatgttttaatgttctatgagggtt

SEQ ID NO: 176090 - DNA, 528 bp, Homo sapiens
tgtgttttcgattaagaaaacagagtctcgaacagtgtaggcactcatccttagtagacgatgacattggatggcagaattaagcagttttaaaagagccttgcacactgtggagtactgttgtggataattgaaattatggaggttgtgcaaatctctctttagcaaacaagatcaccactagtttcatattacattcattttaaattgagccagaacaattttctatttatttccacctgtcaagaagggacacactgcaaaccttattttggaggctacctgcaggtgcacatgtgaccaatgattatttctaattctgaatttattgaaagagagtggaggtgaagaggaagaggaaagttgcaaaccctgaatccattattaatttttttcagaggacagggtttttttcttttgggattaatgctcactgataaaagagggagctttagttgctttaaggcttaaggctagagtgttgtcatagttttagttgctgagtgattttgattgctaattgccctt

SEQ ID NO: 176091 - DNA, 321 bp, Homo sapiens
tctctgtaacttgacccccaaagtatgccatgtggttgggttgtgcagccaggcagagagtggtaataatagataagttggtggaataggcatggctgaaatcttctgagccttgtgggtcaaagttgggagtttgaattttaagtataacaagaatccacctgttagttttaagctggagagtataaaatttataatgtatgaagacccctttgctgttaatgttaaggcatgaccctctctcggctcaagcgtggaaaggcagtgaccctcagtggagctgggtttgagacatttctcttaaacagagcatagggagaa

SEQ ID NO: 176092 - DNA, 327 bp, Homo sapiens
agggagtaaaaaaaggaaaactggaaacagtttaaaatcttcctgaccaatctgcactcagagtgcagaaatggagtgtttgggtacaattcagaggcacagaaatagcatttaaaattctataaatttcactcattcattcattcattcaccttgtatctggtgatcacctagtatgtaccaggccctgagaatatggaaactggaggcacagtcccagtccatcctcaggactctactgttagcaaaggagtcaagcaaatcagccttttacagtagtacaaccaatgcttctgtttgtaattattaaagtcttctgaatttcca

SEQ ID NO: 176093 - DNA, 258 bp, Homo sapiens
tgtctatggtcatagtctgtctctcagatataccacgctacctgacactgtggtcagggaacagtggggagcaccagcctgcctattttatcatggcactggcacaagctggctctgggcacaaccttgaggtcagaggcaggagaaagtaggcagcaccatggctctctcggccaacacctgaatatataaagttttcccttggtgtccgacggggattggttccagaacatgcccctgaccaaaggatacccaaat

SEQ ID NO: 176094 - DNA, 300 bp, Homo sapiens
ttttgaaaagtagaattccaaaggcaataaaacattttggacatttatgagttttgcatgctattgagcctcttagataaaacttactctgtaaaattgtattattcttatttctgaaaaagtcagttaaatactgacatttctcaaaacactactttttaacatgaggtggcattaagggtgattattataaacaaatttctatttacttttgaagaagattttgttacagacacccagcattataatgtgcaattgacatttaagaataatatttagtccaaagctgaaaagtggtca

SEQ ID NO: 176095 - DNA, 443 bp, Homo sapiens
cttacaaaaatggtttccgagcctcacccgcaaggattctgacttggcaatggaagaatgaaaggcaacccagagtgaaattaggattacaattttacaaacgtctgtttctgacgcaggaagcacatcatttgtccacatcacactctcttggaatttatgacaaagccaggtgagagccgggctgggaatgacctttgtccaagaaaaaaatgttttgctgagtaaattaagagtgcaaataagactggggaaaaaacttaaattgtacatgaaaacttttgaaaatattttagtaatgtcaacttaagtacaattgatacctggattgcctaattccataattcaggaagcttcccactcacctccacaaaatattagtttgaattaattatatttaattatatgtgaatgcctcaaattaaatgatcccaatgctcact

SEQ ID NO: 176096 - DNA, 255 bp, Homo sapiens
aaggaatacatcccagccaatgccggacaagatggagatgaagaagaatctctttgggctataaaatgactaagcagagaaatttggaggcgaatggcagagcctcctcctcttccagattgactgtttagaggttgacaggggcatcatgccctgccattgcttcatttctgcttagagacagtattaaaagttcctggacaggtgccaaaagtaccgttgacatgcaatgagtctcacaagaccatcaccttc

SEQ ID NO: 176097 - DNA, 161 bp, Homo sapiens
ctattcactgtgatcaaacaaaggtgctctgacctgcccatgaaggtgaagactgcgatgtcaaagcaaccctttcctctccttctttcctctgcttggtaaagctgtagaactggaactgtgaaagggttttatctgaggggttcattcgtccaagctca

SEQ ID NO: 176098 - DNA, 423 bp, Homo sapiens
tccaagttaagattgataatgggaggaaggagattaaatggacagtttcaatcctgaaagggctctcaaaagataaacagatgagtaagcaaccacttgttaaaatagtcacgagttattttccatcttaagagtctattatacaactgaataataaagaggtccatgaaaaacagataagggagagattcatttgtgaaaatgaaagcagagatttcttttaaaagatgaaatctgaaaaagagtaagatttcagccaagagaagtatgaggtacaaatagagataacgaacagaaacctagcagaggaaaagcccaagctgatcctaggaactggtaataatctctcctagatatagacaaaaaacaaggtgcacaatggccatggtcctaggtatggcaaaaaataaaatcatggcggcc

SEQ ID NO: 176099 - DNA, 940 bp, Homo sapiens
cttgcgatccacctgcctcagccttctgcaatgctgggattacagacgtgagccaccccgaccaatttttgtattttttagtagagacggggtttcaccatcttggaatagcacctgtagttccagctactcgggaggccgaggcggaagaattgcttgaggccagttcccgaccagcctaggcaacacagggagactgcgtttctggaaaaaacaacaacaacaccagcaacaacaaaaagcaggaaggaaggggagagggaaagagaaagagagagagagagaacgaaagagaaagagaaaaggaaggaaggaaggaaagaaagaaagaaaaaaagaaagagggatactttgagaagctttgaagtgatctgtttattgatcaagtagataggtaaggtgcatgctgccaggaggagctggggtagggagggcagggccctgctgtatgggggtgggcaggggacggcccctgctcagccctggcctccattgctacacagaatggcaggtccaaatgtgatctggtcttctgatttttcaggagaaatcaggaatctgaggtgcatgcaaaaatctcctgatttttaaatattggcaactaatttgttttaaaaaaacaacaactatgagctaatccaaaactgtttgctggtgggatccacctactgcctttgcgctggggtatggagaggtgggaggtcaatgttgacaagagccagatctaattttttgttaaagaaaagggtacttggaggtcagatagctctcttcatagctatctgaagccttcctctcccttatctcttacaatctggtccaaactcagaaagctaggccgctctcggtgagatgggcttgtctccgtctctctgtacctgtcagagcagcctgggcgcctgcaagaaaccggggcttccagttggcatttgccttccct

SEQ ID NO: 176100 - DNA, 298 bp, Homo sapiens
atcgagccggtaccctcgtataaggcaacatggtgaaaccctgtctctactaaaaatacaaaaattagccaagcgtggtggcacgcgcctgtaatcccagctacctgggaggctgaggcaggagaatcgcttgaacccaagcggatggtggaggttgcagtgagccgagatagcgccaacgcactccagcctaggtgacagagcgaaactccgtctcaataacaacaacaacaaaaagaatctggtgttctcctgaagacctcctctttcctctctgcaattaactggttctaaagag

SEQ ID NO: 176101 - DNA, 737 bp, Homo sapiens
agacatgggtcctgctgttgtggagctaagtagggaagagggcacatggacagaccattgtagtatgacaaagtgaatgcagtggtgacactgtaggaagcaaagggaggccaataattcagcgtagcagtcacctggaaaggttactggaagccataatacaggtcagattcgagccacctttccctgccttgagatttttgtaaggacacagggacataaattggcacttagtgtctaacagtgtctggcaatggatgatatcccatattatttgtagctcagattagtggaggaattagctaagaagtatagagagaatgttgctaaaataaagtaatgataccttagtcaactgtcagttactttaaggaaagaaattaaagtatatgaaatcaattagaacaaaaatagttcattgtttccaacttatgtgattggggcgaggtgttgaaaagaagtattaactagctcatgtctgggcccaacaggaaagaacaccatgactcattagtgatagctgccatgagtgctgatccattagggatgtctaccgtgagtgcaagaggaaaagaggcaacctccatgccacatgtctgcattccttaaattagaataacagctcaaggtactgggatctgactgcatgcaacctgttaaccccaaactcctacatgcttggcatttttcagagacaaagtaaacaaagtaaactttcaaaatgtctgttgtgatcc

SEQ ID NO: 176102 - DNA, 181 bp, Homo sapiens
gcagatatcaacaaactgattctaaaatttatatggaaaggcaaaagattcagaatagtcatcacagtattgaacaacagtcagccgaatgacagtacctgacttcaaggctttctataaagctacaggaataaagacagcatggtactggtgaaagaagagattactggaacagtaacag

SEQ ID NO: 176103 - DNA, 227 bp, Homo sapiens
cacttactctggatacacttgaattccccttacagactccttctcccacactggctcccactgcaagcgtggtagcctgacttacctttgacatcaatgaccactcttgctcccttattttccttccctggttccttcttttgccccctacataggccctagggttctgtactccatactcttccttcttcctttccttctctagtgaattttacttctactttttt

SEQ ID NO: 176104 - DNA, 953 bp, Homo sapiens
atctctgcaaaccttcccttaactctatgcttatttgctattccaggctttgttttcttatactggaaattattttctcttttggttacctcaaaccaggaactttttttttcttaatttgaggtaaaattcacaatttaaaatgtatttatgaagtgtgtacaatccaatggtatttagtaattcttaaagctgtgcaatcatcacttctgtgtagttccaaaacatgttcatcacctccaaaggaaatcctgtacccattaagcagtcactccccctttcctttctcttcagcccctggcaactcatctgcttcctatctctatggatgtacctactcgggatattttgtacaaatggaatcatcctttaattcccttcttgtttcttcttctgtattgtttttagtatttttcgtgaggctatcctgtcaatccctgagcttccaaagtttagttcaattcccactttctctacaaggctttacctggctgtaccctccactccacactgatcttagccttctctgaatttctgtagcatttgttctctccctttacttattttagcccttaatcacatactgctgtgaattgttagttacctgtttcaacactaccccttcttggctcacgcagatgataatctcgtagctacagaagctctggtatctccctttgtgcctagaaccaacttgaacacatgtgcaactgttgtgtctggcaagacatgaaggaataataaatcaagaaaactgaagtctagatgatgaataagagaaagcctcaaacctgtttcagttctttatccttccttatattatcttctcttggtaagagaagcatctgcttgtgtctagcagggcacttctttgccctagtagctgaacaggtgtggtggcaggaggagaatggcaggttgcccagcagtggagagcatggaagttccttgca

SEQ ID NO: 176105 - DNA, 147 bp, Homo sapiens
gaaatagacctcccaatctcagccaaggcacaaactcagagaagagtagtaggaggtagctcaggcacatggttggactgacatattttgggtgttactgtttttttttttcactcttagaaaagcttgtatttttttttaaatttc

SEQ ID NO: 176106 - DNA, 683 bp, Homo sapiens
ggacaaagatccaaaccatatcacctgctcaccaccagcacgtcgctctcttgttcgtttcgctcccttgttcgtttgcttttgctcttcctctctttcactgcctatttttctgtttctttgtatgtgtgtactttgtttgttttctttttctcctgtctcttcctctcctcctttatcaattgtttccccctccctctttgtctctttctttgactttcttcttttaaaaaaatataactagccccctctgcccagccaccacctcgtctgggaggtgtacccaacagctcattgagaacgggccgggatgacaatggcggttttgtggaatagaaaggggggaaaggtggggaaaagattgagaaatcggatggttgccgtgtctgtgtagaaaaaagtagacatgggagacttttcattttgttctgtactaagataaattcttctgccttgggatcctgttgatcggtgaccttacccccaaccctgtgctctctgaaacatgtgctgtgtccactcagggttaaatggattaagggaggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagac

SEQ ID NO: 176107 - DNA, 374 bp, Homo sapiens
aaagtcaaagacatttataagttgtagaaaacaagccagagggcagagaaaaggttttaaatagtagcttacttcagtcaattattcacacaacaaatatttatagagcatctacactcttcttgagcaaatcattccaacatagaaacaaacaaccctccatcacagtgttaatatcatgtttcaaataaacttgagaaacaataaaagcccatggtaaatagcgcaaaatatgtatgtatctcaattctaaagcagcttaatgcttataaccaaaaatatgttagcatctttggctttgtcatatttatgtaagcaatgccacaattcaaaataactattcagtgtagaggtttattttgtttacttcaaga

SEQ ID NO: 176108 - DNA, 489 bp, Homo sapiens
cgatctagaggatccggagatagcaggaggtaaggggcttggggctctttgaagataaatgtgattaaagaagatcaaccaactagtcaatggctgaatcagtgtttatgcccctttccatcggaattattctcctggggctgcggtagccattctgggtggcttatcacccggttctggaggttagaaatctgaaatgaaggcgttggcagggtcttgctccctgtgaaacgtgcagggcaatgaatccttgctgcctcctcgcttctggtgtttgcttgcagaccttggtgttccttgttctgtagtgatgtcaccccaatctctgcgtgttctctgtgctttgcgctctgtatcttcacataatctcttctctgagtctctgcgttcaaatttccttcttataaggacatgaaccattggattagagttcactaatccagtgtgacctcatcttaacttgattacatctgcagaaatcctgtttcc

SEQ ID NO: 176109 - DNA, 423 bp, Homo sapiens
acagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatc

SEQ ID NO: 176110 - DNA, 587 bp, Homo sapiens
gcagctagagtgcaggagtgctaggagcctccaaaggatgcctctttcatcccagaatctcccagcactgtcctgagcctgctgtaaagccccaggctttggagcagggtgcctgtctctcacggaaatctcccacaagcgaaaacgtggccgaagggtggcatgggtgggccacagagactcagggggaacattaaagctggaagagtgcagatgcggtgaggccgcagggaatgctgggagtctcagtaaaaggcctccctcatatcagaaacccccagggctgtcctgggtgggctttaaagtaataagctttggagcatggtgactgggtctcctgcaaaaggcctccacaagtaaaaacagggcagcagggtggcatgggcgggcagcagggactcatggaaacatagaggcagacagagggaagaatcagtgtgtacacagcgaatgctgggagcctcctgtggaggcctctttcatcccagatactcctggactgtcctgggtgggctgtaatgccccaggcttaggaggatggtggctgtgtctctcgcagaaggctctcacaagtgaaaatgcggccg

SEQ ID NO: 176111 - DNA, 452 bp, Homo sapiens
gtctgcacagacttccaaccgtctccgtcaacctcctgcatgctgcctttcctgattagatgggtcactgtaagggttatttttcatttttcatgaccgccttctggttgtaagaagaaaaatgactatatgtttttccctcttaaatttcatgcacattttggtggccactctgttctcctaaggtttgaggagactgtaatctctggtttgagtcttaactcagtttctctggtctggctgctggtcaactgatgtcattctgtaacacctacagagagaaaaaagatctagcactcaatgtactaccttgtaataatataaagagaaaaaaatataaaatttgatccattattttcatccttttgtgctttattagtctcctggtcagaaaaagaaagccacggtcctaactatgctttcaagtggcttcttcacagacgaaatgggtg

SEQ ID NO: 176112 - DNA, 483 bp, Homo sapiens
gctgcctgaagttgtcctatggcatagtgatgcttttattatttatttattttttgatatctaatatcactgctaagaaaactcaccccctccagccatccctccctgtctttccccctttactgcacagctccctggaaaagctacctgcatttcctctctccacttcttccttgagccctcaccattaggcttttgcccccaccactgcagtaagccactcctgtcaatactgatctcgtgtcaccaaatccaattgcagatcaggctttcttctgcaacaggccttctttaggtggctgccttgacaccttttcccagcaatccttctaactcactgcccaggtcctgactcctctgtcctgacttgtctgctgggagagtctgctgcaagggtctaggtaccacctgtcacagccatggtcaggtacaggccctaacctcccccttgaactctatcccctatccacctggatgtttaac

SEQ ID NO: 176113 - DNA, 762 bp, Homo sapiens
  misc_feature (56)..(56): n is a, c, g, or t
  misc_feature (176)..(176): n is a, c, g, or t
  misc_feature (560)..(560): n is a, c, g, or t
taaggagtcctgaaacctctggaaaggattctatgaagggaagggatgaagagatnctctctagcctgttctagctgttcttacaaactgtaggaagaccaattagggctctatagcaccccacaggaaagatgacagtagggtgggatatggtgggacatggtggtggagatggntcataaatggctggattccaggcatattttgaaaggtaggactgacactctggcagatggactaagtggagattgtgagaaagagaatcaaagatggcttttagatttttcgcctgagcaaatggatgaatggagaaactatttaatgaaccatgcaagactgggaaaggggcatcattgaggggataattaagcttttttaacctaaggatgaatttttataagtggtaatgcttgatcaaatgatttacatattaaaaggttgataaaattgttagaccagaggccgggcatggtggctcatgcctgtaatcccagcactttgggaggctaaggcaggagaatcgcttgaacccgagaggtggaggttgcagtgtgccaagnatcgtgccactgcactccagtctgggcaacaagagtgagattccatctcgaaaaaaaaaaaattgtcagaccatcctccaaaaaggttataccaatctatctttctaccaacaatgtataagcatgtctatttcccaatatttttgccagcagggaaaaaaaatcagatgagaaaaaattttattttaatctggattttttt

SEQ ID NO: 176114 - DNA, 806 bp, Homo sapiens
ggctccttgggagcagcgggactcgagccatgttcctgaaaagctgccgagaggcctttaaggccaaacctcactagcatcaggaagggttcacatcccgagctcagtcttcagcaaagaccagagtgctggcccaccctgctccttgaatctggaaagcagtcttagaagagctgttagatgatgacgtcaggacagtgttgaaggatggtgcacactaggcctgtccagcccgtcaggggcactttgttggcctggaagtaattaagaggcttgtcctttgaacgaaagtgtgatcacttgggtttgaaacgcactcgcgggctcgcgtgaggaacgtgcagcctggcacgggttgcctctagattcctgcttccctcgctctcaccctcatgcctgctggtggtctttcacccagctccaccatgccagcgtggttttctccagtgtgtgaaggatagaaacgggctgatctatataatcttcagcttattttcctaaagaggatggaccgttgatccatatttagcttatgagagtgttgagaccgaggcagcggttgggaactgaggaactcctgctctgatcccatgagtggtgtgtgggtggtgacttgagcatggcagacatgctgtcagatgcacgcgctccaggtacacgccaccgtttcgctgttagaacacgcaggacaagatttcttcttggagttgttgagtgatccatttgaaaatgttctcaaagtattgctggtgtggtggccaaagatgtggtattttttattgtgttgactttggggtgataaagaa

SEQ ID NO: 176115 - DNA, 296 bp, Homo sapiens
gactaccactgaatcatggggagtagagaggaggtgattacaggaaatcaggaaggaaatgccagccccatgaaatcaggtcaggcttcaagatcaactggcctatcatggtctgatggttgaggagaactctcatttctcacagttcttaatgtcttagctattctgacagtgctcaggggctctcaaactcaaaaactctctatgctgatttttgttttagactattttgctcttctgcttatccgttttctagagtaataatttataccttggctttggaaacagaggtatag

SEQ ID NO: 176116 - DNA, 275 bp, Homo sapiens
agagtaggacatgatgtatcatgtaataggggttggcctatgacactgttgtgtgggcatattttgttaggtgagatgtttcagtccgtaagaggatgtgtacagtctattagttggcacttctaccctcaggtacgttgtgaaaatcacgtgagtgaatttggcttggtgtgttccagaggacatgagaaatctattttgttgagaattacaaattatattcgcactaagagatgtcactactacttcccaaatgaaaaattatctttataatt

SEQ ID NO: 176117 - DNA, 722 bp, Homo sapiens
atagaggattttccatttctcattctctgcttctcatgctcttagcatatagacggaaacttagatttggaattgtgactcttctttttttctgcgttaaatcagcctgcagtgtctgatacatatacttgggtacatttcagatttaaatatgcaatacctttgcacagggcaagatggaaagaaaagtatgccccgtggttctggctgtgttttgaaactaagattgaaggaaggagagtatattcagaggcaagtattctgaaaatactattaatagaggcatttctttgttgatttcttaagcagcctctgcattaacaagagttttagtattgggatagcttaatgaggtgctaatgagggaagaagaactgagccctctgtttagtccctcatactgcattgtttacaaggggtcaaaggttctttgcatatttctacatgagcaaaataattgcagtactttctaatcccatttcaactatcaccctgccaacctgttttcagcgtacacacacacacacacacactcacacacacacacaggcacacacacactcaactttatacaaagtggactagaagtggattacataaaatagaaggaagccgatcccctcatctctattcatttttcctagcattaactgctgacttattgacaacgtatttgtgctcagcttgagtcagtcaaatatttcattcagaaccgacaggtt

SEQ ID NO: 176118 - DNA, 404 bp, Homo sapiens
cctctcgaattgttggggttacatgtgtgagccacagtgcccaccaagggtatctccatttttaatggagaaaaggtaacagcatttcccttaccaacagaaacaaggtaatactgttacctttgttggtcacagtactagccagcctacagtgacaacaataaggtgtaaggatcagaaaagatgtataaggattacagttgacagtttttttaaaagatgccgcttacagtagcaacaaaatatatacctaggtgtaaatccaactgcaggctctttaggggagagatcagaggtattagagtcagaaaagactagtttcaaattcttatctgcttctagctccatgactctggttcctaatccccttcaactgctttatgtggtggctgaacttgtgcaag

SEQ ID NO: 176119 - DNA, 333 bp, Homo sapiens
ccataatcacatgagccaatccctcctaaaaatctctttccatattttatgtacacacatatgtataaaatccattgtttctgtggagagccctcatgcacccattgtatggcagatttaagagtgccagtatccagtgttgtcaaagacatggagcaactggaacacttattattattgctggtggggatgtaaattattcaatcacttcggaaaacagtgaagatcagcatatcaaacatttcgaaaatgatttgaaatttttttacatgttttaacaaagccagtttattttgtagttttaataaaaaaggtgccctttttgtccctgga

SEQ ID NO: 176120 - DNA, 340 bp, Homo sapiens
ccactcataccaaggctcacctggactttctcaccactcagatttgctccaacctggaaaacttaaactctaatgtcctgcttcctgaaaacagttttggtgcttctcataccctgattcctttcttctctttatacctgctccttgccttcttccttcagtacatttcctcctagtctatcaaccaaatcctcattccacttcctgcatttttcagtccaaacttgtcaagagtaacctcttcttccttgccatctctcctaagccactatgaaatggcttatgatcactttggtttcctcatcccttctcaaccttgacactctcttcccattggatg

SEQ ID NO: 176121 - DNA, 687 bp, Homo sapiens
aatgcatggcgtcagcagggttgtggatagccctggccagaaggacagtgcattctcttaggcagaagacaggccgagggcctgctccaactgggccttgagcccagtgccagggagaggctgcaggtggcctgactgtgggcggcttgctccctgaccccatagtacatctgacacaagcactacaaggaggagtttgctcagagagcatcttctgagcgccagcctggtgcgagaggtcagggactaggcagggccctgtgagcagctaggacaccccccacaaccctcaccccagctgcccccgccagggaagggctcaacccttgcctggaatatgtgctggcttaagaaacagcagtcccaccctctccgtgggtggctgaatatcaccaaggtatggagagcccgatgtgatttctggggcctgaggcctcccgtgaagggcctgcacaggcagctgcccagcgagcccagctttggctgcttctgtgaggttaatgagacaaggttggtgagaagttagctctgaggcattcgctctagtccttgaagtcacttgcattccaggaaattccagatctcaagctgggttgggggctgaggcctggcttagccaagcagcctctgtggctcaagaggactgcagggctctgaaccaagctgtcatccgtccagagcccagga

SEQ ID NO: 176122 - DNA, 341 bp, Homo sapiens
ggtgcttcctacaacagtgcttaaatacatgggaattatttatttcttcctacccatcaccaatcccagtgagattcatttaggtatagggcttgcttaaggcatattccttacttccttaattttcttagttaaaaagaaattgttatgccactgttcaagatcttttatcaaattgacagtttttgttctagttaaaaattccaaagctcatgagcctaaaatcaagagctatttgttttaaaaagatacaagatcgatataccttaatcgtatgaaataaagtctattttaaatagtatcttctaaagacaaagcctgaataaacctctgtagtaact

SEQ ID NO: 176123 - DNA, 592 bp, Homo sapiens
gactgcaggcgcccgccattacgcccggctaattttattttattttatttttagtagagacagggtttcactgtgttagccaggatggtctgtgtctcctgacctcgtgatccacccgcctcggcctcccaaagtgctgggattacaaaatgcgtgagccaccacgcccggctgatggttttattaatataagggactttaaccctttgctcaggacttctacttgctgctgccatgtgaagaaggacatatttgcttcccctttcaccatgattgtaagtttcctgaggcctccccagccctgcagaactggcacggtggctcacgcctgtaatcccagcactttgggaggccacggtaggcagactgcttgagctcaggagtttgagaccagtctgggcaatatggtgaaatcttgtctctacaaaaaataaaaaattagccaggtgtggtggtgtgtgcctgtaatcccagctactcaagaggctgagtttggagtttcacctgggcccagggatgtcgaggctgcaagtgagccatgattgcaccactgcgctccagccttacagagcgagaccctgtctcaaaaaaa

SEQ ID NO: 176124 - DNA, 566 bp, Homo sapiens
gactgcaggcgcccgccattacgcccggctaattttattttattttatttttagtagagacagggtttcactgtgttagccaggatggtctgtgtctcctgacctcgtgatccacccgcctcggcctcccaaagtgctgggattacaaaatgcgtgagccaccacgcccggctgatggttttattaatataagggactttaaccctttgctcaggacttctacttgctgctgccatgtgaagaaggacatatttgcttcccctttcaccatgattaaaagcaattttgttaatcactttagcaccaattcttgcatccctggcaatactcagaactgcttccatccaagtctttgatgtgggaaagaaacacacacacactctttcgcatgtaatctgaaaacaattcacctcttgccaatgaatgcacagcactccactttaatagagagcaagttctgtggaggtttctaatcctttctgccaaagaagagaagagagagaatcactcagcttctattgcagatgtgaagtttagcatttctttgctcactcttttactgggaa

SEQ ID NO: 176125 - DNA, 399 bp, Homo sapiens
acaggagtgattttgccccccagaagtcatttgacattcttgattgtcacaacttggaaagaagtggggacttgctgctggtatctactgggtagacagaaggatgctgatacacatctaacaattcagaagacagcctgtcacaaagaattatctagtctaaaagatcagcagtgctgaggttaaaaactcctgccatatactttgttttctcatatagcattcatgtctttctcttctaccagactaataatcttttaacagcagaaacatgttacctgaatgtagcagagctatggctgaatccatcattgcacagaattatggacaagtagattataatgccttattttgcaagtaaaattaaactaagaacacaataaattactttaaaatatg

SEQ ID NO: 176126 - DNA, 394 bp, Homo sapiens
atgctgcacttcaagtggaaagtagaagtttattcattaaagagggtctctgacccccaggaactcaaggcatcgttgaaaacggaataaagtgcatattttattgaaaacagagggattaagtaagtatatcatttccagaaacagaaaaaagaaagaagaggggggaagagagaaagagacagaaatcagaacatggaagaaaactggaaccctactctagaagcttcaatatcctcaaagtaagaaaaatggaagggaggaaataaccaacagagtaattcaagaaaactttccagaacagagaataggaattgccaggctgaaagagcccctgtacagcacgacctcactgaaagggcatctgtacagcaatgtcccactttcttggcac

SEQ ID NO: 176127 - DNA, 448 bp, Homo sapiens
cacaaatagtagtaaatacttttaaactaaataaataactgctgtcaaattcacttacagaggcagtatgccatcttttctagcgctgtgttaactaggatatgcatttccatatgccattatgctggtgtgccactctcccaacccctttttaaatccaggtacaacaattcataacatagtttttatatctgaattcaaatgagacaatctcattctgctctttctggttgaccatctgacaatcaaaattaaatgcactgagatggactttgcacttcctgatccctaccccatgccccgacttctaaatcccaggattttcctttaaaatgttccctcacgtctagtcagtggatttgcctagtacaagtactgtggaaattttcaccataaaatattcttactctagaatggccaatacttgatgggtttagccgcacttaca

SEQ ID NO: 176128 - DNA, 467 bp, Homo sapiens
tagcaccatacacatgaccaatggccaggctgctgtgtatggtgctcatcttttcacctcagccccccaaagcctgtaatcctagtgctttgggaggccgaggtgagcagattactcgagcccagaagttttagaccactctgagaaacacggcaagctcccatctctaaaaaaaattttttaaaaacaaaactaaaaacacattagccaggcatggtggtgcaagcctgtgtagtcccaactactcgggaggctgacatgggaggattgcttcagccgcaaaattcaagactgcagcaaagtatgactgtgccactgcacccagcttgggcaacagagcaagaccttttctcttaaaacaaacaaaaaaccccaaatacacatgatcaagatgaagaaaattataaaatcttatttgaagacaataaagatgatctagatcaatgaagaatttaataatacgaact

SEQ ID NO: 176129 - DNA, 692 bp, Homo sapiens
gttaaccccaccatgttctttgacatcgccgcgagcccttagactgtgtctccttcgagctgtttgcagacaaagtttcaaagacagcagaaaactttcgtgctctgagcactggagagaaaggatttggttgtaagggttcctgctttcacagaattattccagggtttatgtgtcagggtggtgacttcacatgccataatggcactggtggcaagtccatctactgggagaaatttgatgatgagaacttcatcctaaagcatacaggtcctggcatcttatccatggcaaatgctggacccaacacaaatggttcccagtttttcatctgcactgccaagactaagtggttggatggcaagcatgtggcctttggcaaggtgaaagaaggcatgaatattgtggaggccatggagggtccaggaatggcaagaccagcaagaagatcaccattgctgactgtggacaactctaataagtttgacttgtgttttatcttaacctccagaccattccttctgtaactcaggagagcatccttccacccaatttgctcgcagtatcctagaatctttgtgctctcactgcagttccctttgggtgccatgttttccttgttcccttccatgcccagctggattgcagagttaagtttatgattatgaaataaaaactaaatgccaaacaaa

SEQ ID NO: 176130 - DNA, 566 bp, Homo sapiens
agaggctgtgctttgggtatgataaatagactgttttggtgacagcattcacattgtaagggaagagcaatggtaaataaaagttgaaagtcaaatcatagaggatttagatttggccaatgattccctgtggtagtgttgatgctgtagcgagaggcaggggatggggaggaattgaagacaatgacacaatttcaagtctgggttacttgaaggaatgatgatacccagaatagagtcaggaaagacaacagcagtaggtttgtagtaaagacagtgaatttgactttagacatgttcaataggaagatatatatttgaaaataaattctactccaaataagactatgtcacaacctattataataaaaatgtcaaagatcaaagacaaagagagaattctgaaagcagtgagaaaaaagaagcaaataacatataagggaatcttaataagcctaacggcagacttctcagcagaacccttataggccaggagatagtgagatgaggtattcaacgtgctgaagggaaaaaactgccagccaagaatacttcagaaatgaaga

SEQ ID NO: 176131 - DNA, 550 bp, Homo sapiens
atcccagtggggaaaaacagacaatgagcacacatgaattatcacgtgtgtgataataagtgtaccttcgtgtataatatgtaaggtgatggtaagtggaataaaaaaaaattaagcaaggttgagccgggcgtggtggctcacgctgtaatctcagctacttgggaggctgaggcaggagaattgcttgaacctgggaggaggaggttgcagtgagccaagattgcaccactgcactccagcctgggtgacagggcaagattctgtctcaaaaaaaaaacaaaaactgctgaatgaatggaatctcccagagagcttaagagtatgatggacaggccaaaatagacaggaaattgaataggaataacagcatttgacaaattagcagttttcctttttccgccttccaaaaaaccctttcctcactcttaaataatgtaacttcagtatgagtattcctgtagcactggattcagtgtgtgcacaattaaacttcagcagccaccgctgcaagtgggctcccagaacccatctcctaagtacttctgtc

SEQ ID NO: 176132 - DNA, 584 bp, Homo sapiens
ttgagcaaacttataagattgttaatacaattaaataagatgatgtatttaagcatttagcaaagtacctgacttatagtgctctctgaatagcaactgtcattattattgtgatccttattattaggtatgcattattaagtcatataaatactttgaactatgctgtgagcctggtaagaaatgaagcaagaggagaatttcagatagatgtggggtaggacatgaggcttcagggacgttagagttgataatttattttgcattcattcaactctttttcactgaaagtcagagatgtaatgagaaaatataattaaattattaaagtccttcctcaagatcctaatattaacaggaaaacagctaaaataactctcccatgttttccagagtaaccaccagggtccaccttgacataggcatgaggcaatgccttggttcagcataaaaatgccaccaggaaacctatgtcatcttggtccaagaaacttataaataccattcattcaaaatgggcacatgtgttgagtgaggcagcagtgagtccaggacagcaacaagattatacagtctttccttat

SEQ ID NO: 176133 - DNA, 1026 bp, Homo sapiens
tagctgtgagttgctggcgctggggcgattcggtggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatggagttctatcgccaagcccagggccgcaggtggttggcgagtctttaccccggcttccatcagctcaaaagtcccttaacccaagcggacccaatggattattgggcggggaaattgggccaaattctggttctggagattgccgaagattcggacaggaagctggagacttaaacggtgctggccattggagaggtctggaaaaaggcttaaggaattgggaagcaccttttgggaattacggggaagcagtggcaacgggggggtcttccagaaggaagggggcgtgggaaagccccattttgttgatgcgctattagggagttttcggaaggcgtgtccctggataaagcggggggtttccccttgaggggcgagccagaaaccccttggtgtgcagggcacacagacaggggctggaggcccaagggcgcggaaatataggaaggggcgcacgggtataacacgagggtgttataacccccgagatctggtggttgtgctggcgagaaaaaggcccaccagggtgaaactcgggacag

SEQ ID NO: 176134 - DNA, 305 bp, Homo sapiens
tagaaagccaaccttgtcacagacactgctgcactctccctccgagagggagctggacctggctgtggcagaaaaaaattccagggagaaaagcaattttaggaaatacggtgaaatcaaaacaatgcattttacccgtctccagtgtgaagatgatgaaggttgggttgtgggagcgtggaccgcctccaccagcccgagccctccacgtgcgcccgaccgccgtctctgcctcaggtgcgtggagtttggaggctgcgttacactggattcaggtcacccatctttactcttggctctttgaa

SEQ ID NO: 176135 - DNA, 361 bp, Homo sapiens
cgcaagtgaaatcaactctttatgagctgtttgtggctgtgattgttttgtaaatgtgtgaatgataccagtaatgttggcttttcataaggctgcaggaaaacttgtaactatgactgtgtgtacattttacacaaagcagtttcgggttttatttttgtttagaaactaggaaatgacatagtggcagcatctgagttatttttatcttgaattgagagttactgtcacacctaatgcgaatttctacctaatgtttaattgggatggagtggggagacaattccagctgtttgtgatcgttgtcagagtctcaaattatgtacatagacatatttttaaaagattgaggataaagagg

SEQ ID NO: 176136 - DNA, 404 bp, Homo sapiens
tcacagctctgaaggccagaagtccaagatcaaggggccagcagcggtggtttccagtgagggctcttttcctggtttgcagtcaccttcttgctgggtcctcctctgcccatgcacacacacagagggggatcttggttgtctcctttttataaagacactagtcctattggattaaggcctgacccctatgacctcacttaacctttactaccttcttataggccctatctctaaatacaattacattaggggttagggcttcaacatatgaatttgaaggcaacacagtttagtccacaacaattagatatgttttttctttcaataaggctaagataaaagtcttttctgtgcttccaatacatgtggtgttcttgtctaccacgatctctgctaggaga

SEQ ID NO: 176137 - DNA, 130 bp, Homo sapiens
atgctaagtaatataagctttaagagggttaaaattagtccggtttcaaagatatatttgagaattatgtagtatctcttgagatagtctagagatcttagagctacgttggggcctaaggactgagaat

SEQ ID NO: 176138 - DNA, 151 bp, Homo sapiens
gccctggaggaattctatagcaattattatggggattacactttaagaatctctttaatctaaaaagtcttccatccctttagtaagcatttttgagccctcaaccaaacctaggcatgacataaagtgctacaaatgcagacaacagtaa

SEQ ID NO: 176139 - DNA, 734 bp, Homo sapiens
aggatcctgcttgaatagccagtcagaaagggagaagcaagtgtgttccaggcagaggaaacggaagggggagcccctggctgtgtagacagaggaggagagatgggcaaagaaggccaaaaaggaacacccagaaggtggagaaaagccagggagaaaatcaagacttcagagggaaaggaggcatgtgttgggtcagaggtcaaaagcaaagcaacataaaagctgagactagactcagcatcactctcagggagccctgggcagtgtgggaaggtggggcacagaaacacaggaggccagagtagatcacgcctctgctcaggtctgagtgtcagagctggagccaatccatacccctgagtagtctgtgaaggctgcctgggagagacatgtacagttacccgcctggaagggcatgcaagtgcctctaggatatgggcaataagcaggaccaggcagcctgagtgtaactctccaggttctgggactgaacacaagaattaattagaagtgtggggaggtaatagagtggggagcagcctgacctctaacccccagactcctgggggagctggaagagggcctagtacaaggatgttggcgttagaagtgtcttggacaccgggcgcagtggctcacgcctgtaatcccagcactttgagaggccgaggcgggtggatcacctgaggtcaggagttcgagaccagcctgcccaacctggtgaaaccccg

SEQ ID NO: 176140 - DNA, 194 bp, Homo sapiens
ctacccaggtagactaactgcacagcaaaacaagttgttgttttgggtttttttttctgagacagagtctcactctgtcacccaggggtcttgctttacttttctcaaatctgggcagatcagttctgaagtcggcttctgcctccagcgcaggggcaacagtctggagagatcacctggttaggtctacctga

SEQ ID NO: 176141 - DNA, 193 bp, Homo sapiens
cgaggcttgggggctggggctgggcaggtcataaggccaggaagatgagtggctgaggccacgtcagaggccttgggtgccgtgctcaggaggttggatgtggtcctgtggctggccatggagtggaagacgggaggccttgggggagggggcccaggccagggccatcagctgaggctcctctcacaccctg

SEQ ID NO: 176142 - DNA, 411 bp, Homo sapiens
cctagctgcttggtaaccaactccacttttgtctttctggttgggctcttatttccagtcctccaaagacagcaagtgactgaagggaaccagtgaaggctggtatggggctcctctcagtatgtttgccttttctccggaatcttggccctacaagtctaggttgcctttgttactcttgatgcttttaaacactgggggtttttggtttgtttttttaattgtggtcaaatacatataaaatttaccatcttacccttaagtgtgcagttcagagctattaagtgtacgttcacattgttgtacagagctgtcaccaccatcctctccagaattcttttcatcttgcaaaactgaaattctgtactcactaaacagtaactttccattttcccctccaccaagcctctg

SEQ ID NO: 176143 - DNA, 382 bp, Homo sapiens
gaatggagtaattgttttaaaaacctattgaaactacaacatagatgtgagcactaattcattctaatgataaccagtgatctaatggttagaacagacaagcagttttaggatgtttattaatacatcggaaagaagagattgaaatggaactttgtcactataaaccaaactgtagcaaagtttatgacttttcgtcgtttcgaaagttagaatttgtagtatacaaaatgatttgcatgaaattactactctgcatggctgttgtcgatgttttacagtcatttgcatgctttgcccaacaggtatttttttttccccgtgctagtaggccaaagcattataatggcctacatattatatatttggtgtgttcgggtct

SEQ ID NO: 176144 - DNA, 527 bp, Homo sapiens
aaaatcagctgggcatggtggcgcatgcctatagtcccagctacttgggaggttgaagtgggaggattgcttgagcccagaaggcagaggttgcagtgagccgagattgtgccactactctccagcctgggtgacagagccagaccctgtctcaaaaaatacaattaaaaaaaaaataaaagaaaaatggcaaataaggaaaacttctgccacaagcatgggcaaaaaatcaatatctttaaaaatataaaggtcttaaagtccataagaaaaagatggatatttcagaaataattacaaatggccaaaaccaatatgtttactctctaatagccaacacaaaatacgctattaaaataagatttttacctttcaaattttcaatgcatttttaaaaaggataataactactgctggtagggattcattggcactcacttatgcttatgttggtacattaaattggtacagatttctgaaggataatttgacaatcggcacatgccttaatcatttaatacttagca

SEQ ID NO: 176145 - DNA, 119 bp, Homo sapiens
ataggaagagaagcttagctggtagacaccacagatatgtactatgtgggtctagagagggaatcttaaagcagtgatttgtgtctgtacatttatactatcacgttcgtctttacttc

SEQ ID NO: 176146 - DNA, 460 bp, Homo sapiens
tgattctaaagcatctaaagggtgtctctttctaatgcttttgttttttgccagataccccagtggtatctttgcaatgaacattgttcatgttaatatttcactttaggaattcctaaaataaaataaaataaatgcctaaaataaaattcaaacttacctgagggtcttctattgttacaaattctgaggagactcctcccacaatactccatcaagaacattggccaagaaaaataagctccatgtcatcactccatatacatgagaagatttcaccagtttgcatttttcactgagagaccaaaatttacatggaagtctctgtccaaattcctccccctttgatatggaccaaaggggttcatctcttttcctctttgaagcgttaaaactccaactcttggttaccaagatgggtaaatccccataaggcagccaaagtgtcagctctcctgct

SEQ ID NO: 176147 - DNA, 445 bp, Homo sapiens
acacacacaagcgttcagatataaagatttcaactgtagcatcatttgtaataaacaatattggaaacaatgttggtatatattgctaagaaaatgtgttgagatcaatttagtataattatataatgagatatatgattatttcatttctttatggaatgagtgtaatgggaaaatccagtggaaagcttacgttaaagctaagaaagttaaatctttaagacctttcatatgtatgggtctttctcggggtcatatgagttttgcaaaatttgctatgtaagatgcttaattaaaaataagaaaagccacacctgttttgactcccatttgcctttagtcatttatctccctgtcaggtagtgcgggtccagcctacaatacttttagtattcagctaaggggaagttgaatagagacatatttaatttcagttcattgaggt

SEQ ID NO: 176148 - DNA, 418 bp, Homo sapiens
tacttccttcaggtcttgactctgaagtcactgtcagtgaggccttcctgttcatcctgtctaaaatttcaaaccctaacccctgcatttcctagttttcctccttagcacctgccatgaacacgctatgtattgaacttatttttctggtctattacatctccccccttgaatataaaatccagtcttgtgtttgctatttattgtccctgtagtacctagaacagttccagatatagaagacactcaaattttttttgttgttgaatcacagctgacagggtatagggaaatgagtgctctcatacactgctgagagagtgaactgatgcagcctttttgcgaacagttgtgtggtatgtaaaagtctcaaaatgtgcttgccctttgacatttctccttctaggcttttatcata

SEQ ID NO: 176149 - DNA, 109 bp, Homo sapiens
caggaggaaagacaaattgggatatttcttcccctgcttcctcgctgtttaggactgtgtttctgacagtagctgcatcccccatatgacctcagttcctgttgggtag

SEQ ID NO: 176150 - DNA, 374 bp, Homo sapiens
tcattgtcacatatctgaaatcaggatgccttttaaaacagattgctcttgccccagattcttccagaggggatttacttttgactctgctatcacttgagtacatttctgagaccattgaaagttaaattctctgcttgaggttttcccctgcctcctgcctagtagtgtgaattcagacagcaaccctgtaagactgaacttttttcttctttacgtcagggccaggtgcatgcaagcttttgtactgccccttactgcatggcatatttatttattctttactttgtactgagaatgttgctctttgataccccagtggtgggatcagaactcactgcagcctcaaactcctgctgggctcaagtgatcct

SEQ ID NO: 176151 - DNA, 427 bp, Homo sapiens
cacagtactctgagcatatttgattcttgttcaattcttaagattaaaaacaataataacaatataggtagtgaactggctctggaaacattttcggtaaatgccagccaaaagctaacacaagctcaaatgtcatttggtttatcccagtcactgttcaaagatatgaagcaattcaaaatctacttttactcaatatctctatgaagttagaaaaatttatcttgacattggcaagaaaacatatcctttctttacatatatcattttattctttttatttatttcttctatttctatataaagagaggtagctgtgtgtttatgtgcacacactccattgtaaacttaaaagctgttgttattataaattcactttctagttagacctgtggtaggacttaaagctattcagctgaaaccattc

SEQ ID NO: 176152 - DNA, 295 bp, Homo sapiens
ggaaatcaaagaatcatgagagaactggacagggactctgtgagagtctcctgagagggactctcagcaaaaccaacactgtcttgagctgtggaggaaaaaggcaaatgataataaaagacttagtctgtgttacaaataactggagcaacatcttcatttttcatctgtaagttaaaggaactggaccggatcatctgtcagctcccccttccgagctctcaacatcctacgattctagttggagataaaagaatattcaccagcaaatgtttacaaatgggagggggaaggg

SEQ ID NO: 176153 - DNA, 193 bp, Homo sapiens
tatcttcattagtccctccatgcccagtctagatcccatttactcctgtctttgcaattatgtttttttccattatgttcaatccttccctgtcactgtttcaacagcttattctgtcgcaaaaaaaagaaagtgaacgtggggaggggaggagctgaggagcaagggaggagctgaggagcaagggaggagc

SEQ ID NO: 176154 - DNA, 885 bp, Homo sapiens
ctcactatgttgcctatgctggtctcaaactcttgagctcaagcgatcctactgcctcagcctcccaaactgctagaattacaggcatgagctactgcacccagcctcaagggcccattaaaaaatgtgcaacaacctagtggagaattaaaagaaaaaatgcacataaaaaattgcttatgagatcagaattcctgagacaccagaagatggctaagaagaaaggcaggcactatcgatatcagtcatgtggcctgctctgcagaggataccaccttcttttgccacaaaggtaaccaacagccatggccatagcaagctagtttgcactccagagccaagatctctctgcatgtccacactccaaacaccagctcagctgccattgagagcccatgctccaggccctgactccaaggctgggctgtgcacacctataccgcaaacagtaaagccactgccatagtaagggagtttacaccctgggccccagagccaaggtttctctatgtgtttacaccctggagaccagctcagtcatcacagagggccaggccttgcctccacactaaagccgctgtagctgtgtgcacacttgtgctcttgtccctgcctgtttcacaagctcccatacttcaccagcagggtgtctgtgccctgggcaccagtgccattaccaccccagagctatagtccctttacatatgctgctctgtgggcatcactcatcagacaccagttccattgccacctcaagtgggcttgcatgccagacccagtgtcaagaaggatccctttagccacaacttccctggtcggggaaagagagatcaagaggaccctacagtcatcatcaccaagcaccccaacagcccttaccactgc

SEQ ID NO: 176155 - DNA, 610 bp, Homo sapiens
tgaatgcagcctgctgagcctgggggctcatccctcccatgggaggctggagtttctgctgtggatgctgctggggcaggccagccctccaaacaccagctcagctgccattgagagcccatgctccaggccctgactccaaggctgggctgtgcacacctataccgcaaacagtaaagccactgccatagtaagggagtttacaccctgggccccagagccaaggtttctctatgtgtttacaccctggagaccagctcagtcatcacagagggccaggccttgcctccacactaaagccgctgtagctgtgtgcacacttgtgctcttgtccctgcctgtttcacaagctcccatacttcaccagcagggtgtctgtgccctgggcaccagtgccattaccaccccagagctatagtccctttacatatgctgctctgtgggcatcactcatcagacaccagttccattgccacctcaagtgggcttgcatgccagacccagtgtcaagaaggatccctttagccacaacttccctggtcggggaaagagagatcaagaggaccctacagtcatcatcaccaagcaccccaacagcccttaccactgc

SEQ ID NO: 176156 - DNA, 1320 bp, Homo sapiens
atggttggagacacattaaaacttctgtctccactgatgacaagatacttctttctgcttttttattctactgattcttcagacctcaatgaaaatcaacatcccctagattttgatgaaatggcttttggaaaagtaaaatcagggattagcttcctcattcagactggagttgggatcctgggaaattcctttctcctttgtttttataacttaattttgttcactggacacaagctgagacccacggacttgattctcagccaactggccttggctaactccatggtccttttctttaaagggatacctcagacaatggcagcttttggattgaaatatttgctgaatgacactggatacacaagcagcaagtccaacacaatcacagcaacagactctcctgcagaccttcccaggaagccagagccacacacaccatcatggtcctggtgagctccttttttgttttctattcagtccatagttttctgacaatttggacaactgtagttgcaaacccaggccagtggatagtgaccaactctgtgttggtcgcctcatgtttcccagcacgcagcccttttgtcctcatcatgagtgatactcatatctctcagttctgttttgcctgcaggacaaggaaaacactctttcctaatctggttgtcatgccatgagtcttttctcttcatggaattcagctatttatcataactcttgctaagatttaggaaatattaactactagttatttgtgatagcaacatacacatggccagtaatgctcttgtccaggaagatctaataccagagctaaaaatgaaagtcatggatactgttacacaaagaacactctatataactgtgttaagtccttcagacaagttcaggaaatcaaaaagtttaaaaagggaattctttagagatttaggggagatttctcatttttgtactatgaagaatcatggaatgttttaaaaatatttttaaagcacagtttgattcaggtgcttcttgaacagcataaatcccctggagagtccacatgtaagaaagacatgtgcaggccgggcacagtggctcacgcctgtaatcccaccgttttgggaggctgaggcactcccaaatgcctcaagtgatccactcaagatgacttgaggccaggagttcgagaccagcctggccaacatggcaaaaaccctgtctcaaatacaaaaattagccaaccatgtggcacacacctgtagtcccagctactccagagggtgaagcacgagaattacttaccagcttgggtgacggagggagactcaaaat

SEQ ID NO: 176157 - DNA, 1286 bp, Homo sapiens
cgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacagggatacctcagacaatggcagcttttggattgaaatatttgctgaatgacactggatacacaagcagcaagtccaacacaatcacagcaacagactctcctgcagaccttcccaggaagccagagccacacacaccatcatggtcctggtgagctccttttttgttttctattcagtccatagttttctgacaatttggacaactgtagttgcaaacccaggccagtggatagtgaccaactctgtgttggtcgcctcatgtttcccagcacgcagcccttttgtcctcatcatgagtgatactcatatctctcagttctgttttgcctgcaggacaaggaaaacactctttcctaatctggttgtcatgccatgagtcttttctcttcatggaattcagctatttatcataactcttgctaagatttaggaaatattaactactagttatttgtgatagcaacatacacatggccagtaatgctcttgtccaggaagatctaataccagagctaaaaatgaaagtcatggatactgttacacaaagaacactctatataactgtgttaagtccttcagacaagttcaggaaatcaaaaagtttaaaaagggaattctttagagatttaggggagatttctcatttttgtactatgaagaatcatggaatgttttaaaaatatttttaaagcacagtttgattcaggtgcttcttgaacagcataaatcccctggagagtccacatgtaagaaagacatgtgcaggccgggcacagtggctcacgcctgtaatcccaccgttttgggaggctgaggcactcccaaatgcctcaagtgatccactcaagatgacttgaggccaggagttcgagaccagcctggccaacatggcaaaaaccctgtctcaaatacaaaaattagccaaccatgtggcacacacctgtagtcccagctactccagagggtgaagcacgagaattacttaccagcttgggtgacggagggagactcaaaat

SEQ ID NO: 176158 - DNA, 1702 bp, Homo sapiens
atggttggagacacattaaaacttctgtctccactgatgacaagatacttctttctgcttttttattctactgattcttcagacctcaatgaaaatcaacatcccctagattttgatgaaatggcttttggaaaagtaaaatcagggattagcttcctcattcagactggagttgggatcctgggaaattcctttctcctttgtttttataacttaattttgttcactggacacaagctgagacccacggacttgattctcagccaactggccttggctaactccatggtccttttctttaaagggatacctcagacaatggcagcttttggattgaaatatttgctgaatgacactggatgtaagtttgtcttttattatcacagggtgggcacaagagtttccctcagcaccatctgccttctcaatggattccaagccattaagctcaaccccagtatatgcaggtggatggagatcaagattagatccccaaggtttattgacttctgttgtctcctctgctgggccccccatgtcttgatgaatgcatctgttcttctattagtgaatggcccactgaatagcaaaaacagtagtgcaaaaaacaattatggatactgttcttacaaagcatcaaagagatttagctcattacatgcagtcttatatttttcccctgattttatgagtttgggcttcatggtctgggccagtggctccatggtcttcttcctctacagacacaagcagcaagtccaacacaatcacagcaacagactctcctgcagaccttcccaggaagccagagccacacacaccatcatggtcctggtgagctccttttttgttttctattcagtccatagttttctgacaatttggacaactgtagttgcaaacccaggccagtggatagtgaccaactctgtgttggtcgcctcatgtttcccagcacgcagcccttttgtcctcatcatgagtgatactcatatctctcagttctgttttgcctgcaggacaaggaaaacactctttcctaatctggttgtcatgccatgagtcttttctcttcatggaattcagctatttatcataactcttgctaagatttaggaaatattaactactagttatttgtgatagcaacatacacatggccagtaatgctcttgtccaggaagatctaataccagagctaaaaatgaaagtcatggatactgttacacaaagaacactctatataactgtgttaagtccttcagacaagttcaggaaatcaaaaagtttaaaaagggaattctttagagatttaggggagatttctcatttttgtactatgaagaatcatggaatgttttaaaaatatttttaaagcacagtttgattcaggtgcttcttgaacagcataaatcccctggagagtccacatgtaagaaagacatgtgcaggccgggcacagtggctcacgcctgtaatcccaccgttttgggaggctgaggcactcccaaatgcctcaagtgatccactcaagatgacttgaggccaggagttcgagaccagcctggccaacatggcaaaaaccctgtctcaaatacaaaaattagccaaccatgtggcacacacctgtagtcccagctactccagagggtgaagcacgagaattacttaccagcttgggtgacggagggagactcaaaat

SEQ ID NO: 176159 - DNA, 805 bp, Homo sapiens
cgggtggacattttgtttgcttttccattaatccactggtttagtttccagaacgcaatgtcagacctgaggtgacagaaaagggaaaacgtgagagagtgtcttcttccctgaagagaggtgggcctgaggcttgacagtggcgctgcctgagtgacctagccgctgggctgggccctggacagctgatcccaggttcctgcacttgtcgccacccttccgtagtccacaggcctgatggcggcggctgagccgatgggcccggcacaggttcccatgaactcagaagtaattgtggaccctatacaggttgttggcatggaatggaggatgaagagataccttttgagcagagcttttctataggaatgtcacagatcaggattcccaagggaggtccttctactcagaaggcttacccctgtgggacatgtggcctggtcttaaaagacattttgcacttggctgagcaccaggaaacacacccagggcagaaaccatacatgtgtgtgctgtgtgggaaacagttctgcttcagtgcaaaccttcaccagcaccagaagcagcacagtggagagaaaccctttagaagtgataagagcaggccctttcttctgaacaactgtgctgtgcaatcaatggagatgtcttttgtgacaggggaggcttgtaaggacttcctagccagctcaagcattttcgagcaccatgcccctcacaatgagtggaagccacacagcaacaccaagtgtgaggaggcctctcactgtggaaaaaggcattacaaatgcagtgaatgtgggaa

SEQ ID NO: 176160 - DNA, 305 bp, Homo sapiens
agaggggataaagtaacaaagaggaagaagaagtaacaaagagggagggatgactcccaagtttctggcctagaagaacatggatgcagatgagataagtaagttagtaagagagtgcttgcctcagaagaaaaatggatgaggtgcagattgtggattgtgaggtaacggcaggtgggaagagggatgaggaaaacgtcacataccgggtatgtggtacacgtggtgcagtccaggcaacacagggaatcaaggctctgctgagagtcaagagccaaggcttgaacccaggctccccatactct

SEQ ID NO: 176161 - DNA, 255 bp, Homo sapiens
cagggcacactaatgcaaggggtgggctcccaaggccttaggcagctatgctcatgtaactctgcagggctcagctcccacagttgctctcaagagttggcattgagtaggcctgtggcttttccaggcacacagtgcaagctgttggtggatctaccattctgggatctggaggacggtggccatcttctcacagctccactaggcagtgccccagtggggaaacagtgtgggagctccaactccacattttcc

SEQ ID NO: 176162 - DNA, 507 bp, Homo sapiens
aaggcaaatcctgacttcagacaggtacatgcagcacagccagtgaatgaatgaatagataaggaagccagtgggtaagagagactctctagcgtgtgcctgcacgtgtcacaagtcagggatgccccatttatgtcactggcctcatgctttgcacgttacaaagtgagtaatgtgtgctgacatttgtcttcttgacataaggcagttggcttaagggctggccagagtgtttgtgctgtgcttgcagaacaaacactattcattggttacagcaaagtggcacaagttcactgggatttacccttttgtcccctggtgttttaaaaacaaatactctttgatatatcaggtgccctgagctgaacacctaagacaataaaatgaatggaccaggctgagtgtggtggctcacacctgtaatcccagcactttgggaggctgtggatcacctgaagtcaggagatcgggaccagcctgaccaacatggcaaaaccttgtctctac

SEQ ID NO: 176163 - DNA, 246 bp, Homo sapiens
cctcagatgattcacctgccttggcctcccaaaatgctgcgattacaggtatgagccactgtgcccaaccaaaaaatttaaaaattagatggttgcagtagtgtgtctctgtggtcccagctattcaggaggctatggcaggaggatcccttgagcctaggagtttgaggtggcagtgagctatgatagcaccactacactccagcctgggtgacagtgtaagaccctgtctctaaaaaatgaagg

SEQ ID NO: 176164 - DNA, 422 bp, Homo sapiens
tcacttggaactgtggggcagggccaggcttgggcagcattgccccctgagctgcatgagtcatgtccataggatacccctacccagctctcacagtggttaggaacacaggtcagcacttataagctaggtatatcttgggcaaattctgtagcctgtctgccttggtttcctcatctgtataatcgagataatgctggtattgcttcatagggttattgtgaggattaactgagttaatacacaacaggtgcttaggagcagtgcctggcacgtaagaaacaacatagaagtgttttcattgctatgatgcttgaggggtgagcataggagggatggcgtctcctcaaaaacagcgtcccccagctcagtctcttgacccccacagcctgcctcccagctctcttcattctatcctgtcc

SEQ ID NO: 176165 - DNA, 520 bp, Homo sapiens
caccacgttggccaggctggtctcgaacccctgaactcaggtgatccacccacctgggtctcccaaattgctggtattacaggtgtgggccaccgtgcccagctggtaattcggtttagatgaggtcatgatggaattagtgaccttataagagacactaaagagcttgctccttctctccatgccacgtgaggacacagtgagagggtggccatctgcaaggcaagagagcagccctcaccaggaatggaccatgtggaccccctgatctcagacttccagcctccagaactggaagaaaatacatttctgtgatttatgtttaccttgcacccagtctatggtacattgttatggcaccatgaacagccaatgcaatataaaaatagtcactattacgacgacacaaaactcccaaactataagatacacaccctacagagcagacagattaaatagtgaaatatttttatattgcattggctgttcatggtgccataacaatgtaccatagactggg

SEQ ID NO: 176166 - DNA, 573 bp, Homo sapiens
ggtactatggcatagctgttcctatgatgtatcacttctgatctgcaatacctagctctacgcacgtgtgtgaaatcgaacccctgaactcaggtgatccacccacctgggtctcccaaattgctggtattacaggtgtgggccaccgtgcccagctggtaattcggtttagatgaggtcatgatggaattagtgaccttataagagacactaaagagcttgctccttctctccatgccacgtgaggacacagtgagagggtggccatctgcaaggcaagagagcagccctcaccaggaatggaccatgtggaccccctgatctcagacttccagcctccagaactggaagaaaatacatttctgtgatttatgtttaccttgcacccagtctatggtacattgttatggcaccatgaacagccaatgcaatataaaaatagtcactattacgacgacacaaaactcccaaactataagatacacaccctacagagcagacagattaaatagtgaaatatttttatattgcattggctgttcatggtgccataacaatgtaccatagactggg

SEQ ID NO: 176167 - DNA, 212 bp, Homo sapiens
ataattatttttgttttcacgtcagtagtcttttgttccccccattgaatttggtgattcccccccgccccccgaggattattttttaaataatgcattcccaagtattttgacttttgtgaaagaaaatactttttaaggtaattgaatacctccataaatcttgtatttccttaataatttatttggcaatgtatttaaaaacagtgttg

SEQ ID NO: 176168 - DNA, 251 bp, Homo sapiens
aatggtaccgggaaaattgggtatccacatccaggagaatgaaattggacccctctctcaccatatacagaaatcaactcaggatggactaaagacttaagtgtaagaccccaaactataaaactaccatgagaaaacataggtaaaataattcaggacattgatctaggcagagactttatagctaagacctcaaaagcacagaaaacaaaaacagaaatagacaaatgggactatattaaactaacaag

SEQ ID NO: 176169 - DNA, 707 bp, Homo sapiens
gctttggagctgctgcaagggctaagagtgtctttgtctgaagtcctcagcgtggtccatgccgtcctgtgcagggcccttctgaggccacagggacgtgcaggatggccggcaaggcctgcacagaaggggcgctggggggccttcccaggcaaggcagcagccccaccattcacagcaaggagactaccaaggagggcagagaggcggctttgggcagcaagggctgctggggtggagtcctgctggccttcccctagagaaggcgacgtggggagggcagagcaattctgagtaagggagaaccagtttatatttcactttagaaagtaattgtcacagtgcgaagtttcttcccctgaaaaagcgatataaaaaggtccatcgtggccagtgcttttggggacttgagatgatgggtatccggtgcccgggccctgcgtggtgcctcagctggatgctctgcaggtgggggaggccatgttggctgagggcaggggctcaggcaagggcagtggggtggctgagcctgcacaagttggtgcacccctgtctgggtctttttcttaaaactgcaagtccagccttatctctgagacctcctgaggctggaacctgccatcagacaggcttacagttctagccctggtaactgcaatgatgcggatgcctctgtgactggcagagcagagggaggagcgacaggg

SEQ ID NO: 176170 - DNA, 257 bp, Homo sapiens
ttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaa

SEQ ID NO: 176171 - DNA, 379 bp, Homo sapiens
ggttcagaaggcacacccaagactcaggcccctgcctcaactccacaacactgagggaggtgagtagactgggtgggaggggcagctctgcagctggccagaggctgcggggacacaaggggtactcagcagacctgggcgtctctccacaaggctcaggtaccagatctgaaataacatgaaacacagtagggggttcatcaacgtcatcatcattattcactacgtttgcttcagacctcaacatcacccacagatgattatgggtttagaaatggaatgaggttgaacttagggggtgaccacctgacttctgttttatctttgtcttttattcatgcttctttttactgagtggtcatccgcaaacaagcctgca

SEQ ID NO: 176172 - DNA, 237 bp, Homo sapiens
cctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattac

SEQ ID NO: 176173 - DNA, 495 bp, Homo sapiens
gtacctgcctggggtcccggctcacccttcatccacacccttccccatgacaggctgcctccaagccctgcagtctgtagagaacaccttcctcctcctgccctaacccaggtccccacggtaccttggtaaggggttgcaccactgccactgcacagaaccagacaccctctcccttgcgtggcatcagcatgcccaccatgggatactcatcactagcaggacaacactgacccatctgccctctccctgctggaccatggacaccttaaggccaaacacagctgactccaggtgcacactggctgagaaggagtgggttgtgcaatcatgggggagaatttctacaaccctagggtactgcaaagaatgcagccattctaaatgaaacataagatcagctggtaagttttgaatatttttctttttaaagagctttcacttctattattgggatgtattctcaacatacttctaaataattattgttggcat

SEQ ID NO: 176174 - DNA, 126 bp, Homo sapiens
attttagagatgagcaaactgaggctcacaataggtaagtaactcattcacagcttgaagctgcagagctgaacagcaaacccaatattcatgccctttgcccctaaaggctctccaatatggcac

SEQ ID NO: 176175 - DNA, 337 bp, Homo sapiens
atcctaaatcaaagcagagaatccttgccactgtccgctttcttcccaggtgaaagcaaagtttccagttctgccattctcaagcataaccaccttccacaagcaagaaattcaatactctgagctaggtgtggtggctttctcctgtaatcccagcactttgggaggccgaggtgagaggatcacttgagcccaggagttccagcctagcctacacaacatagtgagacctcctctcaaaaataaataaataaacaacaataataataaaaataaatccacctttcatatgtgtaatgaaaaatatcaaagattttttgttttgttttgttttgag

SEQ ID NO: 176176 - DNA, 471 bp, Homo sapiens
tgggcaacatagcaaaaccccatctctactaaaaatacaaaattagatgggtgtggtggcatgtgcctgtagtcctagctatttggaaaactgaggtgggaggttggcttgagcccaggaggttgcacagtaagccaaggtggcaccactgcactccaacctgggtgacaattcttttttccactgaataatattaaaatgaatattcaaattttaatatggatgacagcacattagtgggcccttaaaaatacaatgctgagctgggtgccctggcttgtacctatagtcccagctgcttagaaggctgaagctggaggatctcttgagcccaggagtttaaggttccagcaagctagaatcatgccactacactacagcctgtgcgacagcaagaccctgtctcaaaacaaacacccccatgccgtaatagtttaaaagaattatcctgaatcagggcccagaaggggg

SEQ ID NO: 176177 - DNA, 298 bp, Homo sapiens
tggaccaccatccattttcagcactaggctggatacgtatcattagaattaaacttacatggcaatcactctactttctacattaatcaacaccatttccagagtttaacaagccttgctacatagggtgctcatttggcatctgattcatccaacacagccaagtgtacaatcatgaaactcccataatattgtttgaagaaggctcccaggcctaatattagaattaaagagattttaaaagctgtcatttctccttcactctctttaatcctcacaattacgtagtgggcttttg

SEQ ID NO: 176178 - DNA, 670 bp, Homo sapiens
agcagaggaggggccagcagtagaggaggtctcagaagctgaggggcctggatgggaaaggcgccaggccctagccagctcaagaagtctgaaagcgtccccagtgagtccccactcagagccctgtcctctctcgccatggctgtccagaggatactgtctcagagaccttcaaaaccgtgtacattcctgaatggtactgggccctcagcctcagctctctgctttgtaaaagaggacaagaacaccactcctgtcccccgggtttgcctccctcaagtcactgcagatggacagaacagaaattaaatgtcttcgctgtggccacatttggccccaaagccttggcagcgcagggccaaagagcccgccctgcttcagtgggtgctgcctatgaggcttgagaaagtctcctgcctacttctctgggcctccgtctcctcttgatgtggggctggaaacagtaccctctccccagcacagctgccaccatcagagcccagcactggggcaggtatacggtggtgtaacagtggagtcgccacccacagccagcatgccccaggcccaggcctgcccagtcctggcagcctggcccacaagtagtgtccagccctggtgacaagaacagaagaggtggggtcctaggccctccccaacccacccacca

SEQ ID NO: 176179 - DNA, 594 bp, Homo sapiens
tgccttttatgaataacagaaaagagaacttttatcctgatccgctgtagtttcttagagaaaatcctgctcccaagtagaatgctggatttccatctcattctagttatagtcagaattgggttacaatcattctgaaccactgagtgtggcacaagtcaaaatgtttgttcctagagattgagatattagtcagtgatgtctggctctgaaatggttatttatagattggaacgacctggagcagccagcagagtgacaaatgaggaagaggacagaatctagctgaagaagctctggaagataccatttgaagtcttgagtgcttgaactcacaaagaaagcacatgagtacacactagcacttgagctcttcattttaaacagaataaagaatgtactgctattattgtcattttacagatagggaaattcagactcaccagggctactcagatacaaagaaaatgagccagaatttcaagcaagcctgagcttagaatcacttgaacccggggagaggcagaggttgcagtgagccaggatcgcaccactgcactcaggcctggcaacagagtgagactctgtcaaaaa

SEQ ID NO: 176180 - DNA, 665 bp, Homo sapiens
acacttcactccgtgctgtcagcaccctttgcttctgttcctgcacttgtgccaaaccctttggatgaagagcctcgttgtgcccatctctggattcctagtgccaagcatggggtccagcacttgacacatggctgttgctgaataaattaaagaacaaggattatggatggccaggtaccatgcatataacatccttattataagaactttgggccagaaaacagaacaaaaagggagagtgctttgaggccctggagatcagagcaaatctcggcaatatcacgctccaatttgaaggctgtaagtgtgtgctgctttttagcatggatgctgatcaactgcccgaggtaaaggaacctcttgaggtcaggaaggaggtctgtatgtttagtctggaggtcagtctacattttggttagctaccaaaactaacagacctaggtggttggcaattagaggcgcattttgattgttttatgccatatactctacaactcacatggcagcacttttttcctcctgatttcctttccctttgcaggaagaaatgtgtttctccttttcttggaatctccttattttctgctccgattatatcccttttttctgctgttcatacaatttcaagaattaatatgagttatgagggttctccagagaaa

SEQ ID NO: 176181 - DNA, 2676 bp, Homo sapiens
gcgagggccgctggggccgcgaagtggggcggccgggtgggctacgagccgggtctgggctgaggggcgcggcttcgcggtggaccccagcccggcaacggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaagggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtg

SEQ ID NO: 176182 - DNA, 2813 bp, Homo sapiens
gcgagggccgctggggccgcgaagtggggcggccgggtgggctacgagccgggtctgggctgaggggcgcggcttcgcggtggaccccagcccggcaacggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaagggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtg

SEQ ID NO: 176183 - DNA, 229 bp, Homo sapiens
caccaggccctacttccaacattggggattacaattcaacatgagatttggatggggacacagatccaaacaatatcacaatggctaaattttcttatgagtcatcgggctccagattaaaatttgtcattgattcactactcccagccaccccagattcttctctgttgagcctctacaactgttaaggatgttcaacctacctttccctatcttggctggaactatg

SEQ ID NO: 176184 - DNA, 2126 bp, Homo sapiens
taatgaaggcccatgtagcaaaatactgattcaatgtaaagcaaactttgaaaataagctaatagtccttaaagaaaaacttatttcagatagcaaaagacaagccaatgaactcattagttttaaaaaccaaagtcaagaaaggctgaataagaaaaagacagattatgaaaaagaattattggaaaaaagccggaagttggctttaactgtaaagggcaaagaattgagtgaggaagagttacatgagaaattcaatcaactttggaaaaagtgggtgtgtgatgtatccacaactctcccgcaagttacagagcctgacattgatttggattctgaaaacatcctttgggagtatttcaaaaacaagacgaatgtcgtgggtctactgacaaattctgcagagaagtttcaaatcaattatgataaacatatcaaggtgaataagaaatataaccatatcccaatgacattaacagtctttgagaaagagttcattaatatgactactgactacattgtttcaagatttaataaaattattaacaacatgtggaaacaacagtgtggttacaatccaaattatttccatgagattctaaagacaatagaagaagaagtgaaatctgcctctactcagaagagatacacatttacaaatacatttatcattgacttatgtgtgtgtttatttcaaagagcaagagagaattttaaggaaatgcacagggcattcaagagagcaaatgatcctgtaaactacctagaaagtaagaaagatgatttcttcacgagttttaagatctcctgtcaaggagcaacctccatcaaaacatttgttgatattctgtggtataagctcactcctgcagtctccactactatatgggaggacatgacctttaaaattgcgggggacatgcgagctacctgccctgcgttcaatggaaacaggactaacctggagaaacacattctcttctctctggcagaagaagaaaactttgataattactgggaataccttcataattcaaaatcgttttttaggagttacatcaaaaatcatattaaaagatattgttcagacaatggaggtgaaaaaatgaagactttttttgaaaaaagcttaattgatatcaagaataccatcctctctgccatccatgaatccacatcagtagctaaagataaaagcagcactgcttctgagtggttggatttattctgtgattgcctggggtgcaacttgatctttccacgaagggacttgataagcattgaacaccaggagataaaacatactgaatttcttaaagaagccatgagtgcagctttggatctcacaatgaagaaaatagaacagaattattcaagtaagcctatagaagcaatggtttctaaaattgagaaaatgctctctgaacatctctgtggctgctggaaacagtgtcccagctgtggagcaatttgtacaaacacaattcctacacatgaaggagaccatagtgttcccttccaccgtcctcaggctgtcaatggggaggaatggtatgaaacagatgattttgtcattgattgctgtactagtttggttgcaagtgattgtttgttggttttgagggatggcaggaatttcccatttaagaactatcgacaagcaggaggggattatgccatgtggagcatcaccccagatacctccatccagctatactggaaatggtttgtctctcacttcagatcaaatctagaagaaaaatatcagaaaaaatttgcaggtaaaggtaaaatccccaatgcatgggccaaaatcacaaagcaagatgtgcttgaagacttgaaaaaacagtaatactcagtgaccacaaaagagccccagtgtctgaagaaaagaggcagtgtacctgaacaatccaaaaacaactactcattacaattagaaccttcatcatttccatgtttaaaatgaaatgtgtaaaaatcaatcaattaacacattaagagatgaaaatttccagtaaaaggacttcatttctctctgcctcaattcctctagtttaaaaacaacttactaaaatctgttaatatatgatgaaatcaaataacattcattttagaaacct

SEQ ID NO: 176185 - DNA, 163 bp, Homo sapiens
ccccacttcctcctctcctcctccatttcccccataatagcctccccgagactaatgactgaggaagataagagccctttctccaaatggcagtgaatgccactaatgacagagcagatgcagcactgttaattattccacgggtattaaatgaaaacgccag

SEQ ID NO: 176186 - DNA, 406 bp, Homo sapiens
agaaaacagaacacttacccaggagaaagccagtcaccaggcaggaaatcccactcccctgagacctcatgatggaaaccacaaggccagtccatgactagctacacgcattgacatcccccactgagcctccagcaacaccgactcccaacaactagtgagcctccagcaacatccactcccaaccactagtgagccaccctgcacaccaccccactgtgctttcacacaatccagcttggctgcaactgtgtgtgagatgagctggccaccaagactctctaagccaaaaaacaagtaataatgagttgttttacttcagaatagataactggaacagaatatggcagctggaaatgagctgctgtggtaatcagaagctacaatatgtgacacgactgtgagg

SEQ ID NO: 176187 - DNA, 597 bp, Homo sapiens
ttggggtaattacagaaatttgaatatagaacacatatgtaataaaattcattttcttaggtatgattacaatattcttgttatacagaagaaaaaccttattcttgggagatgcatactaaaacattatggggtgaactgtcatcatgtgtatggttttcagatgctcaacaaaagtgtgtgagaaaataaaactgtggcaaaatattagtaactggtaaatctaggtgaagcatatattgtgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaatgtttcattttgttttgcttttttgagacagggttgcctataatggagtgcagtagcttgaccatagctcactgtagcttcaacctcccaggcacaagcgatcctcctgcctcagcctccaagtagctgcgattacaggtgcatgccaccat

SEQ ID NO: 176188 - DNA, 519 bp, Homo sapiens
atctcaactacatggtgagaaaaagagctgagtccagactggctcagaaatggagcctaagaactgcaataagtatcctagcaccttaggccctaggaaggactgttccatagttaacttctgtgtggcttcactgtaagcacaggtgacagatgggcatgtcttgaattcctagaagccattgtctctctcaatcatctgttccaacactgtatcagagaatgataaactttcagaattgaaaagggtcttaaaggacatattttccagctcttgctatatttccaacaagaggcatcatctcacatttgcttgactacctgcagtcatttctgagaagagggaattccacaagttggaagtagttcaaatcattgctcaaagctgtgtgtaaagatagtagtttttttttgttttttgttttttttttcagccaaaatttgtccccagggaacctctatccatgaaattttgattacttctcacaggaactttagcaaaagttagttgggattgtct

SEQ ID NO: 176189 - DNA, 224 bp, Homo sapiens
gcttgcttcttcttatgttctctccctgacaccaaatttcttgctgtgacacacaggttatctgtgacctggccttgcctctcaccactcccccagccatgctgaataattctgcactcctgtatctaccaagttctttctcatttctgtgctgttttttcctcacatggaacagcttctcctttcccctttttgggctggcattccctccaagtcttagcttg

SEQ ID NO: 176190 - DNA, 376 bp, Homo sapiens
agattgggggttctgggacaggggcaaagtgagggcattcaagttagtaggaggaccctgggtctggggccagaagacctgctctacttttgccatgctgtgcaaccttgagcgagtacctaatcctctcttgggtctctgtatatggggataatacctccgaggacaaatctagggtttctagatgagagttcttttcttatttttttaaacttaattcttttttttttggtgatggagtcttgctctgtcaccaggctggagttgcagtgagccgagatcatgccattgcactccagcctggacaacaagagtgaaactccatctcaaaaaaacaaaaaaataataagtagcactcgtacttgtttggagatat

SEQ ID NO: 176191 - DNA, 317 bp, Homo sapiens
tagtatgtagaacacatagaaaaatgtttgtaatacccaataagtagcctgataaataagctattcaaaaatagttgcctcctacgtggttggtatgggaaaaaaaatagttgccaatttttatttatcagccaatactttatgccttatttccttctctcctggacagtaagattctaattttaattagtaattgcaattgaaatgtaactgctggatgattattctgctttgtcttcttaaaagcatcctgacttgaaatgggaagatgtgaactcttgatttctctaatttatttccaggaataagaaatggta

SEQ ID NO: 176192 - DNA, 525 bp, Homo sapiens
cacccccactcaggccctgcccaggtccttagcatcggggactcggcccatggctctgagagtttacccttcagaggggccccctcagtgccatcccaggtgcaccccgtccccacacccaggctctgcgtcgtgactcttgtccgcatcttcttactactcactgttgtctgaaatcactttttaaagctgtgtttatctacttgcagatggtctgccctccagctaaagaaattaatgaggccaggcgttgtagctcatgcctataatcccagtactgtgggaggccaaggcaggcagatcacccgaggtcaggagtttgagcccagcccggccaacatggtaaaaccctgtctctactaaaaatacaaaaatttcgttttcgtatgatggtttgcacctgtagtcctagctacttgggaggctgaggcaggaggattgcttgaacccaggaggtggaggttacagtgagctgagatcataccactgcactccagcctgggcaacagagtgagactctgtctc

SEQ ID NO: 176193 - DNA, 301 bp, Homo sapiens
ttttggtggtgggataatcagagtaggtaggggcagtgaagagaacagggctgtgacctaggtgatgagcatctatcagggtggtaatggaaggaatagaaaagagaatgaaagggggcagtcaggaggagagactgagttgctatccaaggctgaaaagaaaatcttgggtgcagctggggacacgaagcagctctggaagcctaactgcgatggagattcagatgtaggagccagatgcgcagaagtgttgctggtgctataaaagagggcggaggcactgccagagtgggcagtgaga

SEQ ID NO: 176194 - DNA, 260 bp, Homo sapiens
agaatgttgagcggagaggaaggtcagcgccagctgtattcaagcacagagtaccacaaaaggcgctgggggcagacaggcctgagatgggatcgccactcagccacttacgaacctgtttactaacttggccacatcccgtctccccttctgacctccgtttccactgccaattaaaagtgcgacggtgtctaccttgcagggctgttttcagagtcagcgaaaatctatgtatgtttagcacctaacaccacatccat

SEQ ID NO: 176195 - DNA, 114 bp, Homo sapiens
gatgtagaaaccatgggtatgtataaataaatcacacagacatattttagtcaacttgagagaaagaatgtacttcctctccacatccagcacccgctcccgcctcccaccatg

SEQ ID NO: 176196 - DNA, 414 bp, Homo sapiens
ttggtttcatgaacaaaaccagacccaataactactgctcccatcatttcctccctcccctcggctagtgaaaaccaactcatcctcaggcccacttcctcttagatttgggcttccccaggctgttgcctttccccaagtagcttctgcttgtcctgtagaagacctttcatgctttgcttctgcagcagccgttcctgaatgcctagtgtcaactgccttcttaccacgcccaccctccctgcatgctgcatttatcccctgccacagccctgtgaccctgtgtcctgctgcctctgacttgtctgtttctgcttggccatggtctctgtgaggtcaggtgtgcatatgggcacaaaccagggcatctctttatccccagcacctggcttaagtgctgctctggaactatct

SEQ ID NO: 176197 - DNA, 450 bp, Homo sapiens
tggggtgctgaggttggggtgcaattgaatctgtcaccctggtagtaagcagagtcctgaataggttgtttttcaaccctccccccctcctgcccttcccactcttgtagtcctcagggtctgttgttcccatctttatgtgggacacattttaaaagcttaatacagactgcactctggtactcaaagagtctcatttctcttgtaggttacagtcccaccatttgttgatcctcttttttttttttttttttttaaattgatcattcttgggtgtttctcgcagagggggatttggcagggtcataggacaatagtggagggaaggtcagcagataagcaagtgaacaaaggtctctggttttcctaggcagaggaccctgtggccttccgcagtgtttgtgtccctgggtacttgagattagggagtggtgatgactcttaacgagc

SEQ ID NO: 176198 - DNA, 411 bp, Homo sapiens
ctgccacccacctcccagagcctcataatgcttgatctctgtagcactgaagtttgggattctaaattcccaagtgttccatagtggggaaggccagaagtgtgctaggctgggaagtgggtggcagtaaggagaaaatcttcacctgtttgagattatttagagctctgcttagaggcaagacgttagacaggacacatgggtgaggtgacagagacccgtactggtctctctttctgagcctcaattttcccactcatagccagaggtaattccaggccactcccacagtggttttgaacctcgaagaaatctccttgtttatcacagagattatctactgtacagaatgtgttaatcatgggagatgatggaggtgagaagaaggatttttagcaagaaacaaaatct

SEQ ID NO: 176199 - DNA, 479 bp, Homo sapiens
tccctgtcccaagtgcccccatcagctcttgagactagaattgtagagaaccccagagagaggtgtcagagggagctctgcaaagatggggctttgtctagacacctgctttgtatttgcacaaacactttgctgaaccagacagactctgcctgtctcagcaaatgctcatgtatacttttaaattgcaggtatccatttaatgaagttaatcaatgttggcaggatgctgggtgctggaaaataaagaggagcaagaacactgtccctttcctcaaaggggcattagtctaggagagaagggaaactgaaaaccctaagtgggacactctggcttctcacccacgagtccccctcagaacacacaccagaccaacctagccaggactctgggatagtgacttggcatgtggattcagaacaaggcccacagtgtgaaaggtgctgctgaacaaagataaataaaagggacatcgcag

SEQ ID NO: 176200 - DNA, 514 bp, Homo sapiens
ggactgagaacgctctagggaatcacactgaaggaaaacagccaaccccaaagggccactcactccatgaccccatgcacacaacacccttgaaatacaaaatcacaaaaatagagaacagattagcggtgtgtgtgggactataaaaggccgacatgacggatttgcacggggacggagccgtcctgatgttctgtgtcctggcagtatcagtgccccgatcctggtgctgagagtgcgttgaatttcaccagatgttacccagggggcagctgggagaaggggacacaggatctctctgtattctttcaactgcatgtgaaactatgagcatctcaaaataaaatttaactgtaaatacaaccaccaaccactgctgagatggctttctcctgctggtctcacctggcggatgaggagaagggcacattgtccaggctgcattcagagacaggcctcgcgctcctgctcccagacccacagttctgtagacaacctgccggtgggtccagct

SEQ ID NO: 176201 - DNA, 462 bp, Homo sapiens
ctccccagacccctcctcccctcctgccgcggccgtttcctgtggctgagactctcgctcagccatgagctcaccgcccctaatgggttgcagctgcctcgctgctcaagccctagctccgcactccctgccttggagcagacggccccactctgcctcacccccgcccatctccaccttccccccacccacgcgcactgcgtccgcctggtcccgggaacactgggggtctgtctgctcgcccacacaccttggggccgggtctgcgcgctgacgcactgaatgtcccgtctctggagtggttgccctaacttcccagacggtcaagacaaacgggcaactctggatggagctcagagaaaaataagctattttgttttatggcaaaggcaaggtatgggggtagggaaggtagagaccaaggtaaaggctgcattgagtatccccttccccatttacagc

SEQ ID NO: 176202 - DNA, 526 bp, Homo sapiens
ttcatgagaagatggcagagttgagcagttgtgacagaggccacatgtctcacgaagtctaaaatatttaacatctggtcctttacagaaaaagtttgctgatccctgtcatgtaatgtgacagtatttaatcacttaagaatgttatcatgacatgtcttttggaatagtgaggccttttcagaggcaacgtcctaccgtgcttgtgaacacagagtcaggctattattagctgacaatgtgatcttgggcaaatgttatttcttttgtcccagtttgttcagaaaagtacttgtgtgtgcaggcctgagactgtcatccttggaaaggcttgaacagctaaccctcggctcgcatctggaacatagatttggagacggttcccaccgtttccagaactgatgagtggctcaccgtgcctaaaatctttgtacaaacaacgtggtttatgccgaacacctgctctctgggagcctggaaaactgggcacatgccacgcagggggcacctatgtgaccacacccca

SEQ ID NO: 176203 - DNA, 709 bp, Homo sapiens
gctgtctagaggatctgaaggagatagcaggacaccggagatacatgcccacagagaaaaggccatgtggggatacagcaagaaggtggtcatctgtaagccaaggagagaggcctcaggagaaacaaatctgcagacacccagatcttggacttacagtctccagaactgtgagaaaataaatatctgttgtttaaactacccagtctatggtattttgttatggtagcgctagtaaactaatactggagaaataagaaacagaaaggtcagcataggtaacttccttttgaggaattgaccaacaagttgccaacgtcattttccattatatcccattgaccagaaatttcttacgcagccatatctaagactcagctcttgctgagtggccatgtacccaggtaaaacttgtggagaagtagtcttttgctaaaagaaggggactgtggatattggagggtaattaatgttttatattgatacaattctatgattatattgtccttatgactaccaaaacaagaatgaaagtcattcctggttcctgaaataatcttgtgggccaagctttggtcatgtgtccattcttgaaccagccactatcactaaggaaaaagatgctttgtttaggactaggtcatgtttctccaccctatgtaggaggtagactaggagaggtcatctacctccaaatatgtctgatttc

SEQ ID NO: 176204 - DNA, 323 bp, Homo sapiens
tgagatggagtctcactatattgcccaggctggtcttgaactcctgggctcaggcaagcttcctgcctcagtctttcaagcagctgggactatggtcatgtgccactgtacccagatgtttttttctttgttgcttaaggcctcaaaagattataaaaatattctcttacatttattctaataaattattattcggcttctcaacatttgtaggttcgatccatttgaaacttttttgatttatgtattttgggattcttttgtagggtgcatatatgtttataattgttatatctttatgctggatttacactttttttggg

SEQ ID NO: 176205 - DNA, 575 bp, Homo sapiens
taaagagagaattgagagagaacagcaacaagttgtgctgagtatggatgtgggtaagggagagggaagaggtcacagacctctggtgttcgcagctttcaccatggggcagagcagggagagctggctttggggagaaggcaatgtggatggctttggtatatgcctagtgttccattattggaatgctaagcatgtgggagttgtctcctactgctcaaggtcattgccaaggtctgatggcaaaaattcaaaaaattgcaacctcaagcataaatggattaaattgagacaagtttagaagagcaggctgaactattatacttaggagctactaaaaatataaaaagcaagatgtctcaaaaaatatcccaggccagacctctggtttgagggaaatcaacacatagggatgtatttggaaccaggggagtaaataagattacttagggaaaacagcgaataggtaagaaagcaaaagacaagagttttgggaaaataataaccatgggatagaaaaagatgtggtggaatgatcctgattctcgttggatttgtgtggtagacagaatgtt

SEQ ID NO: 176206 - DNA, 589 bp, Homo sapiens
cccagaggcaaccacagggaagtggttgagcctacaggaactggaacaactaaaatatgcgttacatattaggaacgtggcccatgttcttgcagcttatagaaaccaggattctccatcaccgacagacctggttctgcatccttatgtccatcgatattaggtatatctgaaaatctggaaggttcaaagtccagagaggcaattaggtccaaaacgaatggggccatacgtggtgattctgacaacacatgctgccttaaagcttcagggagtcaccccacagcttcatcacacgagtgaaatgagtggatgcaccagtgcagtaaattccctcgtaccaggcttaacccatctcagatttaaaattgctcttctgaaaaaccaacctgactcccaaaaatataagtacaggatactttgacccatctaaacggtcgctgctataacacttaaatgtctccacccgccaggagtgttcttgtgggctatctgatggcattagggcttgtcctgtagtcctcaaagctgtctctggctcagagatctgtttccttttattccagatcatcttgatcatgtatccctg

SEQ ID NO: 176207 - DNA, 618 bp, Homo sapiens
tacttgaccttcctattacatttactctgtcacttccatcataagtcttaccacatgatgtgattgtgtgtgtatatgtttctttctttttctctctctctcccactgaactctaagatatttgaaaggtaaaaatccccttgtctactctaccctatgtgattagcatagcaattatacagcacgtatctgggtgccagcacttaattagtgatacacacgtatgcatacacatattctctctctcccatatatattatataaatcagggctcattatatatctcaggggtaacggagtacctaagaaggaacaacttgggtaagtgggagacctccccaagtctaggattcagatcactggagaaggtatggctgcagcccggtagatagtggagaagtctgctgaattgtccagaccagaattgatccacatttgtctagcctagtggaaacttccctcagggtacaggctggtgagggctggttggtgcacacacaaatggagtcagagcattggagcttgctcaccagcagagcagcaggagaccaactgtacataggagaccatctataaaccagggacagccacagcaagaacctggtgccccggactgca

SEQ ID NO: 176208 - DNA, 412 bp, Homo sapiens
aagctcaaggtgatgcctcagcccccccgcaacccccccccttaatgtcccctgtccccagggccaggaggagagtgcggctgcagcggcccccctccagagctaatcggcctggccggagcaaatggcattaattgtggagatggattagctgtcacagctgggcctcccaccgagaatccaagggccgagccactcagtgtggggggaataggcagccgcctgggaagcgggtggttggacagggtgggggtaagcgcgcaccgcagccaccggggttgggggtgggcggcagcttttcttggtcattcacctgctgtgtgactttgggcaagtgtcttcacttctctgagcctcgttttactaatctatcatcacagttttttgtttttttttgagacaaggtctcaca

SEQ ID NO: 176209 - DNA, 424 bp, Homo sapiens
gtgttaatttgcgtttcttcttatggcagcaccctccttcacagagcctgcttctgtattagtcaggacaggccaggctgtattgtggtagcagtcggaacccccaaacccagctgctgccaagagagcaggcaccgggggcccgagtgatggggacttggtggagctggagcagcaaacttgctaaaatcactcctggtgacctggcaggctgaatacaagaaggctcagccaggagcataaggggcgaagtgggaaaacaccacattgcgagttttgtgttaggtcccgcaacacgagacggagaccagcttgagaaagaaggcccagcttacaagcagagatgaaagtgaacagagagatggatccagaaattcagagcaccgcaagggcagaaaaaccaactgctccaagagttaggatt

SEQ ID NO: 176210 - DNA, 172 bp, Homo sapiens
gaaaatagttttttttgcattggcatgctgcatccctcacaaggctttagagggaaaaatggacagatgaggtaatggtatatccagtggagtatgtttcttggctgtgcctcaaattgtcactcaaggctaaaattctgcagatctctgcaatggagtttggatgcccacg

SEQ ID NO: 176211 - DNA, 413 bp, Homo sapiens
gagtatctactaggaatctaacatggaaaggtaattacatatgatgttggaagcaaatttgtatacaccctatttatggccaagcaaaacagtgtaatgtgtctgagcatgtatgtgttcctttcaccagttttcttgtggtagaatttataaaactgcatatattcacaatgtacaatgtgatggtttgacgtatatatacattgtgaaataattaccacaatcaagtcaatgaacacattcatcacctcagcgttttctaaaattacatttatcaaactgtatttgaaagtaaatgtgttttctcattgttaaccacgactttaaaactttattacagattaatgttaagaaagctactgaaattaattttagtaataaaacatctgaatatacaccatgaaatgtataaa

SEQ ID NO: 176212 - DNA, 233 bp, Homo sapiens
ggggctgagaaaagtggcagtcagctacatcaaaacgactctgcagctcaccccgactggtcttctttcccctccagctcctacctattttgacgcatgggaagtattcccaacagggtttgagtcaggggcccttgccaacattgataattaactgaagaaagtacagaagaagtaagaatgaatcttgtgtttattaaattggtatcggtagaacacaacattatgagggg

SEQ ID NO: 176213 - DNA, 357 bp, Homo sapiens
tcatggatgcatccccagtgcctgtgtgctcagtggcacatgaaaggcactgaataagcatttgctgaatgaattaatgaacacttgattacctgggcccatccaacttttcccttcatccttccaacataaactttttctgtctgtgtaacatttggtggaaaacttcctgaatcccttagtactaaatggaacacccagtccattcagtgttgacaataaaacaagttaacacccattgtggaggagtgattgggccagagtcttgttccttagtaagttcatatctcaccacaatgcagagctcaagagagggctgcttttctctctactccaaaggtgaacacagacccttcc

SEQ ID NO: 176214 - DNA, 819 bp, Homo sapiens
taaagtgccagatggtactacaacgatatttcatcttacaataagattcagcaatacctagatgatacattgatgaaaatataagttatttaacagtttgtttacataaattataggataagtacagaaaattaagctatgccactagatgatgacttcctgaatagatagttcagctttttattgaaagagggattgattggctaaattgaagttacagtgacatatattcctattagtgttctgtcattgccttctgtaaaggaatatgacttcaggtaagctcaaacctgagtctactgaaggtatggcacacctggaaaattgattttcaattttctaatgtacctacaaacctctcagaagtatgctggctattggtgagtggaaaagggctagaaggtatctacaacttcacacataaccaaaaacagagaagtggtgaagtggtgaaaggagtttctcaaagcctgtcttcagtcaagtgatttcattggcagcaatgggccagtatgagaacttgaaagctgcagatgcttatcaagctctccagaagtaccgctggctagccattttattccgtgtaacaatttctagatttgtagataggggttttattaatcacctatgttaaataaaagtgtggcgtgtcttttgctggtgttttttggtgtctctccatggtgactatcactcttatgcaattgtacatcaccattggagtcaaaatataaagttttaataggtgagaataataaataatagtgctgagaagaaaaatacagtgaatttggccaacttcggttggaccggctcatt

SEQ ID NO: 176215 - DNA, 468 bp, Homo sapiens
ctcagttgcattgctaaaaaaatgaagaaactgaccctgccgtcctgagggttggggatgcgaggcagggggccttgtgtgactcagttcattccccagatcctgtctggctcaggggcgggcaagcatcgtgggtgaggggtcttttggttggcctgaccagctttggttgatagctcctgtttcttgaatgcctacagatgagaaagcggaggtaaagtaacttggccaaggctacacagcagaagaggcagaagtgggattcgaacctgagactctatgatattacgtccatgccgcaagacagagctggcacctacgggaataacaaggaggtggtggcagggtagtgagctccccgtctctgggggtgtgtgcaatccggcgctgcgctgtcagcagggcaagggctggggccggggccaagaccaccaagccaggcccaggcccgcccgcctcccgcggccg

SEQ ID NO: 176216 - DNA, 995 bp, Homo sapiens
acacttcctggacactgggctatcagggtagacactgtccccccagctaagagggacaggtgctgaggagggatgaggggctttgagaggtcaccaatgagacttctgacccattcctgccctctggtggggctggcatttggatttgtgctgttttatgctgctggaagtgccccacactccctggggcccccaccacagcaaaagcaaaccctccctggagagacacaccttcctcatcccggccttccggctcccagagtgtagacagacgaagagcctggttggaattacaagacgttgaggaagaaagctgttctgagagggtcagcaggggtcagccccagggacctcacgtgctgggatggttaaatgcacagtattcatcaggggagttaaaaccatggagtatcatgcagatgtttttaaggcatatggaatatctggaaatgaaaactataatcactgaaataaaaaacccagtgagcagatgatgtagcttattagacacaacataagaaagtattggtgaattggaagttctaacaaaagagattgcctagactctggagcacagaaagaaagtgagacaggaagcctgcaggaagcggggagctgtggaggagagaatgcagcttaacaggcacctcggcagaggagagagcagggcagggagacggtggctccagaggccggcagcagagggcttttcaaggttcataaaaacacaagcctcaaattcaaaaagtataatgaattataagcaggagaaagagcagtaattacacatttaaatatgactctgacgtgaagttttcagaacagcaaagggaggatgttaaaagcagccagaggcacacccacctgtggtcccagctactcctgaggctgaagtgggagggtcgcttgagcctgggaggtggaggctgcggtgagctgagattgcgccactgtgctccatccttggctacagagcaagaccttgtctcaaaaaa

SEQ ID NO: 176217 - DNA, 929 bp, Homo sapiens
ctcggctcccggaagcggcacgggaggcgaccgtgctcgccgttggcaggctagggttggcggcggcgtattctgtttgttttaaacgaaggagcggagggaggggccgcgcggagcgtgcctaaggtgaaagggctgccgtgcagccaggcagaggcgaggaaggcttctccatcgtcgccaccgcccgcctgtttcgccggcaacaggttcccccgggacgggaggggccgcagcgccgcgcagctcgcagcgctgaacgtcgccgaaatcccttggccggccgagcctccgcagccgcgacccggcttctctccgtccgagtcccccgagcctctccgaacccccgttggacttcccctccctggccggcgccgcccgacccgctcccccatcctagagggaattccctgcgccgcggctgtgaggcacctccaccccggcctgaaatgcaccgcagtcctgaaggaaatccaccctcatcccacgcagattcacccgcaacgctgcctgaatacgcctcgctgcccacagaaattcctgcccaaaccagacgcgtggaccacccaagacgaaattcacactcgaccctagccccgccagcccttgccgaaatcaccctaaacccgttgaaattaattcccagctgtccgaattttccttccaacattaactgactacctgtctccgccaagctgactgaactctaccgaactcttaccctgaaagcccctgagagtccaaaatatatttttccagcccgaaatctaaatcccagttctctgtatgaaaacctccagaaacccagactcttacttccttcggccacggactcgttcgaacatcgtggacatcaccttcccacatttttaccgcagtctttggctccgattctttgtccctgcctcttgggcagcatcctatccctg

SEQ ID NO: 176218 - DNA, 679 bp, Homo sapiens
ctcggctcccggaagcggcacgggaggcgaccgtgctcgccgttggcaggctagggttggcggcggcgtattctgtttgttttaaacgaaggagcggagggaggggccgcgcggagcgtgcctaaggtgaaagggctgccgtgcagccaggcagaggcgaggaaggcttctccatcgtcgccaccgcccgcctgtttcgccggcaacaggttcccccgggacgggaggggccgcagcgccgcgcagctcgcagcgctgaacgtcgccgaaatcccttggccggccgagcctccgcagccgcgacccggcttctctccgtccgagtcccccgagcctctccgaacccccgccagcccttgccgaaatcaccctaaacccgttgaaattaattcccagctgtccgaattttccttccaacattaactgactacctgtctccgccaagctgactgaactctaccgaactcttaccctgaaagcccctgagagtccaaaatatatttttccagcccgaaatctaaatcccagttctctgtatgaaaacctccagaaacccagactcttacttccttcggccacggactcgttcgaacatcgtggacatcaccttcccacatttttaccgcagtctttggctccgattctttgtccctgcctcttgggcagcatcctatccctg

SEQ ID NO: 176219 - DNA, 840 bp, Homo sapiens
tgccagggctgggacggaaagagtataaggtgagcttggaatattttgtgtaccaaaaagcaaggaagcgctcaaagaataatagagattagtggagaggacatcagagccatcttgaagaagctcccactgaccaaatgtgagataattcgagcatcaaaataaatagagatataatagattataaccgactgaataacaggaaaccatgaatctaaacaggtattaataaataaatggaagccaggagtagtggctcacacctgtaatcccagtactttgggaggccaagatgggcagatcgcttgaggccaggagttcgagaccagcctgaccaatatagtgaaactccatctctactaaaaaaaaaaaaaaaatacaaaaaattagcctggcgtggtgacacatgcctgtaatcccagctacttgggaggctgaggcacgagaattgcttgaacctgggaagcggaggttgcagtgagccgagattttgtccctgcactccagcctgggtgacagagcgagactctgtcttgaatgaatgaatgaatgaatggaaaatgaaagccctttctcatggtagaaggccaactaatatttaatggttggaatgacagagtcatacaatcatcatatggtaaccagcatggtaataatttgttcaggcaagaatcatcaatctgtgctaaaacaagtaggtaaaagtttgttgaataacaggatatttacgtagtttcaaaacgtatcccccaaaaatacatattaattacaatgaaaaaaatagtatctttccagtggagaaacatggaagatacttcctccttaaccaagtgaccgaag

SEQ ID NO: 176220 - DNA, 437 bp, Homo sapiens
ggcctcaagtgattcactcatgttggcctcccaaagtgctgggattaaggcatgagccacccccttggcctcttcaatttttaaatagtgtggttcaaagagaagtttttaagtttatgaagttcctgtgatcagtttttttaatggaccatgtttttggtattgtataatatctaagaaatttttgcctagcccaaggtcacaaagaattttttcaagttttatagttttatatcttatagaagttttatatttttaatttgcgtatagactatgagatatgggttgagatttatttatgtttgtatgtggttatccaattgttttagcaccatttgtttaaaagactgttatttctccttcgtattatcatacctttggaccttttataattatcttcattttaataattttcatctctgtgtagatctacattt

SEQ ID NO: 176221 - DNA, 360 bp, Homo sapiens
ctaaagtgttacccactggaggtttaagaatgaggataggcccagatagaagcagatgaggtgagatagcccagttccagacttcccgatgaggaggcgcacctgtggcacctgttacgatgggggccctgagcccccaccccagccctgcagaaggaagtgctgctctgcagaggaaggggcggatggaggcggagtctggggttttaatgagtgtctcaggtgtgtcttaggctagacaaatttgggaaatgttgaattcatcacggacttgctctgagctacccacagcaaccagcaaactgccacagaaagaccaagtactgctttgtatctcgttagcctacttaaaatggacac

SEQ ID NO: 176222 - DNA, 359 bp, Homo sapiens
cctgcacaaatgttaactctggttcagacaccttttctgcacccagttattctcactcataatttctttctccttgggtttttgttttattttggaacggctttttaaccttcagaagtacattttgtctggaggaccagagtatcgatgtgatcctacctgtagattcttggcaagagagaaaatgttcttattaatgcagaaagtcctacccagaaggaagaaaacgtctcacctagaaaaaagtcattatgtagttttttctgggctcatggtttcctgaagagacctggtcctagtcaatttctccttggtattttattatttttgtccatttgaggtgaaatccggaggaagta

SEQ ID NO: 176223 - DNA, 284 bp, Homo sapiens
ctccaaaaaaaaaaatcagtgaagtttagggacttgtttgaaggtcatctagtacaagctatgcagatagctattattttggtttctagcttcaggctgtctcttttgaactttgtattagaaacgcagggccttttaataggtggagttgtctcaccttcaaattcaactacatagctttttcttaaagtagtataatgcagaaagtactcatccgtaaaaacaaaaatggttttctttcttccctgttatctttgtgacccactgatagcagctggtggtcc

SEQ ID NO: 176224 - DNA, 446 bp, Homo sapiens
tgactagcaggagcttatctagctcgccagtgggtcctggtccgtacatgggacagaaggagccgcaaatatgggaactccaatgatgccagataatggagcagtggtaatccgcccaccttggcctcccaaagtgctggaattacaggcatgagccactgtgcccggccaaagaatatttttttgaggacaaactatgcccaagcacagatacatattcgtgggcaagtcagacttaagtgatggggtatttttgttttgaggctgccgatctcaagaagcaggaggtgtccaagggcattgaccaatgcacctgtctggtgaggcactgtacttgttagttaactgctggtggctcttcatctagttggcagagaattcaattcattagttattcacacagctactgtgtattggacttaatagtgagactttgagatgaatga

SEQ ID NO: 176225 - DNA, 253 bp, Homo sapiens
ggtaagaagaaagaagtatccgcgaactttgggcaaaaacttccctaaaataattttaacaaaacgagcagctcagaatcaagtatactaaaaagcatcatcattattattattactatgagatggagtctcgctctgtcaccaggctggagtgcagtggcacaatctcggctcactgcaacctccgcctcctgggttcatgccattctcctgcctcagcctctctaagtagctgggactacagatgtgccac

SEQ ID NO: 176226 - DNA, 253 bp, Homo sapiens
ctatatgccataagtaagaaacctgaaccaaggacctgggtatcagattggctggataaggagggatgagcacagaaggaaggacaaagataatacctttttcaagatgagcctgtaaatgaaaattctaaaataaatgctaaggaggccaccagtaaaaacagagattaagacatatttactccagatgaaattaaagtaatacaacagtctggaaaatacttcaaaacaactttcttccataagaaaaagg

SEQ ID NO: 176227 - DNA, 180 bp, Homo sapiens
ctgaatacacagcagaggtctatagcaatcaagagttttctgttaaaagaattttattatcaagaataaaacttataaaactgaaaaaaattgcctgagtgtgtacatgcatgacttatcttttagagaaatgagatgccaaagtcttatcttttagattaatgttcttcaaactgcttt

SEQ ID NO: 176228 - DNA, 216 bp, Homo sapiens
ttgaaaatggaaataaaaagggttgataaacattgggttagaaataggtatataggtaataaaactataaagaaaaggagagaaattactgctatacattcaggatatttcttgaggtaagggtaggagctgggtgcttctagagtgttgactatggtctgtttcttcacctgggtgggccactcaggtgtagtttatatgttcatgttttgttaa

SEQ ID NO: 176229 - DNA, 416 bp, Homo sapiens
tagaggagggggcctggatccttgggagttggtggtgggaaaaagaagaggagccctggagactgctctccctgcgggagactaggagcctccatcctgaggctgagccctggagggggggggtcactttgctccagggacagggcagcggtggccgtggccgggtggagaggagacgctgcctaggcccgtgactcctagtgtgcctctgggcttgcttccggaaagccacgacgcctggtcctcttaaaccccacgcctcttgttttgtaaacagatgattttgttgaggataaatgaatacagcttaatacttagaactgttcctcgcatatagtaagtgcagttgaagtgttagattttattttattttgagatggagttttgctccagcctgggagtctcactctgtctca

SEQ ID NO: 176230 - DNA, 431 bp, Homo sapiens
tgatttctttgctgctgcataaagggagttggaagataagcacggtcagctgcatggctaagaagaaccccaacagcagagaccccagggtcagctggacacacaacctccagctcatgatgaggccgtaacagagaggacaacagatggccacaaaccagtcaaaggccatgatggccggcaggatgcagtcagcccttcccaggaagatgaagaagaacatctggcctccacagccgggcagggaaatgaggtttctccccatgggtaggacattggccagagtcagaggggcaatggtgaaaaagtagaagatctccagacctgcaaagtttgtcaggaagaagtacatggaggctgggcacggtagctcatgcctgtaatcccagcattttgggaggcagaggcgggtggatcacctgaggtcagga

SEQ ID NO: 176231 - DNA, 672 bp, Homo sapiens
atgaacctgtaatgtgtctgtttgccatctgctatcaccagttttctagtttttcctacgaattgcaattctacattttcataagatcagatcatttaattcacacaaattcctgggaaccgtgagacctcctcagggctttatcttcctgatcctgttcttgctgtttgcctaacaatgttgatgcaacagaatagaaagcatttttgcctgcctgataagcccgattttgccttcataccttaggtggtagcctgtttatagaataaataaagatagcccagagcgcctaggttcagaaaagttctctctgttgatggggaagaaaagaaaacaaataactaagaaaaagtctgcacactttaaaatgagtggatataaggtccctctattgggggtatcaattacttaaatgacttacacccacagtgttttagttctcaaatgctttcaagatttaaagaatccggaatggttacagttagtcttaggtctgggttccattaatcaaacctgtaatcaaatagtcacttgacttcatttgggctttaatggttgaatggtgtttataaccaaatttactagccagaggcctatggggctggagaggggtttagcctcacaaactccagattttagtcaaactaaaaagacccaggaggccagttctat

SEQ ID NO: 176232 - DNA, 447 bp, Homo sapiens
gttagcaactactgtcattaagactatccgtattctattttacttttgatagttttaagtgtatacaataatgatgggtaaaacaggtaactcatgctggtcctgataactttgttttaacattttgttttgttttttgagaaagagtctcgttttgtagactagagtgaggtgcggtggtgcaatcacagctcactgcagcccccaaatccctggctcattatcttcccatctcagcttcccaggtagctaggactacaggcgtgcactaccatgcctggctaattttttgtgtttttggtagagacagtgttttgccttgttgcccaagctggtttcgcactcctgggctcaggcgatctgccggccttggcctcccaaagtgctgggattacaggtgtgagccaccgcactggcctgtttaatgagctctcttcgctgccctct

SEQ ID NO: 176233 - DNA, 419 bp, Homo sapiens
tttgtatcttcaaaacttcgtacataattttaaacaaaagtatgtatggaaaagtctcaagttacaatccaagtaaaatttgtaggacttaatctgtagggtctcataatcacagtttgaaaaggaggccaaaaatcagaatattaagggactccaacccttgaaagtgactgctatagaagtctttcttctacagataccctaatgcttcctataaccccaaacaaagaaattaagaatacagcgaatggggatgtaaacaaagctctaatttcccattttcctactctaaatcatcaatcactgaaagaacatcatgaaatcttcccagctctatagtcacatgaagtgactggacatctcagtaacttcttggcctgaattgccccattctctccaaaaccatctgccccattccc

SEQ ID NO: 176234 - DNA, 419 bp, Homo sapiens
ccttactgagaggaaggaaagatgggtgtaatattggaaggcatgaacctaggcaggtccctagagcatacttatcttctctacttattgtgagcctccttaactgtgagatctataactgtgcttctcatgtgcttggccagtggatggtgttattctttctagttttctatttacctttctggagtccgagatcaaaaaaggatacaaataaagcctgcattttgaaaatacctatttttaacttattaagtggaaactttgagaagagtcattattacagaataattagtaaaaaatcaccttcatttagattctgcttttggttatgtaggtcacgcagcctaaggcagtgggagggtctaggtgtcaccagtatggcagtcagacgcagtgactgtgctgcctgtgatttcctg

SEQ ID NO: 176235 - DNA, 594 bp, Homo sapiens
gaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactaggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaa

SEQ ID NO: 176236 - DNA, 468 bp, Homo sapiens
atattattccactcccgtagccatgaggccaggcttgagtcagtgcaaaggcatctcatgtcagctgagggtagcaggggttgctgagggagggcatagtcaatagcacctgaccagtggtttttattaaccttccctgcatggatttgagttcctgcgtggagagcaggacaagcatctcagagcactcaggagagcttacaaggaaggtgggagtgaagaaagtgccagatgccagcaaggctgaagcttccagcgggagactctcagagggaccctttctggacctctggttggggtcgtgagccctgcagctttgacaggaagaaatctgcctgttctcgggacatctttccccagagcccagccaggagctggtttctagagctgagttagccttgcacaacatttttctctgtaagtggcctccatcaagatgagcagtagcttttcctcaacaaatttgat

SEQ ID NO: 176237 - DNA, 338 bp, Homo sapiens
gaaatcacacagggctgcatcaaattgcacctttcttctttgttaactgcaagattctggatgagctaacttggtattgaataacttgctaactttttttaagcctcagttttctcatctgcaaaatagaactagtaataatacatatgtcataatgatattatgaagattcagaatatgcttggcccatgggaggtgccctacaaatttcaggttctaatattttatatgcaattcctcaatgttatggcctgtatataagaaagaaatggaatgcataaatattgttgggagtattcatttgaattttgagctttacttaaaacacatttagcatt

SEQ ID NO: 176238 - DNA, 400 bp, Homo sapiens
aaggacttggggggcttgatatggcttggaatggggaatgggttggcttagcctcagacggagaggaagtgccactccctgagatgggctgcagtgctcacgggcctgggagaactggctagagcagcagatgagccaggaaagacggagagcagtgggggcctggctgcccaggccacacaccaggtcagtcttttcagaactcacgggcccggctgcctctcagcctctcaagggctgtctactgcaccccccactccaaactcttggcatgtgactctgcttgtcttcacttggcacactcactgaacagacccaatgcaagactcagtggacctgcatctctggcccctcctgggctcccctaaccccaggttcttgatctcagcaccctcccctg

SEQ ID NO: 176239 - DNA, 561 bp, Homo sapiens
ttagcttcatccacctgcaaacagtaaatgcgttgtgtagcattttagagtcctttaaccccatctctttcatccatacctaccatgacagtcctcggtccacccatatacagttctagttctgaggttgtcatgtattgctagcttaaaactactacattaatgagtacagagtttcagttgggaaggatgaaaaaattctaaagatggatggtggtggtggctgtactacaatataaatgtatttaatgccacagaaccacacacttaaaaatattcaaaatagtaaatgtcatgcacattttaccacactttcaaaaactgcaaacattctctgccataaatttatgctccccaacctcagcagcctctccttgcttcttcccagcttgtatgctcatgcttagtcaactctatgatagatactccactgcttgtactattcctctctgttctcttttttcactctctgctctggggaacagacccgggagggggtttacagctactccactatgcagaagattccagtaccaagttcccttttcagttcatgctctc

SEQ ID NO: 176240 - DNA, 401 bp, Homo sapiens
cttatttcttttatctagctataattttatgtcctttaagaaatctctccctattcctcattcattatatgcttcccagcctctggtatcctctgttctactttttacttttatgaaatcaccattttttaccttccacatatgactgagagcatacatggtttaaccttcagttcctagtttattttacttaacataatatcctccagttccatccacgttgctgagaattccaggattttattccttttcattgccaaatagtattccattgtttatatataccacattttctttatgcagccatctgttcttagacacttaggtcaattccataccctggctattgtgaatagtactgcaacaaacatggggtaacagatgtctctttgacatactgt

SEQ ID NO: 176241 - DNA, 470 bp, Homo sapiens
ctggagggcccaaaactgcgccccctgctgccttgtgtatttggtggctggcatagtcagttcattatgtggcaggcaaaagtttgcattccaagggcggaagacatacacattggttttgtttgagaattatatcataaaactgagttctaagtacttcttgaacattgagattattattgatgaactgattataaagtattcttaaatataaacccaaagcaaattttattaaaaataaatagaaatttgattaagaataagagataatttctaataactttttggtaggtgacagcagggagatttgtttgatcatggagtttttaaatgcttttaagtcttgaagtccattaaggcatagaagagagaataggagaaaaaaacatctctgaatggcacagaccgatcacatgttgattgaagcacagtcaatgtgtatactgaaattgtgagtcaagagctatatc

SEQ ID NO: 176242 - DNA, 123 bp, Homo sapiens
acaggtcccttcacccagcatttccagagctgacctcattgtaccttcatatcctcccagtgtttctcttttggtgaggaaaaacacacattgtccagccagtccctcaaggcagaaacctgg

SEQ ID NO: 176243 - DNA, 544 bp, Homo sapiens
tgctaaggaggaaagttcttcagtgagtcttataaagcggcaccaaaacgcggtatttatagtgacataatcagccctaatggagatggaattaccccataaaggccccaaggagccctcagggcctcagcgccactgcagcagacaaggctcctgtacagaaacaacgtgaggctcagagagaagaaatgactaaaattacacagctggtacatggcagaggtggaactaaaaagttaagtgtgtctaccccagagccgagtagacctgctcttttttgaacacttcctggactttcatgcctttgtcccagctgtgccctctccctggatgccccttccatctgggcagctcctactagacctgccttggcatacataacacaggagaacggattgccaaagggtaggagagtgcctggtctatagtgtgcgcccaacacagatttggtgaatgaatgaacactgggtccagcagacctggattcttccatgtaacccactgtgtggccttggtggagccatgcgggtgcaataatcctggt

SEQ ID NO: 176244 - DNA, 270 bp, Homo sapiens
ccaaaagaggacaagaaagaaagaatacaggaataaaaacagatgggacaaagagaaagcaaaaagcaagatgacaagttggtagcctgctacatcagtaattacaatgattatgaatggactaaattctccaatttaaaaaaatattgtcagattgtattttggaaaaaaaacaactagagtttgttaaaagagacatattttaaatataaggacacagaagggttgacataaatgggtgggagctgggcatagtgatgcacacctgtg

SEQ ID NO: 176245 - DNA, 323 bp, Homo sapiens
tcagacaggaggggcgggaaaagagggctctggaacagtgcttcgtcccatacctgaagcactactgccatcgcgaggatgttgtttaacaaatccctacgccattacggtgttctcctgaggactacttgttggggaagttctctgtggggaggtggaaaaggcttgctccatgctgggagtcctagccttctcgtctaaggccttaaaggacaccaggactttggcggtgtcttggtatagaacctggagtgtgaaggttctaataccaaatcctgtaaacttccctggaataaacctgttgtttgtgcgcggtactggtg

SEQ ID NO: 176246 - DNA, 451 bp, Homo sapiens
ttctataaaacaaaagattcagaaggatctaatggattaggttttagtatattattgcaaatcataatgaattcttagatacatattttttaaccataataggaagaatagctatttatacaactcatatttacaagatgatttcatatttttagttcattttctgctgtgtagaaatgtaatggttataatatggtgccctttcatgctcatcaagcactcttttatctcactaatgaagggcaaaagtgatggacatatgttgttactagaataaaaggccaccttacactcaagaaaattaatgtattactgtgataactttgttctctattaaaaatgaatcattcttgaatcagaatttctttactttggaagttagtatttcacccttatatcaatttaactttgtagaaatatgactagaaattaaatggcataaaaactgaga

SEQ ID NO: 176247 - DNA, 530 bp, Homo sapiens
attgattgattatatgtgatacctggctaatgagtaattttgttagatgcatgaagtttaaattgcccagaactattttaatatccctgcgcttatattcatccaaaatgtttactgatgacagcatgcttaggtaagctgccacatacccactttcatctaggtgaaatttgttagtattgctttataaaaataatacaagctcaaggccactgaacacagaggaacccatttgcttttatctagctgtatctcctgtattttactgtacatcaacaatacagtccccgattccagaatgacttcatttccttattataatcccagataggcagttaaatggaaagaagaggtaatgagcaatttctatacacaaatgggccttgatttcttttaactttctaactaaactaatttcttttgcagcacgttacatttacacttccatccaggtttagaattatatgtttccttttgacttgctgttcttgcatacaaaagaagagtccagggaaagagtttcagaaaaa

SEQ ID NO: 176248 - DNA, 312 bp, Homo sapiens
aggagatagcaggaagagaagttggttgtcaggatggtgaggaggaaggatctcaagagcaggacgaattgcatcacagagacaccaaggaggaagaacccttcgagagctccagtgaagaagagtttggtggtgaggaccatcagagcctaaattccattgttgatgttgaagatttgggcaaaattatggatcacgtgaagaaagaaaagagagacaaggaacagcaggaagagaagtctggttggttcaggaacatggggaggaatgaagatggtgaaagaagagctatgataactcctgcttattcct

SEQ ID NO: 176249 - DNA, 181 bp, Homo sapiens
ctccatggaaacctggaggtgggcagccacactgatgcccccaaaactaggagggagctggctgagaagctgagggtggtggagtggaaagtctgtctttgatgaggtgggtggatggatgaattaagctttggtagctgtctgccttcagtaccttttcttacgctaaacgtggtaacag

SEQ ID NO: 176250 - DNA, 466 bp, Homo sapiens
gaccatgatgtcatactttggcaaatggtgttccctttgttgaaacaagcacctccccttgccctctgctcatttttcaacatcagtttgagtcaccacctcttggaaaccatctctgagtcccttcactttccatcctggaagactcagttgagttcccacttaatttctcaaagacctttaccacactgattttcctattgatttgctggtttgtatattccactatactgttgtgtagcaaggaatctgccttgcccagagaggtctggctggtgccctgttcctaggaggtaacctctaaacccacagaattccccaagtgatagaggagagtctttattattcatggcaggatcctgggagagctctcctggcctgtgatgtaaatcagacctacaggagggcagtgctggagattaagtttaactatccgggcaatgatttaaccaatcatgcctcagca

SEQ ID NO: 176251 - DNA, 349 bp, Homo sapiens
acacacacacacacacacacacacacagagcaaaaaggggctgagctatttcctcattctgttcttcatcacaagcttcttttcttccccattctaaagttcttcatctcgaacttatccaatatatcactccttcccaagggagacgaaaccagggtgttgttctactaacagaaatccctcaatagaaaaagaaaccacaagactggggaagaataggtactatccatatgggtgttataattatgtaccccataacaattttctgaatgcttacttgtagataaattttgtcttaggcatgaaggagaacagcaaaagaagaggaaatagctaatatttgttgaac

SEQ ID NO: 176252 - DNA, 256 bp, Homo sapiens
cttggagaaagtaaaggtggaaatgtttaacctagacactggctgcaagtgctttcttcctcagctgaaccttatccccttgcttgagctgacctgggggtcctccttcttgaggagccactccccaccctgctccagtccaaacctctcctatacccgcaaaagatactcaacacattagagttgcccagttatcaactaaaatatttcccaagtcctcatttatgctttccagtggtcacctagactctccttg

SEQ ID NO: 176253 - DNA, 489 bp, Homo sapiens
aaaatgtaaacattttacaaaagtagacacacaaatggccaataagaataggaacagatgaaggctgggcgcggtggctcacaccgttaatcccagcactttgggaggcaaaggtgggcagatcacctgaggttgggagttcgagaccagcctgaccaacatggagaaaccccgtctctactaaaaatataaaattagccaggcgtggcgcacatgcctgtaatcccagctactccggagggtgagcagaagaatagcttgaatctgggaggcggaggttgcagtgagccgagattgcaccattgcactccagcctgggcaacaagagtgaaactctgtctcaaaaaaaataaaataaaaaagaatatgaacagatgcaaaaaaaaaaagatcaaaaaaagaaagaatacgaacagatgctcaacattattattcatatatgatgaattaaaaaccacaaattaggccaggtgtggtggctcaagcatg

SEQ ID NO: 176254 - DNA, 287 bp, Homo sapiens
ccgactagtatccatgaggacacggatttggtccctggccctgctcagtgggttaaggatctgatgttgctgtgagctgcagtgtggatcgcagacgtggctcggatcccacattgctgtggctgtggtgtaggccatcagctacagagagagggtccaggcgcctgtccctctctaggcagcactacttcagagccatctgagacgaatggtggttttaaagatgattgagaaggagcttcttggagcttcttagaggactgttgtgtgtttaattaccttttccc

SEQ ID NO: 176255 - DNA, 733 bp, Homo sapiens
ctctacaggtcaccctgccccatctccatctcctatgagatgagtgactcccaagaccccaccacttcccctgtagttaccacccaggtagagctggggggctgcagccggcaaggtgggggcaatgggttcctccgttttcgccagcaccaggaggtccaggccttcctcagccttctggaggacagttttgtccaggaattcctctccaaagacccctgcttccagatttcagataagtatctcctggccatggtgctggtctacttccagcgcgcccacctgaagctcagcgagtatacccacagcagcctgttcttggccctgtaccttgcaaacgacatggaggaggacctggagggccccaaatgtgagatttttccatgggccctgggaaaagattggtgtttacgagtggggaaattcctgcaccagagggataagctttgggcacggatgggtttccgggctgttgtgagccgccagtgctgtgaggaggtcatggcaaaggagccattccactgggcttggactcgggaccggcgcccccaccatggtggggttcagagggtctgtccacaggtccctgttcgccttccccggggccctggcctctcgccgcccactgttccccctgtggtttgccccagcactgcagcagccacttgcttaagcctgtgtcatccaagtgcccttctctgacctctgaatgtcatcgccctccctcccaaaa

SEQ ID NO: 176256 - DNA, 494 bp, Homo sapiens
acaagcaagcctggatagcaaattatctctgaagtcctgcccaaacttgttttctgtactgccatgcactgctcacatctgctgcaaccccttctatgcccatcttctcccgtccgacaagcctagttccaaccctacctctactccagctctgcctgcctctcccagccccccagctaactcctgcacccatagtcaacactggtttatgtctttccatttatctttttatatagatacaaatagatctcttttaaagataaatgccatcatagggtacatagtgttgtattcttcatttttctcatatgtcttgtctttccacatcacttcaggttaagatcatttttttccatacatgatctgtactattctgcagtacatatttccttaattcatttatctcctttatttttctctagggtcatttgtcaacattttatcattctgaccctcctagcaacccttttgacagaggtattattattctagca

SEQ ID NO: 176257 - DNA, 349 bp, Homo sapiens
ccaccttggcctcctaaagtgctgggattacaggcgtgagccaccgcgcccggctggtttttaagacatgaaatttcagaatgtttgttttcaagaaagaaagcccaattgcctcaatgctttatttgaggacagagcctgaggcacaggagaatagcacggtgggacattactggcaccattgccaacacagctcacacgcagcaacagcacgttttgttggttttgccagcgttgatgctcagatccctctgtggccaccaatagccagcacctgtgtcaaaggtggctgcctcaattaagacacaaaccaaaaattctaattatatagtagtttctgtagtatcag

SEQ ID NO: 176258 - DNA, 653 bp, Homo sapiens
taaagaaagaaagaagaaaagaaaagaaaaaagaaaagaaaagggagggctctgcgggtggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggtagatgagcacgcgcagctggagctggtgagcctgcggccgtgcttcggagactacagtgacgagagtgactcggccatcgtctacgacaactgtgtctccgtctcctcgccct

SEQ ID NO: 176259 - DNA, 244 bp, Homo sapiens
gtttcctttctctgtcttgctcctacttctgccaaatgagacatctccttgccccttgacgttctggtatgattgggaggcttcctgagtcctgtcagatgcagaagccactatgcttccttacagcctgcagaatcattaacctattaaacctcttttctttatgatcatggagaaaattattactgcaaagtggatctattaaatgtcttcaaggccttctctctaatgtcttggcaatcag

SEQ ID NO: 176260 - DNA, 226 bp, Homo sapiens
aggaggtttgcctggccaggagataagcaaataagtaggactggggatgtagaagggctgagagcagccatgccccagggaaatgagtaatcatggtttgtctgtgaggttattgtctagaattgccagagtctacaagaccagctgtccccgagggttggagataaagtgctaggtggtgtggaagttgtaagaatcaaaatggagttactaatgttttttcttt

SEQ ID NO: 176261 - DNA, 593 bp, Homo sapiens
atctgccacatgttgccaaggaggtcctcatagagttaaggttaaagactttcatggctctccattacctaaaagatgacatttaagtttcatggcctgaaggaacagaattgcaaaaaaagatctgcttttatctcttttttccttcactttgagctttgaggaaccgtcctcagataataggtctaaatcctattgccaataggcatttgtctctgccagctctgtaaccaaaattaactatacattaagaaaaacagcctgtaatcccagcactttgggaagccaaggtgggcagatcacttgaggtcagaagttcaagaccagcctggccaacatggtgaaaccccatctgtactaaaaatacaaaaattagctaggcatggtggtgggtgcctgtaatcccagctactttggaggctgaggcagaagaatcacttgaacctggcaggcagaggtttaaatgagccgagattgcacccctgcactacagcctggacaacagagtgagactcagtctcaaaaaacaaataaacaacaacaaaaacagataatccacagcaccatcatagaccatgtttcttctaaagtag

SEQ ID NO: 176262 - DNA, 578 bp, Homo sapiens
caatagtgatcaatatgagaaagtaagtatttcaggtaaagacaggaaggaaaaaattccctctttcctctcttcctctagagataaaatgtccatctgcatcacctcctcgaaacctcccaaacttccatgcgtacagagcagccttcctggtggcaaagtggtgcagtggttaacaacctgggcttgggcgtcagacagcggagctcttggttaagttccagagctccatgcttactacctgatgtgatcttggatagcttctttaatctatgaccctttgtctctaaactggggataatacctatcctctctggataattggtaaggtgtaaatgggataatgaatgcattaaaacctggcacgtcacatagctgccactgtcatagagattgaagaatgaacagaacatggcttctctccatggggaagacacaggtttttaggcaatccaagcaggtctagtcctgacctgagttggacccactccctgggcacagcatccccaccagctagaaaccaggaaaacagcagaggtggtacaaagttctttggaaaggagtcagagttccaagtc

SEQ ID NO: 176263 - DNA, 334 bp, Homo sapiens
catatggctcaaatatattattacacactgaaaccactaggtaactaatacctatatcagtaatcagaatatcactgtcacaacataaatcccttcgtccttccccagttcactacctcctctaccagagaaactacctttgttacctctaacagcatagactaatgttgcctgtgtatcaaataaaatagagcctacttttttctgtctggcttattttgttcaacatgtttatgagactatatccctttcttttgaagtagtaaaaaactttttacttggaaataattacagattcacaggaagctgtcttttgaaattttaaatcactaaa

SEQ ID NO: 176264 - DNA, 467 bp, Homo sapiens
caggttggtaaaatggactccaaagtacctgctattgaggagaagttctcctaggtgacaagcatttgctgaagccatgggatacttagaagctgtcgtcaccctcctcctgaccccggtcctaatgaagtccctggaattaatatctttccatttcctggccagcttgccaatgttcctgtcctcccacctgccatgaagactggatgtggcaggaggtccctacctgacctcatcaatttgtactttctgccagcactgcccaccccccggaccctgaggagacagcctactctagcctgaataggggcaacagtacctccaatttgactcacatcatgactcacctgggcattagtgagggcctgagcctggacttgggcccaggtcatgatgccccaggactttgttcacctctcagccacccatccctgcagtcctccctaagcaatcccgatctccagact

SEQ ID NO: 176265 - DNA, 327 bp, Homo sapiens
cacaatgttggtcaggctggtcttgaactcctgacctcaaatgatctgcctgctgagattacaggcgtgagccaccatgcctggtagagaaggatagcttttggtcacaggattgttgtaagaattaaatttgttaatacaaataaaagaaatcagaatagtatctggcacacaatcaacactatataaactataaaatgaaaacaaaacatagcgtattactgaagctaacacacacaacattttcacagaggtagaagctaaaacattaaaggagattttgttcacctataactgttctcactaagaatgttaagttttagaaga

SEQ ID NO: 176266 - DNA, 999 bp, Homo sapiens
aaatctacggctaggtacgaggctgggtttgggctttcccagggttctcggggccggggcagtcgtagggggcggctggggctccacaggacgttcgtgacccaccttgcgccccccagggagtggcaggaccctcccgtccccagcctccgcgccaggcctcgtccctgcatgggacaagaggcagccctccgccatttcccgcggcccttgcctcccgggagcggctcccctctgacgactgagtggactgcgcttgagggggccgccgctgggaaccagcccctccagaaagagccgtctctgcacccgctcccacccgtgggaagcaccagatggggctgtctcccgagacaaagcctaaaaccaaatgtaccggaatttttggaaactgaaacacaacttgtcctagataggaatgtcaggaagccagcgagagaatgaagagtctgccgtccggggacacaatttctgtccactgtccctgcccacgtcccctcacagccctgcaaggtgggtggggacggctgatgatgccattttcagatgaggaaactgaggcacagagaggctccacagccaggactgggcgctcatccagttgactccagggcagatcctctcttcccagggcagccacccccgccttgtgagagccggtgcccgggggaggggaaggatggagacctgggcagttcacccaggcccaggagccagagccctggcaggttgtacgcagctgctcccaagaggcaccccttccagccctgcaccaggcctgcctccacagaggcgcaaaggaagcaaaggcactgctggcgaagaaccttgggattccagccgcgcacagacacccagagaggaaacccgagcaccggaactggacggggtggcgggcaggggcagggcgagggcattgagtcagcgagaccctgggggcctcaaggaagacggcaaatcgtgaagagccctgtgctgcaagagggggcctgggctacc

SEQ ID NO: 176267 - DNA, 1390 bp, Homo sapiens
gatgggacgggttgagagattggtcgtccaggcgttgagtgtgccctcgctcctccccaccttccgccgtggccttgagccccttgcgcccgcgcccatggggttaaatctctccctgtctctctctgctccaagttgttttccaagtgaggcagagaatggttctcttgttaccaacatggcttctgggcattgggtaatgcgctccctcttctcccgcagcgccacaaagggaccttttgttcccctccctgcccctctcgctggctcttcccggccccccacccacccaaactccctcctccccccgccggcgcccgcaccccggggctgcgcgctgaccgtggcggccgcggcgccctccctctcccagcgcctgcactggcggccgccatcttgcgagcggccctcagggcggcctgggctttcccagggttctcggggccggggcagtcgtagggggcggctggggctccacaggacgttcgtgacccaccttgcgccccccagggagtggcaggaccctcccgtccccagcctccgcgccaggcctcgtccctgcatgggacaagaggcagccctccgccatttcccgcggcccttgcctcccgggagcggctcccctctgacgactgagtggactgcgcttgagggggccgccgctgggaaccagcccctccagaaagagccgtctctgcacccgctcccacccgtgggaagcaccagatggggctgtctcccgagacaaagcctaaaaccaaatgtaccggaatttttggaaactgaaacacaacttgtcctagataggaatgtcaggaagccagcgagagaatgaagagtctgccgtccggggacacaatttctgtccactgtccctgcccacgtcccctcacagccctgcaaggtgggtggggacggctgatgatgccattttcagatgaggaaactgaggcacagagaggctccacagccaggactgggcgctcatccagttgactccagggcagatcctctcttcccagggcagccacccccgccttgtgagagccggtgcccgggggaggggaaggatggagacctgggcagttcacccaggcccaggagccagagccctggcaggttgtacgcagctgctcccaagaggcaccccttccagccctgcaccaggcctgcctccacagaggcgcaaaggaagcaaaggcactgctggcgaagaaccttgggattccagccgcgcacagacacccagagaggaaacccgagcaccggaactggacggggtggcgggcaggggcagggcgagggcattgagtcagcgagaccctgggggcctcaaggaagacggcaaatcgtgaagagccctgtgctgcaagagggggcctgggctacc

SEQ ID NO: 176268 - DNA, 600 bp, Homo sapiens
aggctgaggtgggggaattacttgagctcagcagtttgagttcagcctgggccagatggtgagaccctgtatcttaagaaaagaaaaaataagaccaggtgcagtatctcatgcctgtaatcccagcactttgggaggccaagttgagatgactgctcgagtgtaggacttcaagaccagactgggcaataaagtgagacccatttctaccaaaaaaaaaatcaagaaattagctggacatggtggcacatgcctgtggcctcagttacatggcatggcaggctgaggcaggaagatcacttgagcccaggaggtggaggctgcagtgacccatattcatgccactgcactccagcctgggcaacagagtgagaccctctctcaaaaacagataaagtggacagaaaataggtcagtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgtttctcttctgagtgctg

SEQ ID NO: 176269 - DNA, 193 bp, Homo sapiens
ggaagatgaccaataaaaactgaagaagaacctagaagtcacagagtcaagtgaggcttttataaattcttcaggtctagtttctgctaatatggttcgttttatttctttacaagaatgtccagtcttttggcttccctgggccacactggaagaagaattatcttgggccacacataaaatacactaacac

SEQ ID NO: 176270 - DNA, 2062 bp, Homo sapiens
accgcctcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtggcaggtgctctggctgaggctggtgtggggctggaggagatcgcaaagcaggtgaacgtggtcaccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatgggccggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctgggttctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccc

SEQ ID NO: 176271 - DNA, 1161 bp, Homo sapiens
accgcctcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtggcaggtgctctggctgaggctggtgtggggctggaggagatcgcaaagcaggtgaacgtggtcaccaaggccatggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatggagtcacaaacccgaagcggatcgtctagagtaccttaatcaa

SEQ ID NO: 176272 - DNA, 1253 bp, Homo sapiens
accgcctcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtggcaggtgctctggctgaggctggtgtggggctggaggagatcgcaaagcaggtgaacgtggtcaccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatggagtcacaaacccgaagcggatcgtctagagtaccttaatcaa

SEQ ID NO: 176273 - DNA, 1219 bp, Homo sapiens
accgcctcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcaccgtgcttatacacaaggtgggcttccaccggggacgtggagactggccagccctttccagccttcccttgcctggcagcacccagtaactggacctttccagcccttccccaagaagctagttctttttctccagtgttccctgatctcagaaggccccgccatcccctcagctacctaagcccagatacaggcattttcccagactcgtccccttttcttctccacacccaatcagttgcccggtcctggtgcttctcctcccaaatgtacaacacacatccttctcagaccccgccctcctgctttgccttggttcaggggtcatctactcatgcctgatggctgcagccacctcctcactgggctcccctgcctgcttcctgccttctggccttgctcatccattctccacactactgccagaggtgtctttttaaaatgtgtatctgactaggttattcatccactgaaagccttcttgggtgcctacaatcaatacaagccctcaccatagctcc

SEQ ID NO: 176274 - DNA, 835 bp, Homo sapiens
acaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtc

SEQ ID NO: 176275 - DNA, 101 bp, Homo sapiens
tctcttcacggaattaataacatatagtgttctagagttttcgtgacttctgctatccatgttggtgaggagaaactttatccttggagaagggttggtaa

SEQ ID NO: 176276 - DNA, 312 bp, Homo sapiens
ctggtctggaactcctgacctcaagtgatccacctgcctcaccctcccaaagtgtgagtctgtgtttcatgtgcttcaaatgtaaggattcttggtaaactcattattatttgttcacaacattatatttttgtcaattctgagtacaattctttttatgacttactgcaaaaggaattttaaaaataaaatatccattagaagaaccaaaggatcatcatatagcctaaactaatgttttttgggtttctgcattaaaaatatatctaattacaaaagtatgacatgcccttgtggaaaacttgacaaaag

SEQ ID NO: 176277 - DNA, 527 bp, Homo sapiens
agaagtcttatgttgccttactttgttttgtttattttgaaattaattaattcacaggaagttgctgaaatgagtacaggagaacccatgtacctttcacccatatccccagtggtaacctctcacataactatatacaatatcaaaaccagagcattgacattggtataatccacagggcttgttcagatttcaccagttttacagtttgtgtggatatgcatatagctctatgcaattgcatcacacttatctgttctccaagtctatacattttattacttcaagaatgttaaataaatagaatcatatagtgtgtaaacttttgagatgggctttcttccactcagcatcattcccatgagatccacacaagtggttgtgagtgtcactagttcattgctctggagaaacaagtaggtcatggttccaggtgctctgtctcacttcatccactttttttcttccccccccgagatggagtctcgctctgtcacccaggctggcatgcggtggcacgatctcgg

SEQ ID NO: 176278 - DNA, 231 bp, Homo sapiens
gtgctaagtgaaggaagacatctggccaccaggtgacgcgggttgctctcataggagtctagacttaaagcacatggacaaagatggaaagatgactctaaccaaggacgacttcaaaaggagcacagcttggtcttgactgagcaatggaatggcaaagcccagagctgagatttatggaaagttctgggtacaatgcaaaggacaagaacaggactggggagcggggaa

SEQ ID NO: 176279 - DNA, 217 bp, Homo sapiens
attattttgccttataagttaagatcttgaagagggcccatcattgcgttgacaacccccctaaatttaatacttttagactttttcccaaatgacatcataatagatttctagatctgtatcagtgacattatgttgatattcttccttcaactcattatcattatgtatcaaagaagtctagttttgttttcaaaactaaaatttttcatcagat

SEQ ID NO: 176280 - DNA, 320 bp, Homo sapiens
ctagaggaaacttgatgggaaacactgatctattcaacactttttaaaagtacactttagtactatttctacctagtcaataaaataaagaaggaaggagaaaggaggacgaataagagagaatccgaaagacacactacccagacagactactcagacagacgagacagtcaggcagacatggtgctacccgtcaagcatgcaggaaagcagctttcatggaataacattcctaaactcttgcctaataaattatgctgagagctgctgctaagaattttttaaaccaactcaaagcaaaaaaggagctattcacccaa

SEQ ID NO: 176281 - DNA, 273 bp, Homo sapiens
ctggatgagagggaaagacagaagccatgatgagatggccgtggaagccacatccccaggcctcttcctccctcttccctctctccttatctctgcatctcagtctctgtctttttctctccaaggctcccaatctcccatttatccattcacagtacagtcaggaagctgaaggatttaggccgaaatgcaaggtggaatagaggtttgccccctacttaggactcagagctgcttgtggggaccatggcttcacactctcctcctgggcct

SEQ ID NO: 176282 - DNA, 322 bp, Homo sapiens
cgatgcaagccccccgagttcaaagaaaggaaatggaagtacagggcagacaggtgacgtggcaaccgtccctaggaaaggcactgctggacccagctgtccctgtccctcaccagcctcacatgcccaagtcccatgtacccctggggctgccatgctggctgctgagccatgggcgctggtttggagatgaacttcttcgaggaaagcagcttcttatcccccagaagttctgcagatcatctgtgcactttggtttttacttaaaatgtgatttaaacagcctgctctacttaatactgcctgtgccacagacagaaaa

SEQ ID NO: 176283 - DNA, 809 bp, Homo sapiens
cctgggcaacagagtgagagactgtctccaaaataaataaataaaataataagacagtgtgtattatgtacgtgtatacctctctatgtatctaaatctgtatattgtattaccaatttttaaaatatatgtttcatttaaaatacacttactatgtgcagaacattgtgctaagcactttaaatataataccatgtctcagggaatcctgacagccatcttataagataggaattgttattaccactttagaaatgtgaacatgcaggcgtgagaaattccaggtcacagagcaaaaagttgtacctgttattggaacccatgtctctaatttgaaagccatcggctaacctctggatatactgccaatattgaaaagcttgtcctttctctttgagaaccatgggaaatactgtattctcaggtgagaagtattaacatttgaaactggggacatttgcatttatcttccaaggtgatctgtgtgtttgtaacccctttatgaagtccctgggagcaaccacaggagtaacagcttttagatttgtgccttggtagacaaaattatcacaaacgtgtccatcttgtgactgccctctcattttgcttctcttttgtttataaacttgtttttcatttaatgagtatcttccaaagaattaatacctactttgatataatgcagaaagttatttggcaaacatttagatgatactgggatttattgctttaaaaaaaaagggtactcttttcatctgttagctaccaatcaaatacctttgcaaaaagttgaattttaataatgctac

SEQ ID NO: 176284 - DNA, 875 bp, Homo sapiens
gatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcttgagcctcggaggttgaggctgtagtgagccatgattgccccactacactccagcctggatgacagagtgagaccctgccttaaactaatacctactagtacataatatttcataaagatacaggaaacttagaattataatggacattttcacaagtgacaatactgtctagaattgggctgggccaacacgtaaagctctggtcagtggaagtcattactactactatgtctttcattatatttacataactactttttttgacaacaaaaacaaaagtcctggacaacaacactggaacccagtaacacgtcgtactactatcacgtaagttgccccggaatagagccagcatttccacgggtatgacaagggcaaaggctaggcatatccaagggccaggtatatcagcgataaccggcccttgcccatggaaacttaacgcccggaacccggccaaattgggcgggggccccacgaaccacttgaggggagaccgcgcgcgacagacaatgcctcaaaaagcggggggcccagagcaggacgggcgctcgaa

SEQ ID NO: 176285 - DNA, 126 bp, Homo sapiens
tcttaacgtagaatatagtaaataccagaacagtgagacttaaaaataattcccagaataaataaagagctatgagtcaatcagagaaagacaaatagcttaatataaggaaaagagataaaatac

SEQ ID NO: 176286 - DNA, 270 bp, Homo sapiens
  misc_feature (239)..(239): n is a, c, g, or t
atgttggccgggatggtctcaactcctgacctcaagtgatctgcccgcctcagcctccctgtaaccagctgggattgcaggttcccggttggtatttccttatttggaaagaccatctttgtaggtgttattagctaaagtcaagtcattctgggttagggtgggccctaaatgccattgactgctatcctgctaagagacagaagagggagggacacactagggaggggaccacgtgnaagacggaggcagagacgggaagaggcagag

SEQ ID NO: 176287 - DNA, 608 bp, Homo sapiens
tacacaagataggcctgcagcattttgtgttgccacaaagtttaaggaactgcttcgaataaaacgaacaaacaaaaaaaccactgaaaaacacattgatggggatatgtcaaagggccacaggagccaaattaaagagtggtagacggccaaagctggaacaatttgaccgacaaaatacagtagtattgggttataacacaaagcataaaataaacatccaggccaggtacagtggctcatgccggtaatcccggtaatcactgccttgggaggccaaggcaggcggatcatctgaggtcgggagttcgagaccagcctgaccaacatggagaaatcccatctctactaaaaataccaaattagccgggcatggtggcacacgcctgtaatcccagctacttgggaggctgaggcaggagaatcgcttgaacccaggaggtggaggttgtggtgagccgagatcatgccattgtactccagcctgggcaacaagggcaaaactccatctccagagtaaaataaataaataaataaatatccagcattccatcctgatataattcaatgacctagtaagtgggggagagcgagggtcagtatagata

SEQ ID NO: 176288 - DNA, 796 bp, Homo sapiens
tctgaaagcttcatttttaaaaacaaagtgtaggtcatagtaatacataaaaataaaacagttgacatgcatgagagcatgaggattattaaaaaccacacttaattgaaatctctaagtgcgtataaacaaacggaatcaaaggacctttgtggacaaaagtccacaaagaagcagtagtgtggtacacagcaaggattttaaagatgaagcactcctgtcagacattatttaactcgttggttacatctgcagctggacttaaaaatcaccagacttcatgcgtcctggtgtaggccgggtccttttcagtctcatttgctaagaggatggaaaaatagctggtttagttgtcctgggaattagatatgtacctgagtatgggagagcttcagcctaccactgaagagcatcatcagcctctcacaggatgtcccacggaggcttcagggtagtagaatctcaggcaggacgggactggtcccttataaagacttcacgttgacatgaaacatcttgtaagcagcgcatctgctgagcctttgtaaagggcaggttgacacctgcaaagaattcggtgggaacagtaattggctcagttctccagcacagaggctttcgggcctccgtgatgccaactgggtgtgacttcatgagcaaacctgctctaccagcgccagataaacagttgagtcttcgtttaaggctttgattcctgataaagatgaaaaccccttcatgagaataggcttttaagcccatgttgggcattcaccattcgcagttgagagtgaaa

SEQ ID NO: 176289 - DNA, 708 bp, Homo sapiens
gggcaaagcacacgcattgtatttgcatctgggaaccacatttttaatttaaaaaagttatttgtaggccggacacggtggctcacgcctgtgattccagcactttgggaagccgaggtgggcggaccacttcaggccaggagtttgagaccagcctggccaacatggcaaaaccctgtctctactaaaaatacaaaaattagccaggcgtggtgatgcatccctgtactcccagctactcgggaggctgaggcatgagaatatcttgaactgctcctttttattgctgagtgatattccattctatgaagctcagtttgcttatccgttctcctgttgatgaacatctgatgtttgcagttctcctctccgtgagtcttcttgtaaacataattttcatttctcttgggaaaaaccctaggagtggtactgctgggtcaagggggtaggtgtttgtatagctttataagaagttaccacatccttactaatatttggtgatagctattctttaagttaaaagtgtagaggcatctcgttgtggttttaatttttatctcccaaatgagtaatgataagtgtctcttcatataccgaatggctatttgtgtatcttttttgtgaactgtctcttcaactgtttcatccatttctgattgattatctttttattattgagttgaaagagttcttcataaacccaggatt

SEQ ID NO: 176290 - DNA, 466 bp, Homo sapiens
tccacaaatgcgtaacctatttatccacttgcttatttatttctacctgccttcttatagaatgggcttagcatacaatcaccctcatttgaggtagactattatgatttccgctattctctttttggacacttcagatgtttccagttgccttcctcattttgcagtgaaacctgcaatgagcaacttcatgtaataaaactccctttctgaatttaatcatttcatgattaattatcaggtgagttaatgagtcaaagattgtaaatccagtctcttatgtataaacatatataatttagtgtatacattttcatagatttttttatacataatatatgcatatatgtgaggttgtttttaaacttacctttcattttacattaaatttctccctaccctcaaatatgagcctatgacttctgtgaatctgtctcattcaaatgtcacttgattccagttatat

SEQ ID NO: 176291 - DNA, 455 bp, Homo sapiens
ataaattccaaaacaaacaactagaagaatttaattgcctctctgaaggaagattggataaaatagagaggagtggggcaaaaactgctatattttgtcatttatactatgtgattttttaaactatgtgcatgctttgctttgatcgattaaaaatttactattagaatatttaatgctcggtggcttacgcctgtaatcctagcactctgggaggccaaggtgggcggatcacctgaggttgggagtttgaggctagcctgaccaacatggagaaaccgtgtctctactaaaaactcaaaatcagccgggcgtagtggcgcatgcctgtaatcccagctactcaggaggctgaggcaggagaatcacttgaacccgggaggcggaggttgcagtgagctgagattacgccattgcactccagcctgggcaacaagagtgaaactctgtctcaa

SEQ ID NO: 176292 - DNA, 762 bp, Homo sapiens
ctagattttttaaaaagtaaagtaattgcgctacaatgttatgacagctatgatgtcactaaatgatgagagtttgtcagctccattaatcttacgggatcactgttgtatatgtagtccacagttgaccagaacattgttatgtagcacataactaatgtaaatattgcaaatcacatctgactactgagcttttgcttcaaagtagacacttaaagataagaatttgccatcctttcagttggtctcagtgcctaggtctaggtatgttacattttgttgtgttgagtgtgattctgttattcagacatgtaatgttcatacaacatggcctctaatacccagcctgtagtgcccaaccaaagaaacagcagtttgatccggtgctggaagagaaactgctgtttgggcttgctgagcaattgtattggtctccaatgtggcctgcagatatggcaacaagaaactgtcatgtattctctttgatatacacacgtgtgcaccccacatgtaagccttcacccttcttaattctatgtatattttatatattgtgtatatagttctattgttttagattgctatatgtgcattatatctttgtacaacacacaattttgtacagtgtggtatacaaaaaccacatacattatactttatggatgacttgagatttttcaagaaaaatgtcgattctgtacaatcatagactctgtttgtttgcacatactcatttctagaacatggcaccccagaaatacc

SEQ ID NO: 176293 - DNA, 520 bp, Homo sapiens
attttagaaggagaaataaaagtccatcaaatattatgaaaagtcctggacatggatagacctgagattagctgaatgtctgtatgagttgtttcatctaccaaataaacagattgattcaaaactatttcttgagcacctactctgtgcaagatatcacatggcatgcggggtgacaaaaaacgaaacgggaggtttctgctttcaaggagctcttagcctgatatagcataaaattcaagaacagaaatacatcacagaaaacatgaaatgccataataaatataccaacaaagtgccactttcagctgcagagacctgggaagaccacttcaaatgtgggaggaaacatttgaatcagaacatattaaaagagaaattgtcatctacgtgtgttgcttaaaatataattgagaggaaaagaaactatgttctattggttctggtaatacagtagatttgtctcacctaattagcaatagcaaaaataccaacagaaaatgaagaaatatttggaaaa

SEQ ID NO: 176294 - DNA, 439 bp, Homo sapiens
aatcccagcactttgggaggccaaggcgggcagattgcttgagtccaagtgtttgagaccagcctgggtgatgtggcgaaactctgtctctacaaaaaatacaaaaaattagccagatgtggtggcacacacctgtagtcccagctacttaggaggctgaggcaggaggatcacttgagcctggaagatggaggttgcagtgagccaagatcgagccactgcactcctgcctgggtaacagagcaagaccctgtctcaaaacaaacaccaaataaactttaagggcaaaggataatctcagagtacttgggcaagttgctagaaaacagtattctcaggggaagcatcaaaggggaaaatggccaagttgatatggtagttgacttcattgtagttccaccagaaagacaaaaaataaacaaacaaaacccttatatct

SEQ ID NO: 176295 - DNA, 301 bp, Homo sapiens
ctagaggattcccggtattgagtggcatgtgatgaaacaatatacctacacaccaaaagataagtcaaggacgaaagataaaaaaatactcttaatcaagatgttctacatcatactgaagcagatatagtccctgtgcaataaaagggcggggcatgaagtactctatgaggaatctgaagaagttcattccagttcagacttcacaaaaatataacctagagaaacttaatttctttatccaaacccccaacttctgataatgggtacctatgatggtggttgttgataatgatagctc

SEQ ID NO: 176296 - DNA, 697 bp, Homo sapiens
ttctaagtcttccgctgatctgttctccattactataattttgtcatttcaagaattttttatcaatgaaataatatactatacaaccttttgagactagcttttttaaaaattcaacataagcatgtatttattttgtgatcagctaccataataaagatactcccttttggaagacaactccaaaaaattttatcgattactggctaagtaaatcgtaattcaactgtataatgaaatcgtatgcagccattaaaactgatgagataaacataaattaaggacatgtatattttttcaaatacacagtcagctctccatatccatgggttccacgtcagagaacccatggatatggaggccaactgtaagaaacttgagcatccactgattttgctatctgtgggggctcctggaaccaatccccaatggatgccgagagagaaaactatatagttaagtgagaaaatacaaaactatatattatcccatttttgttaaaacacacatataaatacatagatacacagagatagacaacaagatgttaacagggattatctctgggtgataggattacaagggatttttattttcttgttgcttgtctgcattgtctaaatttacaacagtgaatagctgagcagatcgggatctctaagtcgacgaggctgaagcgagcggggttaaaaaaagg

SEQ ID NO: 176297 - DNA, 255 bp, Homo sapiens
tcacagctaggctgaggctcagctcttctgaagatgatttgggttctttaacctgcaatctctgagaaccattgacttggctactgtgcagttagtaaaagatgctgtgccagccccaactcggaaaaacgactcattcacgccccaaataattccagatgtgtaatatgagtcatactcaccactgccatgtctttgatgaatgtggaaaaggccagtattcccaaaacattcaactgcttccaggtcgttggt

SEQ ID NO: 176298 - DNA, 418 bp, Homo sapiens
tcgctcagaggatcccgtgatgtatcgccaacacttataataccatgccacttccttctggcctccatgatttctgaggagaaattcactgctttcaaactggtgtccccctataggtaatgcactattttcctctggctgctttcaggactttttgttttcagtttttagatggttaacttattatttgccttggcatggattttttttttcttttgtttgagacggactttcactcttgttgcccaatctggagtgcgatggcgcgatctcggctcaccacaacctctgcctcccgagtagttgggattacaggcatgcagcaccacacccagctaatttttatttttagtagagatggggtttctctatgttggtcaggctggtctcaaactcttgacctcaggtgatccgcccg

SEQ ID NO: 176299 - DNA, 255 bp, Homo sapiens
ttgatcatctatattctcagctagttgaggtgtaagagtttcccaaaatacctgcactgtcattcagtctaccactagagttttggactgcagccactgtgctagcagcaaagcagcacttgctgcatcaagaactctgccgagaagagcatgtgtagagaggatggatgtcagtatccattatccacacaattgcatgggatcctgctgacatccttatgtccacatgcttagctcatcagaattcattttgcg

SEQ ID NO: 176300 - DNA, 428 bp, Homo sapiens
acagacatcctcagccccagaactaattttaagggaagtacaatgataaaaagttgtaattcaaaaaatactaaaatgatcaaagctttcaggctttaatgatcttttgaaataatcaagggtttggaagattaatgatagagagaatacgacatgtattacaaaagtgaactgcctgatagatagctttccgaatgtacggtgctcatgagtgaagactgcatgctgaccctgtgtgtctggggcagaaacaatcaagcaagatggactcccactgacagcagcaaggcagtgcagccacccctcaaacatgcagacaagttacaaatgagaactttgccaaaaagctggtatcatccctaacaaaagtggaactgttattgatttatacactttttcactcaaagtggatgcgggacagaatgcat

SEQ ID NO: 176301 - DNA, 336 bp, Homo sapiens
tgtgagccaccacgcctggcctgaagatttttacaatgagaagaaagcagtaagagatgattcctgctaatattctttttcaaaagaatatcccttaaatggccaataatatcacaaagacataattgaaatgttttggtcctagatcactaatctaaagtagaagaaatgaatacattatgtatgttcagctgtagaaaggatttaggacaagggttgaaaatggaaaaaactcctatttttcatacatggtgatcaatatcattcaaatagttattgctaatatacacaagaatcttcccatcttctcttcaaattttttacccaggtatttat

SEQ ID NO: 176302 - DNA, 292 bp, Homo sapiens
agggggccccatggtcagcaggacaggcccatggtcaagccattgcactgccttcagtttacagtgggcaaaacaaaccccgcatccctaaggtccaaccggtagtgacccaactggtagtgacatctgtcttcatgctcaggccttgggaagagcaggagcagagaggacagaatgtggagtcaagaattcagaatggggcaaaaggggggtctggggtggaagcaggctggggatgaataaggggagccacagcccccaggatgtcagcccagggtaggcaacctggact

SEQ ID NO: 176303 - DNA, 188 bp, Homo sapiens
agtttttgaaagagtttgcaaaaaactggcattaattttcctttaaatgtctggtagaagtcactggtaaagccacccagtgaggggtatttctttgttgggaggattttaattagcaatttaatcttcttactagttataggtttacccctattttcttttttttttttttgagacgaagtcttgct

SEQ ID NO: 176304 - DNA, 552 bp, Homo sapiens
aacacacctgagatgcacactcatcactaacagtggttttctatacaggaagagagaggacactcccaaactgacccctccacctggaactcttccacagttccggggatgactggctctctcccatcacgtaggtttcagctcaagtgtcaatttccagagtggcctttcctgatctccccatataaagccaccctccttcctgctgttattctccatcggagaaccttgtttattctcctcgaagcactatttacactctgtaaatcttttattgaacttgcgtatctgtttctaccactagaacctgagtcctgtgcaggagaaatcatacactgttttctttccattgaatccccagtgttgaccatagtacattggaaaagattaataaatattcatgacataagtgactgtatgcataataaatgagaaaagaaactttgtcagaaacaacttatttttcatacgatgtctccaaatgatcactgcttccttacaaactagcatttgataaatttcttagaatgtttccagggacctctattcact

SEQ ID NO: 176305 - DNA, 336 bp, Homo sapiens
tcatgcttctaattcttcctcaaaagtcacgtgccatccagcgcgtcctcgagcgcggaatcccatactagctccttctcttaaggtacatttccatcactagtctcctccttcctgagagaattatccctcctacatgcctcctaatggagattctctacagttgctctgcaagcatgccatctcatccctgtcctgctctacagaacgttttgattgagaacctccttgtagagacacatttcatccagctcctcctctacaggcacattccatccagctcctcctctacagacacattccatccagctcctcctctacagacacatttcatcc

SEQ ID NO: 176306 - DNA, 774 bp, Homo sapiens
acttactgggtgaatgctagcatgttcatattttgtaatttcttaggatataaaggccattccagacaaattcctggactttggaatagaccaccggccttgtagtattgcttatcattttaatcagataactcagtgaattaaaataccaaaactctggagtctgtcatcattttccagactattttccttcagaggatccctggaactgtcatctctgaagtatatccagcttcctctcaactccctccttcttctctctcttcctactcctcatacccagcttatttgctttgaccacttggatttttctccaaacaagataaagaaaatgtgtttgttttttggtattatttgccacaaacccagggtccacagaacttggaagaatataagaggttcccctcttctactttagattgtagagaaccctggtcaggtctcagattccaacccacttggaggaagctaagacataaaagctggtcagtaacaacttggaatatcgaagtatgtgagtaggggcagcgtaccactagttgctgagacctgttatagccttgtgtgtttaggaagccagtggtccaacctgtacctattatccttgtaatcaagaagtcattcctatgcctgtcccgtatccattcctgttgctctatgaatctgaaagatctgcagtcacactggggaaaataaccccctccatataaatgcatttggccacattctgccgagccacctttcagattcatagagcaacaggaatggatacgg

SEQ ID NO: 176307 - DNA, 706 bp, Homo sapiens
acttactgggtgaatgctagcatgttcatattttgtaatttcttaggatataaaggccattccagacaaattcctggactttggaatagaccaccggccttgtagtattgcttatcattttaatcagataactcagtgaattaaaataccaaaactctggagtctgtcatcattttccagactattttccttcagaggatccctggaactgtcatctctgaagtatatccagcttcctctcaactccctccttcttctctctcttcctactcctcatacccagcttatttgctttgaccacttggatttttctccaaacaagataaagaaaatgtgtttgttttttggtattatttgccacaaacccagggtccacagaacttggaagaatataagaggttcccctcttctactttagattgtagagaaccctggtcaggtctcagattccaacccacttggaggaagctaagacataaaagctggtcagtaacaacttggaatatcgaagtatgtgagtaggggcagcgtaccactagttgctgagacctgttatagccttgtgtgtttaggaagccagtggtccaacctgtacctattatccttgtaatcaagaagtcattcctatgcctgtcccgtatccattcctgttgctctatgaatctgaaaggtggctcggcagaatgtggccaaatgcatttatatg

SEQ ID NO: 176308 - DNA, 308 bp, Homo sapiens
ctctatccttaatctttagaacaattttatgatgcacacagaacccaaggctcagtgtgataaaaataacatgaccaaagtcaaatagctagaaagagaaggggtttggacttaaatagatctgcctgattgcaaagtccatgctttttccactacagctaaagttcatgtcttcaattcccacaatgtggtaaggaagacagacatataaatagatcaatgaggcagagaaaaataaactgcttacccattctaataacgttagtaactttttttttttagacagattaaggatagaggggtaccga

SEQ ID NO: 176309 - DNA, 336 bp, Homo sapiens
cggctggctgatttttgtatttttagcagagacagggtttcgccatgttggccaggctggtctccaactcctgactttaggtgatacgcccgcctcggcctcccaaattattcttaagggaaaaatctcatcatgtaagctttaagttttgcacaagacaaaagaccaccagtctctttgagaccagttagaaagaaccccaagaacattgagagagaagctgtttatacagctgttctgagcactgttgtgatatgaccaaccacctgccctgctccgcaccctagttactgtgagtcaggaaacaaggtgcactgcacaagactgggcgagctt

SEQ ID NO: 176310 - DNA, 571 bp, Homo sapiens
actccatcccaaaaaaaagttagtgaattgcctacaaccttgtcctctttgcaggggacaagcccagaaagccagatggtaattgttgtgaaatctgtaggtttattaggtttattttgtacctttgccttcccagaaaaattgtagttaaaagcattgttataatgtggataacaacaactaatgtttatatagtgctttatagcatacagactgtccagaggagaaaaatgaagtacagaaagtctattacttgttagagggaggtaacacagcccttaagtaagtagagcaggacttaggactgaggccttcttattccagattctatattctttttattattacatactgtctcagatttgtctgtcaacgtgtgatttaaagaattacaaaatttggctgggcatggtggctcacaactgtaatgccagcactttgggaggccaaggcaggtggatcacttgaggtcaggagtttgagaccagcctgggcaatatgacaaaacccagtctctactaaaaatacaaaaattggctgggcatggtggttcacgcctgtaatcccagca

SEQ ID NO: 176311 - DNA, 274 bp, Homo sapiens
cgggcaggatcttaaaggttacatgaaaccaaatgccctaatttttcagaagtgaaaattgagactaagagacagtgactttgtcaacttcccccacggggctgggaacaagctataaagtaactcctggctcatgtcccatacccttcccaccggcctgggcattgtctggtccactgtgaccccaacactttaaggcactcatttctacctctttaccaccaaatcattacaaataaggcacagtttagttttctacagtttctccttcccc

SEQ ID NO: 176312 - DNA, 1103 bp, Homo sapiens
ttcttcattcgcaggtgtgtcgggtttcccgctttaaatcaacgctagttgcctatttcgtctggcaaggcgtatcagtgcgatgctctagacctggtcgcatatgcccttctatacccaatgacatggaggcccacgtgctggcatacccgcacgacgctctgttgaggaccctaggggtactagcgagttgggtagggtctctgagcagagagcctgatagggcacggtaggctccagagctgaggcgtcgagtaatccactagtatgagcgctccgttccagtgcactgcggggtttccactttctgcattagtccatgtgagccgtcatcagactttgcaaatgcttcctctctgatgtccactttctttagtaagaggaggcaggcggcccacagctgcgttcagaatgcattccggatgcggctctcctgagccctccgacctcgtccccttgtcccctcgtcccccgtgtggggaggcactgccaggggtgggggctcctgtctgggaacagcggccttttccaaaccttgattttactcttgaatttgacacgtcgcctctgttcctagacggactgtagtctttagaaaatgtcaagctatggtcactacttgcttccattttatttaaatcgtttcttcctaacattggcttttttttttgcagttgaattatctatttctcatataaacatgttaggattttgtgcctgaaaaagtggccactcaggagccctgctgcaggagccgggcgcgggactcgactaccacacttgctgggtgtctggcccatgcccggtgcctcctgtgcctgcaggggcagagcgcccttgagtgctgggagggcccaggcagcggagaacgtggctccctgtcccactccgtctcaccgctcttgtctgagaaagcgccctgtgctgtactgcttggacatgactggttgggagtgtccaagctaggcttccacgaggtcacctgtcttgctaagccatgtccctgcctctgacacagagactgcaggaggagccctcctgaccttcctcttcctgtttccagggccctcatccccacgcggcccatgacaaaagtgctatgg

SEQ ID NO: 176313 - DNA, 818 bp, Homo sapiens
cgtcagccctgcgggttcacttctgcattagtccatgtgagccgtcatcagactttgcaaatgcttcctctctgatgtccactttctttagtaagaggaggcaggcggcccacagctgcgttcagaatgcattccggatgcggctctcctgagccctccgacctcgtccccttgtcccctcgtcccccgtgtggggaggcactgccaggggtgggggctcctgtctgggaacagcggccttttccaaaccttgattttactcttgaatttgacacgtcgcctctgttcctagacggactgtagtctttagaaaatgtcaagctatggtcactacttgcttccattttatttaaatcgtttcttcctaacattggcttttttttttgcagttgaattatctatttctcatataaacatgttaggattttgtgcctgaaaaagtggccactcaggagccctgctgcaggagccgggcgcgggactcgactaccacacttgctgggtgtctggcccatgcccggtgcctcctgtgcctgcaggggcagagcgcccttgagtgctgggagggcccaggcagcggagaacgtggctccctgtcccactccgtctcaccgctcttgtctgagaaagcgccctgtgctgtactgcttggacatgactggttgggagtgtccaagctaggcttccacgaggtcacctgtcttgctaagccatgtccctgcctctgacacagagactgcaggaggagccctcctgaccttcctcttcctgtttccagggccctcatccccacgcggcccatgacaaaagtgctatgg

SEQ ID NO: 176314 - DNA, 532 bp, Homo sapiens
ttaatgcctctcctccactcgactgcacatggcatggacaggagcacgcacgctgcactcatctgagtccccagtacgtagcgctgtgcttggaacacaggccgtgctcagtgactatctcaggaatggatgtggagtcagcccccatgaacggggactccgaacagagcccaatcagttttcagttctgctttcgtagagtcagcagtgggaacagggtttttgtttgggacctaacattcctgggtaagagaggggagaagcctcacacacagacctggccggcctctgtggaaatgatgtctggacatgcctgagtatctgacaggagctgtggtaacaagaaagaacatgggctcaggagtggcagcactttaaataagataacctttatattttataaaagtttttcatttacagaaacattgggcagatagtaccgagagtcccacagactccacacctagtttcaccttttatcaacatcttatgctattaacatctgttacaattaataaaccgatatggatac

SEQ ID NO: 176315 - DNA, 387 bp, Homo sapiens
ccaataacacatcttttaaacaataaacactaaaatgtatacatgtccaatcattttgttagcttttttccatgaaggaatactaagatttttaaaaattaatttagcatttcttcattatctttttaaaattaaattagttaagattaaaccattaattcctccatccactggcccaggctgggggaatactgctgtgcttggtgagcacaggagcaggtgtccatttccatggcatctgtagtgctcaatgtcagcccacgcaagtccttgagctctcaatatctgtttttcagtgtctgacctgtcaaatgcgggacatggattgactcccacagacccttccagctctaacccccatggcctataatcagggctgtccagtga

SEQ ID NO: 176316 - DNA, 130 bp, Homo sapiens
attagcaattattaattaatcaatgcacaaataaaatcagaaaactttgggaaacatttatttatatatgtgcatgtatgtacagattatacctgatctacttcataaagtaatttttattagcttacag

SEQ ID NO: 176317 - DNA, 453 bp, Homo sapiens
tcaacttgagtatcctttccacattccaagcattgcaagtcttcccttatgtctactgtgaaatacacagtgcattgttgccgactctggtcacccagtgctgctatagaacatgagaacttatctcttctaactgtatgtttgtacccccttgtggggcacccggttctgttgctgtttggggtgcaactaagtaatcctcatggacctagggggaccgaacaaagggggcgaacatgggaataaaagacaagagacaaaagagtatgtttggaagaaggggtcagggggcaccttgcctctagtggacaagggccctgaactttacacagccctccgtatttgttatgcaaaagacatagtgagaaggggggtggaagaaggggtcagctgctcagtccggagtaggcttgcaagactgcattcctcaaacaacaggctctagatgtcgca

SEQ ID NO: 176318 - DNA, 263 bp, Homo sapiens
ggacccgatcaacgtcaactattacaatcgtccatggggatgatggtgaagggcactcaggaccctgagagtggcaggagaggtaagattaatcaccagcagaacccattcagctccagctatctctaacggtgtggaggagaacttgacatgattagggcattgtctttgatgtaatttggaaggctgcaatgtagataatgttatcagaatatatgtccaaatacaatattaacaggctatgacacagcttcctggctcca

SEQ ID NO: 176319 - DNA, 388 bp, Homo sapiens
gtataaagctgctacagtttgtcaattgaatactgaaatggtacaaagatatggattctttccacacaaagaaatgagatgtaagttatgcgggaaaagattgcaaggtagtgtgtatacacaaaggacaagtatgtaagatgtgtaggtgtcagtccatggggatgatggtgaagggcactcaggaccctgagagtggcaggagaggtaagattaatcaccagcagaacccattcagctccagctatctctaacggtgtggaggagaacttgacatgattagggcattgtctttgatgtaatttggaaggctgcaatgtagataatgttatcagaatatatgtccaaatacaatattaacaggctatgacacagcttcctggctcca

SEQ ID NO: 176320 - DNA, 562 bp, Homo sapiens
cagaaggaggtgataagcaagctgcttatcattaccactgtgagtcccattacagcaggaggggtacagttagctcagaggaagagcctctcagggagaaataccgaggcatctgatatcctgccagggagacactgtctgacttgagagcaggcaccaggatgtttggtgtggcgtaggcctaacccctacccagagacgggaatgggtttcagacactctagaacagggccctgtccacactcctaggcctgctttacccatgctcccttcccctgctcccttcccaaacattgcttgactgacagcaagggaagctactgaggcttgtaagtgtgcagtttgtgcctcaatgcaagttctaggaaaaccagaaaaagagaagttagtagagtgcagctgcaggcattccttcactccaggttctgatactgagtgggtggctgggattcctctgtggacttgggggttagagggtgctctgtagtcatattctgcagcacctgagcttccagaaggacagctgagcaagcatttcaggatggtaagtctcagcctaaac

SEQ ID NO: 176321 - DNA, 841 bp, Homo sapiens
ggtgacagagtgagactccatttcaaaaaaaaaaaaaaaaagtaaggacattaaaaaaaattatagccatctaatgttgccacttctttaaaaattaacagtattttcttaatgtcagtatctagcaaatgttcaaattttcagttgtcccagatgcctcaaatattttatgtaactgtctgttggaatcagaatccagtggggttcatatgtcactactggttgatacatcatctcttgactgtttgacagctgtagggttctctgctaggtcttgcctggtttttgttgaagaaactgattgttctttcgagtgtgccagtctggaccttaatgatcacatcactgttttaataggttccttcgttttttttcttttcctgaaaattagtagttacgtttagtggttagatctggttggttggtaaaactccgctgcaggtgggagtgggctcttgcaggagacccccagcctctggtggcaaccattgtgaccagatactggatccactcatttcttaggggttactctaaacggtggtactctaaatctgtcattcctttcttacttatagctgggacatgtctataaagcgcagcttctcgtttttttaccctgaggtgcagttcatgatgtttgaatctgtgtgagtttcttagcatcctgcagtgatggtcagagtattttaatgcactcattggtttaaatacttcatacacttctaagggaaatggaaacctggtacctgctaggtctccgtgtgtgagtgcagcaggagaatgtcctcgtgagggtgaggctgctgtcagtgccacccacatccttgaaaagcccctccag

SEQ ID NO: 176322 - DNA, 298 bp, Homo sapiens
tcctgaaaaagtgagtgtatctgaaatcataaagattcaattttgaagactatagcttattataaaatactatgtaacaaacattgtggtatggatgcttggtcctgattgtcaggttgtaagttgttgtaggaacttggcttttgctttgagtaagactgaaaatcattgcagggttttgaacagagatttaacgtgacctgactttcgttttaaaactcaggctgcaggctgggcgaggtgcctcacctgtaatcccagcactttgggaggcggaggcaggtggatcacatgaggc

SEQ ID NO: 176323 - DNA, 230 bp, Homo sapiens
ttgtgctgtggtcaaagcacttgctgtctgcggttctcccttgtgcacaccggttctttggttgctgtaacaaaaactacataggacacagacaggaaacccgcaggctttgttttttcttcctaatttggcagcagaagggggaaaaaccagggcctttcacagacaaggcttgttttagagtttaattttaacttcttgttcgtgttctaaagcttgggttggtaata

SEQ ID NO: 176324 - DNA, 514 bp, Homo sapiens
tggatgaaaaataaagtcaccttaatctaaattcaatttttcttatctctgtccttaagtgtatgtgttctttgtaagtgtattgttcccttatctcagggaacaatgttctgtattacgttaaatgtacaataaatccatcttccaaattctaattgacatgttcacctatacacttaaataccctactgatccacacattcatcaaatgtttgctaagcatctcttatatacaaagaacagatattcactcagctgggctgtggtgccctcttcctagtaggctgagaatgctcatagcattcccatctgggcactagccccaaatggtctgggaggtgttggaatgccccagcctctaaattcatagagagctccttgagggaactgcagaaacctaagagaatccgttatacagactcatacaataaatttctgtgggtccaatggccaagaccaaggctaaactaatgactgagaactatgtaatgaactctccagaccaccactactg

SEQ ID NO: 176325 - DNA, 1037 bp, Homo sapiens
cagtgagccaagatagcaacacagcactctagccagggcgacagagtgggattctgtctcaaaaacaaacaaacaaatgtgctaagtatactaaagaccacattgtatgattccatttgtatgaagtatccagaaattgtgtatttgtagagatagagtggttgcataggactgggagtaggggaggttagagggaaatgggaagtgactctagggtatggagtttctttttggggtgacaaaaattttctaaaattcattgtggtaatagttgcacaactctgaatagactaaaacattgaattgtatactttaaatgagtgagttttatgataatctgagttgtatctcaataagatacaacctcttaagaaaggttgagtctagattcctttgttagtttgtatcactaagttactgccttcttgagtaccccagcaagaagactgactattgtttctgacactgagggtgggccctagacacaattggaggtcaagcgttctacagaaaacactgaattaagttaaaatgctcaatattgagaccgttactgaggcctcttctctttggcttccagaattctggcaatcaagtaggaatttggaggatggttctcttactaacccaagaagagaatctgtgttatttacaatagcttttatggccctccttttaaatatgagaagataatcaaggatcaccagacatgtgaagaaagcttctcatataagaaacctcttaaaagaaatagaaaacaaactgggaacaatcagaacaacaaaaaaaaaggctcagtagaacagtcaatagaaaagttgaagttagagtaaaggagttctttcataaagtagaggaaaagatggaaaataaatgagaaaagaaaattaaaaggtccgtcagaggtcaacttccaaataacagaagtactagtagacatcagagaaaagaaggaattatcagtaaaatattcaagaaaaattcccagaatcaaggaacgtgattttgcagaatgagaggctctatgggtatcctgg

SEQ ID NO: 176326 - DNA, 710 bp, Homo sapiens
tctgcaagaaagagaaaattctaaggaaggcttagtactagacctcagaacctccatctagggcatcccctttggagatgttaaggtctggagttggatcacctagggtgtccccgtttggtgtctaatcttagtgtgttagacatctctgaccttaggtgggcactggtgccactttgtatgttttccctcgagaggcaatggcctactaggagcttttcttttgtccctggatgaagatcttgacttatatcatccttataatttgataaagccatgctttcccatgcttccccttccactagagtgacagccatgagctttagtcataggaactgggtgtgtttcttttgtccttagccaattgaaaagattgagtaggagaagggaggtcaaatcgcttaagagacattatcttctgccattatggttaactctataggataatttagcataagaaaagagggtttaattcgcctgaacacatgcaagttcaccctggacgagttgccactgccaattgcatcacatgtagggatcagggactataaccaggaaagacagaaaagagtccttcccctttccatgcagggcagttgtcctcattcactttgtggccttcaggtaatgccagagagtggctccagccggttgccctcaattactaaggatctactaggaaacagctgctgaaagattaaaaaagaaaa

SEQ ID NO: 176327 - DNA, 182 bp, Homo sapiens
cggtaccattatctctgtcttgagcaggaaagacagaaaagagtccttcccctttccatgcagggcagttgtcctcattcactttgtggccttcaggtaatgccagagagtggctccagccggttgccctcaattactaaggatctactaggaaacagctgctgaaagattaaaaaagaaaa

SEQ ID NO: 176328 - DNA, 449 bp, Homo sapiens
attggcagggtcagacttaccctgctccccgcctccaaccaccattttacttaatgaatgtggaaagcagccgtttgtgattattgaatagatcagttatgtcattaagagctgcaaaacagtgactttctaattctaacttcacttttgagtaatgctggaaattttctctcaataaaaattttctttcatccatttttagctaaaaaaagaaagataagcatttgaaccctctttcatttcagagccaagagttggttctatcatcctcccattttgaccaacaaggggagactttatgagcatcaggtgcacatatgggttttatgcgtttgatgtgtttcaatctattgcagttatcattctttctgattttctttttgttctacaccaggctggtgagaacacttttctttacatgagagtttaaagtttgcatcaaatttaga

SEQ ID NO: 176329 - DNA, 429 bp, Homo sapiens
acaagtcaatttagagatgagggtgctgggttgagtcatggtacactcacaggatttcacacattccctagcacagtccactgagacatgtgccacgtcagaattacagattgtactacttgtcattatctcataggaatagtagaaactgcagatcttaaaactttgaaagctaatgacccactgtattctgtgccttcattcagaacactaaagaattaatggctggtggaagggagcttatggttagatttttttctgtttaccacccacagttttgaaccctgagagaaatcttttacttccctaagtacatttccctctaagatttgattctggagtgaatccaaacttactgtttctcactagcacttaacaaatggcaaaaagggaattgtcatagttactaattgtattgtttcatggtta

SEQ ID NO: 176330 - DNA, 602 bp, Homo sapiens
tcacagcttcccttggctaggaaagggaaatcccccaaccccttgagcttcctgggtgaagtgataccccactctgcttcgtctcaccctccttaggctgtacccactgtccaaccagtcccagtgagatgaaccagctactacagttggaaatgcagaaatcacccatcttcttcatcgatcacgctgggagctacagaccggagctgttcttacttggccatcttggaatggatcctccattcatgattttaaagatatttttccatgtcttctagcttcattttgtcctatagaaactagacgtcatgtttatacacttctacataatatgtcttctttcgatgcttttaagatttattctttggttttcagcagtttgaccatgatacagttagttatatttttagttgcacttaccctatttgggatttgcggagtttcatgaatgtgtgggttgctgttttcaatcaaatttagaaatttttcatataatatagttgcaattttttttcttgctccatattctctctcctctccttcttaaatgtgtgtcagaccttttgagacaattgcacagctcactgggggtctgctaagtt

SEQ ID NO: 176331 - DNA, 315 bp, Homo sapiens
tccgtttaggtgctttgcatatgcctctggctatattataggggagattctgcccgcaagagacatttggccaggtctggggacatttacggttgtcaccactggggggtgctcctgacacggagtgggtggaggccatgaactctgcacagcacccaacagtgcccaagacagccccgccccagaggatggtctggccccaaacatccacagtgcaactcctcaaaccacgattctccctgctgggaatgccctcccatcatcttccctgcggataaatccacttaaatcatcccggttgtagcttagccgcga

SEQ ID NO: 176332 - DNA, 256 bp, Homo sapiens
ggaagatgaggaattgggctcctgtgagggcctcccctaccctgccctgtgcctggacttcgctgggcccactgcgggagagaagaggtaggacgaggccttctgcgtggctgggccagggtgggctgtctcacgtgctttcctggatgtgtggttgggtcatgccttagccaggaggtaggtggtttgtccactccctgtcattgcaagggtcacagaggtggctgggtggcctgaccctcagcaccgctccttg

SEQ ID NO: 176333 - DNA, 694 bp, Homo sapiens
tagtcagaaaagtaccctaaaagactccttggatattagggtttgccttccggatttctttttctagattttcctaattttttacagtgaacagaatagtgtaattagaaaacattttttaaagtaactttaaattctataacagcaatataaatgtttttcactttctaaatcactgtaattatcaataaggcaagaaatacaaagtggcaagataatgtgccaaaaatcacatcatgcatgatggggattgtttagagagctgctggtagacataacctttcattatttttagagtttcaatttgtagccgatttggtattttgagactttcagttcatcttcacttacaccactttcattaaaacttcagaaacagaaatagccacaggcaaacactttgaagcatgcatcttccttttcttatttcttactaagatatctaaattcagacatttgaccagtaacattgcaaagatgattcatatgtgttacaaacttagaaaagtcattaggaacatactcagattttgctgtaaacatgttttgttataaaagtgatgtgggtgattttgcttctgcagttgaatgcagtgagtggttactgtcagaaacacaaaatacagattgtgactggttaacaatcacatcaggggtacgagctcgaatcgtatcagccatagctgttctggga

SEQ ID NO: 176334 - DNA, 309 bp, Homo sapiens
tgttctttataccccaattcactaaaacatatagaggggtctatgtctctttcatccataactcagccactggtggaacaaatctcataatcaagaggatcatagtccctggtaagtggatccctggagcattggcaatatgttttccagggaagtctatctggctatcagggaagagccacctgccctctgcagagggagagggaaaatcaaaactcaggaaagggaatatatttctgctccaaaaccaccaggttttgcctgtacccttcactctttctagatcattcttcagactatacactaaca

SEQ ID NO: 176335 - DNA, 234 bp, Homo sapiens
aagtggtgtgatccatcatggaaagaagagtctgaactgcttcaaatatcgcacactgggaataattattttttttacttttttctttttctcttttcttttttttttttgtgagacaggtactcactttgtcacccaggctggggtgcaaaggggcaaacaaggttcactatagccttgacttcccaggctcaggcaatcctcccgtcttggccccctgagtggctgggacca

SEQ ID NO: 176336 - DNA, 166 bp, Homo sapiens
gtgaacgggatgtcctccagagagagcttgaagagctaaaaaagaagttcgagggcatgaggtctcggaacaagctgctgtcaagtgagatgaagaccctcaagagtcagatgggaaccctggtggagaagggccggcatgatgacgagctcatcgacgccctcat

SEQ ID NO: 176337 - DNA, 528 bp, Homo sapiens
atccacccacctcggcctcctaaattgctgggattacaggtgtgagccaccgtacctggccatattaagttttttgagagaattagaaaactgggtttcctcaactccaagatgttatcagttgtaaaatgtacccgtatgttttataccactaagaaagaaaaataagcctccaattaagcaacatgccatcaattgtaaaatataaccagaggggggagaaaagtagtgtttagctgggatacctccctactccctgaaaaacaagtcagggttttattagtaaatgaaaatgggagaatggatatttggtggcagtcatgataaccatttcatttctatatcattattaacctcttaaaatatccatcttaagtacattatggcaaagcttcttaaaatggtggcattggaatctcaagaaagtctcttctcatcctactccttacacagttgaaattaattgttgctgcctcctttctgtatctttttctttggctatcatttcttatccttttaatcaataaa

SEQ ID NO: 176338 - DNA, 392 bp, Homo sapiens
gatatttatataaacttgggttcacatccatatatctgtacactgaaaggcgaagaagtagtgacaccccagtaacaacgtgcacatccagtgcccatatcttggtttctaataccattttccaatataaaactagggctccttggagaaatggccctttcgaggacactgggacacgggacatgtcaaagggacacaggaaccaatctaaaagaactcccaacagccaaagctggaacaatctgatcaacagaataaacaatattgagttataacccaaagtataaaaaagtataaattgatataattaaatgactgaatgaacaaatagggagaagaggcaaatcttccttacagaggaattccaaataatttatatcaataatcccccc

SEQ ID NO: 176339 - DNA, 156 bp, Homo sapiens
acaagcacacagatagactgtacgtgacaatttctgacatggattagtgctatgagggaaacataaacagggcaaggtcgactgcaatttggagagggcagagcagacttttgaaatgacatctgagctgagacataaaggatcagtagcagctgg

SEQ ID NO: 176340 - DNA, 377 bp, Homo sapiens
agctggccccagttagacataacccaggtagcgatgcagagtatagatagggctcaggcgtttgtgtatgatatgttcgcggtgttctgatgatgtggtcgttggagtagaaacctgtgaggaaaggtattcctggctaatgttaggtctacctggatcaggtagactaacccctcaccagaagccaagggccaataccaggcttctcgtacagcctgcagaactatcagccagataaaccttcttctcttcttgaattacccagcctcaggtatttctttatggtgacaactaaacagactgagacagtaacataatacctgcacagtgtctggtaaatagttggtctacctggccgaacaactcactgttaggtc

SEQ ID NO: 176341 - DNA, 429 bp, Homo sapiens
gacgttaggacgcgaatcagccttgctcgcgctaggaggtcgacctcgcgttcaccaccctgtactagcattgacgagaataaccccaccctactaaaccccattaaacgcctggcagccggaagcctatacgcaggattactcattactaacaacatttcccccgcatcccccttccaaacaacaatccgcgcgctctacctaaaactcacagccctcactgtagcagagtcttctcccattaactgcccagaagattcaatgatgtctatgaggaaattagtgcttagtcatttatttgaaggaaagtcaaaatctcctttcattgagctcaacctgcagactgagtctagctaaactgcttgcttatccagtgaattctgagctatctttgttttgttgttgttgttgttgttgtttgttttcctt

SEQ ID NO: 176342 - DNA, 717 bp, Homo sapiens
aatatattaaaaagtttatatgaacattttcatcattgtagaattctattggatagcactactgtgggtgattctgatgtgtgctaaaacttgacaaccactgagcttggacatacagttttcaaccctggatgcagattagaatctacctggggcgttttttttgtttttgttttctctgaaacggagccttgctctgtcgttcaggctggagtgcagtggtgggatcttggctcactgcagcctccaagcaattcttgtgcctcagcctcctgagtagctgggactgcaggtgcccgctaccacgcctggccaatttttgtatttttagtggagatggggtttccccatgttggccgggctggcctcgaactcttgacctcaagcggtcctcccacctcagcctcccaaagtgctgggattgcaggcatgagccacagcacctggcctaacgggggacagcaggggaagacttttgacacccactgacatcccaacatacagcagaccaattgaaacagatggtggggcggttctgggggttgcaggaagactttagttgtttcagtttccccaggtgatcctaaccagtctcaaaaccaaagtcagaaccactgccaattccatgcacttttcccagcattctcattggagtcctctgagaccttacgaggttgccctgttatagccacatgtgctcaacagaagagcatcagg

SEQ ID NO: 176343 - DNA, 256 bp, Homo sapiens
ccccatctctaaaaaagaaagactttttaaaataagtaaaaatattttaaaaaatgaaaatgacatactccattgaagttggattacaggctgttgtgcaatctgtagttcacaataaacatgtgatgagtcttactaagtatctgtagtcatttcagagttctcttgtctccagttatgccttctaggtcatcatagatctgatgcttttgcccacaaaagggcaatttcattcttcatatgatatccaggtagt

SEQ ID NO: 176344 - DNA, 296 bp, Homo sapiens
tggaattgagccaacatggaaaaaccagattttctatggaagtctgaattcctattgtcccttgacaacaattcaccggggttttaggcatccaggagctctctggccaccctggccccaacgtgtttcattcacctacattgtctggccctgttgacatgtagtttgcaacactgggttccaggcctcatctttcaacaatgtccacacacacccaaatgtcctgccacacatctgggaattcctgaattggtcttccattttcacacagctctttgcaccttggcttatgcaaa

SEQ ID NO: 176345 - DNA, 498 bp, Homo sapiens
caaacttcttttattgtaatagtctccagtcgagcataatcaccaaagctatagtgcaatacgattgccaaaactagacaaacatctgtgagatggattcatctcagaggggaggccaacagcttgttatcattaaagcggcgatgctcgctctgcgcctgaactgcaggccgccttgttactgcgtttgcggaggcaattgtaccagatgttggcaactatcttcagatagatgacagacacctgctgttgaggaaattaagctcctcattggcctctctgatttgggggtggggaggaagaagcaagaaaaagtgacccttccagatagcccatgggacaggcactaacccaagagggtggttggagcttgccagatgggcaggccagctcagctcctggtgtcaaagacccaagaagggcccacggggtgctggtggaaagatggagaagtttgggaggaatctaattcaggctgggaaagtacggagctctgcg

SEQ ID NO: 176346 - DNA, 503 bp, Homo sapiens
tgatgccatgagactggatggaatttcatacagcacagagaatgagacttataataggacttgaggaattccattgtgaagacactattatttttaatggaaggagtattttttggcgtccgaaatatcagaaactagatatagtaagacacctctcaatcatatgtcatgctttagtgccaaatagaaataaaagttatactctagtacttcaaccaatgaatcaaccaaaatatattgaaatattgtgctgagttacagaagggttacaaagaatgaaagagatggttcatgctctcaagaagttttatagtttagcttagtagtcatgccacataatgctaaaagaataaaaatacaagaccataactggtcagaacccagtgagtgcgtctgaaaaaaaaaaaaaaaactctgaatttagagaacgggaatgaaaacagttttctcacatgagatgggcatgaaatagattgtaaaattcagagaggcagagtgtgaaa

SEQ ID NO: 176347 - DNA, 236 bp, Homo sapiens
ctggtattggacgcaggcatggaggttcttgtcctgcccatgctctcctatcctcagcaggaggctcctccaccctccaatggcccacagtgtgtctagcacaggcttttaacttgtaaactccaagccattgacaagcatggcaataaaacttcattgttcccgatggcagtagtctgtttttctaacctttggcttccctttttcctggtacatttatacatctggttctggta

SEQ ID NO: 176348 - DNA, 1055 bp, Homo sapiens
agcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagagcctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgccccctacggcatcaccccagagcccaggcctctggcacagagcccccctcacccacgcactccttaggagaaggtggcttcttccgtg

SEQ ID NO: 176349 - DNA, 301 bp, Homo sapiens
tggaagtgagggaaaggggaccactgggaggggcaggggaagtgatgagtaacttctgctttctgagaagttggtagtcaggatatgggagccggctgggggcggagggcagtgttgcaacaccccctctggctccagtctgacgtccctcccctggcctttggtttgcaggccctggctgtatctgctgctgcttctgtccctccctcagctctgcttggatcaggaggtgagttctggacaagtgagcagctgcagcctgcctgccaccctttcatctccccctaggctcccaccccat

SEQ ID NO: 176350 - DNA, 356 bp, Homo sapiens
ctgcagtgtgtcacttagtataaatatctttgtgggaagatcttctaatattagggtacctctgaccgtgatgtcacttatcctgatatcctgattgtagtgtgtctgaattcaggagaatgtcaggtatatgttagtacttgacagaagttaggtagtgtacttaccagcagttgccctcaggtttagttgctattcattaaatgagataaggcttactaagagatgtttccccctatttatttttcagtttactgttagcctagcccaaggccatttttgttttttagtgtatgcaaaaagatatccttaggagtgttcactggatagtagaatatgttcaagttacaaccatt

SEQ ID NO: 176351 - DNA, 412 bp, Homo sapiens
tcggggtgtctagaggatcccggtatccgtacagcctggattcataccttggtttgccacttaaagtatgcctttggcgagttacttctgtatgtcacagttcctgtatctctacaatggggatagtaatagtagtacagtacttacctgaaaagatgattatggggattaaatgagatcatacatgtataaatgttttatagtgcctggcatatagtaaggattcagtaaatgttaaacattattgctattattaactcaaacagatttatgtttgttactgattaagatcatattacaagtactttttaaaaagaagctttttagtttgatatatttacagaaaagtagcaaagatgatagagatttccctatacccagcttctcctgatgttaacatcctctataacca

SEQ ID NO: 176352 - DNA, 484 bp, Homo sapiens
tcatctagaggatcccgatatgcgttctcagctgtgtcgcccaattttacatcaatgtgaatgacttttttttctgcaactcagcagatacacagtttgtacaatatctgtcagagaggaatagaaacagatcatgcaacacagagatggaggtggaggtggacaggggatggaggtttttagattaagaggtaaggggtgaagcataacatcaagccaaagccaagccaaatcaagccagcaacaaagaaatatcccatgttttctagaactcgtggagaatatttgccgcaaacgataaaagaagtctgctcaacagtaacccaatgacaaagagtgtaagcagatagtacaaaaaccaaggatgtttttatagatattatattacggattttgttaaagaccagagtgttctgaatgtgttaaattcctttaggtgagacatccaaaattttaatattcaaatcactgctacagacaatga

SEQ ID NO: 176353 - DNA, 243 bp, Homo sapiens
caatttcattttcattcagttcaatttattgttttatttcctttgagacttccctttgacatatagattatttagaagagtgctctttaagtttccaagtgtttggacattctcttgtcttttttctaatattaattcctagtttaattccattgtaatcagagaacacactcggtatgattttcggttcttttatatatattcaggtttgtttatagccaatatggtctaccttggtatatg

SEQ ID NO: 176354 - DNA, 378 bp, Homo sapiens
gatccctcgcttacgcgctgtcacaatagggtcgcattcctgtgagaatcgaatgccgctgctgttctgacaggaggtggatatgctggctcactcgcctgccgcttgcctcctgctatacagcctggtttctaacaggccacaggctggtaattatgctcagcccagacattgggcaccttgctgtaaccataaaccaaggagaacgtgacatgtgctagagtggaaatacaagatactatgaaagcacagatgagtaaggttaatttcagctgagtaggtaggtaaatgtaggtgtggcctgtgaactagaacatgaagaatgattaggattttgtttgttgaggatacaggaaaatgtttcagaagagggaaatt

SEQ ID NO: 176355 - DNA, 499 bp, Homo sapiens
tccaacgaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaaaagaagaaagaaggaaaatttgagggtttttgcttttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccg

SEQ ID NO: 176356 - DNA, 337 bp, Homo sapiens
gctcacttgtgacccaaacatgttccttctcccacccaatgcacccgagtttcctcacctgtaacgtgaccagagttgggcttccaaacattttcttccagtgaaattttacatggaaacttgagctgtggaagagacagaaggctgctgtagtgaggtgggggtgataggaagaggactgggaacccccttttcttataccccagatatccctatggctcccttgagctcagtcagaaagccacatgtggccttactgcttcttaaatttttgtttgttggcaaggaaaggtcatttttgaaaaaacaataaacgaataacaattttaaaatgaaa

SEQ ID NO: 176357 - DNA, 645 bp, Homo sapiens
ctctgaacatgccacaaagggtgaatgttccatccagtcccacgattctggaattctatgtatacttatgtacctcccacgcctttcctccaggacacgcacacacagagcaaagtcttcctatagcgggccatgatgctgcaattgcagagtatgtaagtgtatgtgtaggcgtgtgtatatttgtaaaagcagaagtgcacgcatacgtgtgtgtgtgcatgtgcatgcacatgtgtataggggcatgcgtgtgcatgtgcacacagaaatatgtaggctttcaatacatagaacacgactttcctttcagacctttctttcttctattgcctgaaagtataaaacctgaaataatgtggatagtttgaggaaaccaaggatgtttctagagcctggcttttcataggctctagaaacagagctctgtctgctctaggtttcgagactggttaccgttctcagatccaggagttctttagacgtcatccagttttccttgctatgtgctgtgaaattacagccgtgccatcagtagagggctccctcaaccttagaagctggtgagaatgcttgaaggccacgcaatgtaaatgggagaaaaatgcagatctgactgtgaattttaaatccagtgccctaaag

SEQ ID NO: 176358 - DNA, 408 bp, Homo sapiens
aatctccctaacctgccctccccctgagccccctctctacacacacacacaattcaccatttaattgccttgttgctttagcttcctggagacacagccacagagctaaatatagctctgtccttcccaacaagcaatcctttaaaggagctaaattgccttgcttttttacttcttaccaaaacttgatctcaagctttataaaagagaaaaactaaaggccttctaccatagaatgtttagcaatcgacatgctgtccattgcttgagaggttttgtgtactggcacttaatccttgcttcagttacaacccctgtagggaaatttgagtcctgtacacgggttcttcattcatttctgagccaagataattctaggattaccatttagaaaattgggagaacaga

SEQ ID NO: 176359 - DNA, 159 bp, Homo sapiens
tgctgggattacaggagtgagccaccgcacctggccctgtttctttcctcaaatgctaagcctagcagaatgcctcctatacagcagatgtcagtcaatgtttgttgactgtttgaaaatgtatgatcttaggctctggaaccgcagttgaaagacgca

SEQ ID NO: 176360 - DNA, 290 bp, Homo sapiens
cctgtgtggcctgactccaaagcccagtctcgatccccatccattctgcttccttggcttggcaagagtctgtctgcagactgcattcattaagttataattactttacttgtccattttttgagttggtgagaggcttatgtcccctccagacagagctattattccctatgatgtactacagttcccatttgccgatgccagccaatagcaggaacgtttttttatttttgtttctggtatgatctttctatagagaagcttacattttcaataggttttaacacatt

SEQ ID NO: 176361 - DNA, 140 bp, Homo sapiens
acatgcagtgtggacaaactggacagagggagactcacgtcctggacaagatgcagcaggacagtgtgggattgaagactaaagaattgtctggaattttccacctaatctttttagactgcggttgactatgggtcact

SEQ ID NO: 176362 - DNA, 783 bp, Homo sapiens
ctcagcactctgccacagcttaggccgtcagcacgagcagatgccccattagggggcctgagaactgagaacggggactgtaatctgctatttctgtccatttgttgttgacccaggtaaccaggaaatatgggaagcaggcagattctggttgtttccacaggagttgagacttaaccagacaactaactctcctgagtgttccctcttgggtgggcacaccacagttcaccccgtagtctgtggtagactcagcattagacacagtgctggtgcttaagaaaagtttccatgaacaggcagtgtgcttattgagtgccagctgtgtgcaaggtatcgtcccaggtaccgaagaggattccaggacaaagtttcctgtcttcagggaactgtcagtcaagtggatcaaaagacacatgcctgtgtgatctacaacccagtggatcataaggcacatgcctgtgttttctttgaccctcagaggaacaaaagtgtttttatttgaccctcagggttttaaaactttataccaacatttaaaaattggctaccatctatatggaaaaaaaggcagtgtgtgcttgtgtatgtgtatgtttgtagggtgtgtgtgtgtgtgcgtgtaaggcagcactgcagaagaacccggccacagtgatggcctcttcaaatagggaatcggggagcaggaatgggtgagagacttgttgcaatgttttataatttttttaaatgtaaaatgtaataactttacaaataaaaaaggattggggaattcacata

SEQ ID NO: 176363 - DNA, 214 bp, Homo sapiens
gcttattttgaaaataagtagtatggaagcatctcaagcatcttatattttatatgtaatttctatcttctaaaaagtttttgttagatgggcattgagggcatgcttagtaaatgttgaatagtgataatagaatttttgccttatattttcatgagaattagaaattacgccattttaatcccaagcacagttagattagtacttaacaaaa

SEQ ID NO: 176364 - DNA, 789 bp, Homo sapiens
gaccaaggggagcacctcggccaagcccctcatcttacccgagggaaactgaggccccggtcggggttgggaattgcacccaggaacaagatcgggcccctgtgactccaggtcttctgatcactgcgcttggcccatgcgagaaacctattgtgtttgttttcacaattaaatttacttcaccagagttttctttctgaagccgctggccccagagggcagcctgtgtgtgagagttgctgcgtcctgcatggatgaccttatttgtggacaacaggactgccaagaaaggaccctcaggacacctgggtgttttgagaatggttgctagactctccaagtagttgacttctgaattgcacaagtaagagacaggcagctttggcagggcacagtgtgttccagaatggtccatacgatgaaacttactaaatcagattggctgcagatctccaggtatgggtaagtttcttcaccttctgtgtccctggagaatcaggagtccctgcagccatcacctagcccaagtttgcacatttctgttttcagagtctacaattgagggtaggggccagctgtgggcttgttacggaagagtcattccccaaaataggaaaggagctgagagatggcaatttggaagggcgggcctccgttatgcgaagcggcagcagaggggtctgttgggacctccctgaggaggccgccctgggtgaagctgtagtcaatttggggagagggttttaccccaggcaaagaaaagggctgggatgaggcaggagaggaggg

SEQ ID NO: 176365 - DNA, 499 bp, Homo sapiens
ataaaacacagactgtatactgggaaaatttataaactgggatcagagaaaacattttataaaacaaattgcacaataaaaacataaaaaatatgatgcaggctccctggtctgagtgttcatattggccaaaagccatgttcagagttcttattctccaattggatgttcctgcagatggggcctttgagagaatttggtcatgggtgttgactacatatgaataagactggtgcttttatttatattttttctttctttctttctttatttttgagatggagtttttctcttgttgcccaggctagagtgcaatggcatgatcttggctcactgcaacctccacctccagggatcaaatgatcctactgcctcagcctcccatgcagctgagatttcaggcatgttacaccacacccaggtaatttttgtacttttagtagggaaagggtttcaccatgttggccaggctgctctcaaactcctgacctcaggtgat

SEQ ID NO: 176366 - DNA, 372 bp, Homo sapiens
  misc_feature (88)..(89): n is a, c, g, or t
tattttcataatgttcttattcgtcccaattggattttacctgctaactagccctatgtacataatctttgtccttactttttccctnntttttaaataagactggtgcttttatttatattttttctttctttctttctttatttttgagatggagtttttctcttgttgcccaggctagagtgcaatggcatgatcttggctcactgcaacctccacctccagggatcaaatgatcctactgcctcagcctcccatgcagctgagatttcaggcatgttacaccacacccaggtaatttttgtacttttagtagggaaagggtttcaccatgttggccaggctgctctcaaactcctgacctcaggtgat

SEQ ID NO: 176367 - DNA, 339 bp, Homo sapiens
aggccattctcctgctcagctcccgaatagctgggattacaggtatgcgctatcactcccagctaatttcgtatttttactctgtatgggggatctccgagatcccccatacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagt

SEQ ID NO: 176368 - DNA, 436 bp, Homo sapiens
ccctcccagcttggaatacatatcagagtcattaaaaaacactggcattcctgaattcaagccctttccttatgcgccatcctttgagctctcacttcaactagattgtgttttcttgcagcatctctctaggtggatccatgctaccagctattgtatttagtttttctttttccaagtgagatcaaaaaggttaaggcatgacttctttcatattcagcttcaataaaatcattgatgagatcttttagatttaataagaattctaggttttctgccctgcatctcaaagtaagctcatttgcataataaaaatatttgcactccgacaccaccaattactggctcgggacaagttactcaaatgctttcagccttagtttccttacctgtaaaatagagataataaccacatagtgctcccctgaaaataaat

SEQ ID NO: 176369 - DNA, 379 bp, Homo sapiens
agttcctgggtctctaccaggattttccaggtcagcatcgagtgatactatctctcctagaagtggtgggaactgatgggaatgaccatggaagctgaatccacaaaccaagggtctccttatcttgtcctctcatggataaggcttcgtaaaggggggattcctcaaggtcttttaaccaagtctgcacatgggagaaaacgatggaaagcagatggaaatgcttctcaagaacctctcaatacaaagagataaagaggaacaggccaggcacatggcacacacctgtaacctcagcactttggaaggccaaggagggaagaccacttgagcccaggaattcaagaccagcctgggcaacacagcaaaactctgtctc

SEQ ID NO: 176370 - DNA, 129 bp, Homo sapiens
agggcctgcttgattttcctacctaaactagtcccaattttgctgagtaaatgtgaacctaaacaaacaccaacaagccttagcaattttagggctcttaaacaatttagaaattatgtttatcaagac

SEQ ID NO: 176371 - DNA, 345 bp, Homo sapiens
gatctgatgcctaattctggttcagaaaagcccctgggactttacttaggcaccagtttagtgcctggttttcccagctcccatgaaaggggataaaacattgctttgatcaatatctctttggtaatggtttgcttctctttccactactctcctccatacccacatatcacatgccctcagggatctccagatgatatggtcttcttgagatttcttgccaatacccagacatcagaccctcctgtcattccctttaccacctggattagccactgtggtaactggaggcattctgcccccaggcctttgctgtttaagggtttcaccaccagagggtggtat

SEQ ID NO: 176372 - DNA, 773 bp, Homo sapiens
tacccaggcccagctgccgaaactggcctgagatcaactcctcaaaagctgagaaggactctggactggccacggttgggagatggcttccaaacgccatctgaacaaggcgcgtgctgtccagcttagaacagcagccaggctgggggcactggtagggccagccaggtaggaagcctgccagggagggggtttgcttttcttggctccgactggtaagaaaagctgagaaggtatcaccaaggaaggagtcgggtgggagttctccaaagtattcagaggacggcgactcctggtgccaacaggaaggtctgggccatgtctggggactggaatcaccatcatggccagcctggggtgttgtgtgctcacccaaatgggcagctctgcagctgcactgacccacccatgtgaggggctgggggctgggacaaaattatggcccaccccgtccaggcagggctgggccaggatcagggagggatatgtggtctgcccggcaccccagggagctggtgggtacagctggggcttcaagccaggtctcctgacatggaagccacatcttttcttcctctgatttggaaggaaagagacagtgctgtgagtctgcaccctctaagagtgtggaccctatagctggacacaggggacctccagaggccagggtgtgcgtgaggcctggatctgccccttcctggttctatcacctttctccagtttactcaactctaaaacagactcctatttcccagtggtggtgcgaggattaa

SEQ ID NO: 176373 - DNA, 327 bp, Homo sapiens
ggtagacactgactgagctttgtccttctgtccccaagacctaccccaccgtgggcattgctgaacttcaggatgtgattctgtgcttctcccatggcacccaacctttcacatgccactggggaaagaggtggagaacctctctcactgagcagcctgtgaaagtgagagggagggatgcagttttataaggttggagcaaccccttcaacactggctcccctatccccagtcctatgcttcagggtaccataaaaatctcaggaggactatagagtttctagtggcaaaggatctcagtctaggtcctccttgccaagtgctcaa

SEQ ID NO: 176374 - DNA, 428 bp, Homo sapiens
cagttgtcccttcctgtactctatactattgtagattcatatcttcatatgccttgtaacattttcatgcggtctcaaaagggagagaatcacatgtgatctgttatcctctttattcagaatatcttgtttcttcaacctgtgttttccacttgcatcttttttcccctttgaatctatcttcaactctttagtttatgtataatagtaattgattttggcatgggcagttagcattataccttctgtatgcccataaggagtgacctgaccaagggctcagagctaataagtagcagaacaaataaccctctaaatctttagacttttccattgtattgtattatttcctcatatccatttattctgtcttttcaaagttctttgaattattcctgtatttgttctgattaaagatttctttcacc

SEQ ID NO: 176375 - DNA, 163 bp, Homo sapiens
attctacaaatgtggaatcatagcaaggcagcacttctttcatttatgtggggatttatactaatagacattcatttagttaggtagtcaaccagtgtgtactgagcacctgctacatgccaggcactgctgtcagcactgcagacccaataatgagtaagat

SEQ ID NO: 176376 - DNA, 506 bp, Homo sapiens
catgtgtgtttatgtgtggcggggatattagtgccgaatcaaacagttttaagttcatagggttgtcctagttgtgagctaattttgaagtagatgctgtggtggttactgaagctacttgatttacttctcatttttattataatgtgattaacacacatggggggggaggggtgccatttgttcctctttacactttccaagtgtttgtgtgttggcactaaacttgtttcctggtgtaatctgagctctgagaattgccaaattacctaaatctccacacattttaacacatttattttctcccaaagcattaagtttttgttttatttaaagtagcagtattcctggacatgtggctcttattttgcatggacagcttatgatgttccgtgtgtaactagtttgtgcatttctgtttagctcggtggatttgccttggacaaattagggacaaggacattgtgggacagcaagaattccaaaagaaccccggattaaggcca

SEQ ID NO: 176377 - DNA, 627 bp, Homo sapiens
agtcggtaccgaaagatctcgtgcatttgtcaaaattggctttttaagggtgattaatattccattatatgtatatgccacgttttgtttatctagtcttccatccatggccatttggtttgcatccaccttttggctattgtgggtaatgctgctatgaacatgggcatgcatgtgtatctttgagactctgctttcagttctttagggtaaataccgacaagtaaaattgccagggtcatggtctgaaagtatttctgtatatatgtttgttgacacttcagctgggtttttaccatttcttgactttggaaaggtctgaaaccccagagcaaatggcaattctaattgattagaaaactggatttttccttaatagattttggaagatttaggagggtagcacataaagttcatcctcccttttctcaccacatttgatgtgaatttgctacctctcagaaaacaaatttggtctctgaaataaagcagatgttttgaattctcttatataaggaaactgattttcctacatgtaaatttttatcttttaaccatttttatttaaaacttgtgacctacatttttctgtttcctccctgaagtctttgttagtggtcattttgg

SEQ ID NO: 176378 - DNA, 713 bp, Homo sapiens
aaggcattataagacttatgtgagttaatgaaggtataagcacatctaatactgaacctttgtgagggtttcttttatcaatttatttttaaatggactaccaaaaaaggcctaaaatggcctaaaaatagacttttgagaactaagaaagcaaaatgtagttccaacataaaattaccattgccttcctcatcctataaccaataaaaattcctttgcaacaaatataattacatggaaaatctctgtagagaaaaatgttatatccttaaataccacttaacttcaagcatttgtttaatatccaaactgttttaaaaaaataacaatgccagagaattttctgtaagagaatcttcccatttttgattgggtagcccgtcagatgggagaataacaggccagtgatggacagctcctaggcctgtggtcggtgttaagaacacaaacttctccaaggcagggattcaggaaatctgtaagtcttttaataccttacattgtaaagtaccttttgatgtatttataactgaaaaaaaattattcaaacaagaacagagtattatggtacaaagtctcttataggtcactgggaatagaaaaaaagataaattctttgcttatcaagcttaacaatttacaaataagcaatataatttgtataagagtcacaaattgtgctaagggaatccagagaagtaaaacagaaaaca

SEQ ID NO: 176379 - DNA, 524 bp, Homo sapiens
cattcttaagaacaaatcttagctattgatcatctcaatcataaactcttcaagatggctccctcaggagcttccttaaaacatctcatcctgagttaaaactatgccattttgaattttttaggatgattagcttcaaagtggacatgcacatggaaccagtgtgatctgttgcttaagtttatttagtattttcttgttaaatgttgggtctaccagatataacatttttagaacacattaatgtagctgataatattgtatctggtaatactggccaactgtttgagcctctttgaagtcttcagtggtttgatcaagataaaaccatgtcggctgggcgcagtggctcgcgcctgtaatcccagcactttggaaggccgagacaggcagatcacgaggtcaggagatcgagaccatcctggctaacaaggtgaaaccccgtctcttctaaaaaaaaaaaatacaaaaaaattagccgggcgtggtggcaggcacctgcagtcccagctactcgggaggct

SEQ ID NO: 176380 - DNA, 388 bp, Homo sapiens
gtgattgctttggtatggagctgaagatgagaggaagttgatggtgacttccagatttctaacttgggagaaaggaagggacatgggttcaggcaaagaaggaaaaaatcaagaaatcatcattatagtgtcaagtattccttctgccactccttctcttcctcaatctctgtctccctccacaccagtctcttcgcagggctccagcctgtgtgaggggctctgaatgctggtgcctgagcagtgagggcagcaggtatcagatctccaggctttcagcttcccaagaagagggatgcttgtgctgaatgtggctggaataaccaaggcaggttgggaccagggaccttttactggaatgtttgcacctggacagagagggtccagg

SEQ ID NO: 176381 - DNA, 454 bp, Homo sapiens
agtattcacaacacacttagaagtggagaaatgaaagtagacattatgatcctcctttaaaaaagatatccagtgaggaaattgctgcacaaagaaattaaggaacttccctaagggcacacagatcactgatgaacagaccaatgttcaacatcaggtctgactgagcccaaatcctatgtgctgccatgcctgcattagggcatactggggtcagcaggggcctctggggcccagaattgctcagtggcccaggatgtcccagtgataccttaaggtgggctgtgggctcctctgtacttcctgcaccgctccttcactttcacatgcagtctttcagaatcctgtactccgctagttaatttaaacatgtatttccacttatgagttaatgattattgtaataggtgatgtaaaagatatatccgtgcacagtaaaaattcaaatgctaca

SEQ ID NO: 176382 - DNA, 357 bp, Homo sapiens
tgatgaaagaatgggagagagagaattattataactaaattcgatgaatgaattaatgagtatcaagatctatgctcagacccttgctgtaagatggctccatcaaaggcctgccccccagtggagtttctgcctcaagaacactagtattctttcaggttgtcaggccaggaaccttggtcttccttactccacctttggtagaacatccatcttcagtccagttggccattccttcagcgtgatgttggtgggcccttgccctccattctaatttcatctctctggtccaggcctccatcactttgtgcccatcttaatgcagttgtctgtgtgtgtcccagtctccagtctctt

SEQ ID NO: 176383 - DNA, 263 bp, Homo sapiens
gtctgtcagatcgagtctagacgatccccaggtgttgctggattccaatgggttgtagcaataaatgattgtggggtgggggggtttcaagaagtgcagccagtgagtatacatgccactgaagtcacctggctacagagggaaggacagtgtgtcgtgccagaagagaatatggagttaagggttttttgagttgtttgtttgtttgttgagacggagtcttgctctgttgcccaggctggagtgcagtggcgcgatctcgg

SEQ ID NO: 176384 - DNA, 309 bp, Homo sapiens
ggctaaaaagcatcacatatgttatccgtattgaggcgaatggcctctcttactagtttcaacggcatggcaagggtggggggctggattccaatgggttgtagcaataaatgattgtggggtgggggggtttcaagaagtgcagccagtgagtatacatgccactgaagtcacctggctacagagggaaggacagtgtgtcgtgccagaagagaatatggagttaagggttttttgagttgtttgtttgtttgttgagacggagtcttgctctgttgcccaggctggagtgcagtggcgcgatctcgg

SEQ ID NO: 176385 - DNA, 207 bp, Homo sapiens
gtaatctagctgaatgcacaggaggaagatgaaacagtgcttgattgaaacagcacagtctctgccgtggacctgaggccccacctactcaaccattgaagctgctgagttgtgctggatgcaaattaacatccggtgactaggggctcctacaatgtgtccttccctgccttaggtgggtcttcatttggagcttcctgctttcct

SEQ ID NO: 176386 - DNA, 122 bp, Homo sapiens
caggacattttagaagtatacaaaatagacaagtaatataatgaaaccttggcatcaccattaggcttcaacaatcatcagtgttttgtcattcttattttatctatccctctacttttggg

SEQ ID NO: 176387 - DNA, 271 bp, Homo sapiens
aaggttagggtgatgtggatggtgactttccagatttaaagggaaccatgcaagtcaagccctgtggatggctacttttttcatggcagataaatagcagttctgtggcagccgctcatcgccagagtccatcaaggtcaaagtatgcttctcaatccacacatcctttcgctatgcagaggcaattgttgaaaccttcaagggtaaataatactctgcattatcaagactatgtgcaatatttcatcaaccgtagacaacccaccgcatc

SEQ ID NO: 176388 - DNA, 418 bp, Homo sapiens
gcccagtagggaggtctccgaagaacagatgaaaacaccattgagaaagaggaggaaccttcagaaaaccatcccatcaagtgtgaactttctgcattttttttcccctgtcctttttcccatttgcaaagaggaggaggtgagtgaaaggtgtggctgaacacacctcccacctgagtgtaaagtggccatcgtcaactggccctacctgaggaaagagagaatattcagctctaaattagttttggagacttgattgttattaatacataggagtgggcattctaatgattaaatcgaggctctgtctcctgaaataatgactctaggactaaagtgggaaaatcttgggacctaccagcgttttaatctagccaaaaggtgaacatttcctcattgaatacatttttcaaactta

SEQ ID NO: 176389 - DNA, 303 bp, Homo sapiens
gttaattttttgtgatagcttgagatataattcacatattatacaatttgccatttaaagtatacaatttagtggtttttaatgtattcacagagctgtgcaaccatcaccgcattcaattttagaacattttcctcaccagcaaaaaaaaccctgtagcctgtagcggttaacctcttcccatttattcccaccagcccaggaaaccctcagtccactttgtttatagattcgtctgttctgcatagtaatataagtcaaatcataaaattgttatcttttgtgactggtttctttcactta

SEQ ID NO: 176390 - DNA, 576 bp, Homo sapiens
agctgttattgttgttagtattatcacgaagcttatcttatgtgtccagttctggtccacatatagtcggagatgaaaaatgagaaaaatgaatgtgccatatctgtgtcaaggacctttatttgctaatagaatttttttaactcatttgttagaaattgtcagtaccattttggagtaacaaaattagcagttttgtttggcttaacctaataattactatcataaaaccctctttctacctttttatgtctttagtgtgtgtatatgtttataaaatttctgaagtttgtgtacatttgcacctatctgtgattgagtaatacatgagtgtaacccctttatgtaaacatacatcaagttgtttctaattaatgcatgtttttggtaaaggtagaagcatttggacacaactctagctgataatatgtcaccttaaaaattttttcgtataaaaaatgaaagtaatgtatacaaaatgcagttgtattcagtaatatagaggtgtctaaaataaaactaacaatgacagtctctgccactgccatggccctattgtaaccattcttagcactg

SEQ ID NO: 176391 - DNA, 367 bp, Homo sapiens
gttttcaagcttgagtggcattagaatcaccttgataaaacacagattactgagtcccgccttagagtgtctgactcagtaggtctggatggggtccaagaatttgtatctaacaagtttcctggggatgctgatgctgcttggccccaaaagtgggaccacacttttggaaaccactgtgtaaaatcacatggtagcataggaaagggaagaagaggagagcctggataattcataaactggataatgagcccctagttacagacagatgtgtgaaaagatgtgttctaaatcaggcaattcaggccgggctcagtggctcacgcctgtaagctcacacctgtaatcccagcactttgggaggcag

SEQ ID NO: 176392 - DNA, 772 bp, Homo sapiens
taaaaaatagaatctgctcagccctcggggtgctgctctctgttactatcctcatttttatgacggcgaaactgaaatgttacggagattacgggaagttgctgagctgcgatgggaacctaggcccatctgagccctgagctggagtgctgagtcaccatgccatgtggcctccctggccaatatctatttgctggaactctattaattggtgtgtcgggacatctgtggtacaatggaaattgatgtttgtccagatgacattgagatccttttacactggggtttcagaccctgtggagaaggggagggtatttgcagtctcctgggagcatgttcagtggcaggatgtgaatttacagcaggagaacaaaccaaaaattctgtcatttccaatttataataaaaattcagaaagtggggaaggacagatcttctgggctgatagggcccagagaagcacgttgacagggcatgtccatttgtcaaaagagactcgggcgctggtattccagagttttactgatgtggattttgtggtacaggactcagttcctttgggaattgctttgtttgttttgtgtcctgagcctatccctgctccccagaaaagtgaatgaccagctgatcctgcttctccaagccccagcagagagtcccagccagccaggccaggcctgagtctcagcagtaaagagtgctgccgagggggcctagagggcacggtggctgttctttgcatccaggcggtcagctggcgggaccccgggag

SEQ ID NO: 176393 - DNA, 511 bp, Homo sapiens
gcatgttccacaagggtttcctgctccaacttgggccctaagggattgattaggttggctaggttaggtcccctttatgacaaaaccaaaacagaattgatgcccccacccgtcaagggcacttaaaaaaccaaaactcaaagttcagggccaagtttgaggatgtgcagaaaggtgtgtgttttttcttgtcaattgcgactctaatgatggactcacgttgcccgctcttccctttctcttacaccttacctacctactaaaggaggagttcttgcttggtaagtggatataatccgcaaagacatgagagaatttattagaagccactcaagagccttagctaccttctacaaggggaaaaggacacacacaaatatctatagtgaccctttttttcgtttatttttggtcagactgtttaacttccattttttttgtcccctcctttcttttcccctttagttgaaaactgctaaaatgtcagtttgcgaccttgactttatattta

SEQ ID NO: 176394 - DNA, 352 bp, Homo sapiens
ggataaggttaagcaaagggttatgaataaattacagttggtctcccatatttaaaaagtactagaatttcattataatatttcattgctccattctggtcagaatcaaaataacatgcaaataaactgattaagcataataccccaactgccttaacagcacacatacgacacccgctgatcacacagacaggtaattgtcgaatcaagcacaaaatggatcaacctctgtccttcaaagaaaatttaactgtgtggaacaccactttagttcccacaactgcatgatgcaaacagtgtgtcttagaaatagtttcaaatacgaggctctatgctcaataattaacacctc

SEQ ID NO: 176395 - DNA, 179 bp, Homo sapiens
atgggagactgcagagatagcaaatgcagaccagactcttaggaaggcagaaagggggctagaaaaagaattgaaggaaagctttcttcagatgcttaagattttgtggccaggtgcagtggctcatgcctgttcccagcacattaggaggccaaagcaggaggattgcttgagcccag

SEQ ID NO: 176396 - DNA, 516 bp, Homo sapiens
gcgcgtgttgtttaccagcagaatattggaatagatgttttctagttatgcacttagcaacctccctaccagcacatctgggtaaatacagatttctttaagtgctgttccttagtaattgtttttcattttgtttaaaaaaattctcaaggagtggggaagcttacattatagactccctggaaagtcttcctggtctgcatcggcactccgttatttgagggtaccatttctaggtagccattgaaggtagtgctccgtgagtcatcctttgagccttctcatgactacagcagcgctaaggcagcaccttccagaaattctctaaagggttctgtcagattctagtgttggtcctaagactaatttgaactggtgcttctttagaactcagagtttacagagtattattggaaattggaaggaactagacaccgcagtctggagacacttactggctgtgaagtgtctttcagtgatgtggtgttcctgtaaactacaacgcgcggctaaggt

SEQ ID NO: 176397 - DNA, 390 bp, Homo sapiens
acacacacacacacagaggaatggaattgctggatcccatggtaactctgtgtttaatcttttgaggaaccaccagactgttttccaaagtggctgcaccattttacattcccaccagcagtgtataacggttccagtttctccacgtcctcgctaacacttgtcaaactatattttaactataccccacaataagaaatattttacattcctactcagtttatacacatacaaataactgaaacaaaaactttagaaaaaacctacctatactatgtctgatgcactttgacattttcgattgcattctgttctttttcatcaaaacaaacatgttgcttctgatcgctcaagttgcttttacaactcactaattgtgacctgcagcta

SEQ ID NO: 176398 - DNA, 507 bp, Homo sapiens
tgttgatggggggatccacggtggtcttctcagaggatagagtatttcagttaaacttgggaggtggagcaggatttgatagggcagaagggaagggggtacatcacaagcctaggtgagggcaactggtgcttcacacaactcggggaactccattcacttcagtcatcatagtgccaatcaacatagtcactatgtggatgtgacaggagaggtttctctttacctctggtcctgcacccctctgagccatcctacccacagccttcagtcattgtcctaaagcctagctctaattccactgcctctccttttgtgcacacacacttctctgcttccctggccgttctctatcttggagaggcatttcaaacgccacttccaccagaaggccttgctactgcaccaactagttactatctcttcttcacccaaatcctggtagcactttggatctcccactttgcacttagggttcaccttccgttataatcacgggccatcaat

SEQ ID NO: 176399 - DNA, 369 bp, Homo sapiens
gtgaagatgatatttgaacattttaaaacactttaaataaactgttctctcctgtttattgccactgacaggagaggtttctctttacctctggtcctgcacccctctgagccatcctacccacagccttcagtcattgtcctaaagcctagctctaattccactgcctctccttttgtgcacacacacttctctgcttccctggccgttctctatcttggagaggcatttcaaacgccacttccaccagaaggccttgctactgcaccaactagttactatctcttcttcacccaaatcctggtagcactttggatctcccactttgcacttagggttcaccttccgttataatcacgggccatcaat

SEQ ID NO: 176400 - DNA, 347 bp, Homo sapiens
ggcatgatctgtaccatggcttgttctttctatctatttccatctatacgttctgagcctctaaaatcttatatgcatagttcgtggtacacatcttttattgagactattgccttgttaatttctaattctagaaacttaactctagaatgtagtagcattactttctcatccctccttatgaaaccactccatagtcaatgctgtactcagcactgcatgatgcagaaaatggtattggagaattcaaatgccttttgcagccttttttctttttactctgtccccagctgcaataaattttcactcttcctcaaacaaatagagcttcatcaccacttagaatt

SEQ ID NO: 176401 - DNA, 390 bp, Homo sapiens
gggagctatatcgcatggggttatgggtgaaatgagctggatcacagttaaagggggggtacactactactttattttatgcatgttttagattctccataattaagaatttattttatgaaggtatgttctgctgttagttggtgagaagtaggggctacataattcttttctgttgtgagaattttactacagtaatctgagtgagcctataaacaacataaaagaaggggcaaaagaggaataatggcattctgtaaggggtatgagtacattccccttctggaatttctctggttaatttaaaagaggagcttctcaactgtgaccctgatgcagttcaatttaataggcatctatcctgtgcttacgcagcccattgcgatatag

SEQ ID NO: 176402 - DNA, 235 bp, Homo sapiens
ggacactgaaatatagatccaacttcccctctactttgccatcatcttcttttttaggcaaaaatacctggggtctttcatttaatctttatgtggttggtttccacaccattcctctttcccagcttgtttgaatgaacatgtgtcaacatccctattacccagaatggaaagtgatctttgagcagagcccagacaggcatgtggctaggagtgacccatccctaacttaggg

SEQ ID NO: 176403 - DNA, 134 bp, Homo sapiens
gctatctctaattccttatctcccacgtatttctcaactaattgcaatcttatttttatcgcactactgtaaatcacactattcttccaatattaccaatatgttcctcatctgatttaatctgtcagtagcat

SEQ ID NO: 176404 - DNA, 565 bp, Homo sapiens
ttggatgaagtggttcttccccaggcttcctacaggcctagcttaggagggtggcttcctgtatgctgaggagctcttccttgcagagggtgacacaatatgagtgtgcagacagactggctttattggctgcctggcttgtgcccaaggtcacagggcacaggtaaccagagacctgagaaaataatggctgcaaggcaactccagcagtcaccctgagctccaggcagaagaccaactgtgccaggcccatctgcaccaggcacacacaaggcccacccatcaggctcctggctgcagccacttccccatcaaattgggctccaggagcttaagcaacagcaggtgagacaaggctgcccaggttgactctgagcacttctatgcatctgccttaggctacagacacaggagttcaggccaggctggccaaacaccagagtctttctcttctttttttctttttttgagacaagtcttgttctgccactcaggctagaggcctgatcacagctcattgcagcctagaattcttgggctcaagggatcttcctgcctcagcctc

SEQ ID NO: 176405 - DNA, 131 bp, Homo sapiens
tgttgaaatcctaaccaccaatgtgatggtattaggggtggggcctctgcaaggtgattaggtcatgaggggtggcgcccccactgggattagtgcccttatacaagagctcccagggttcctcccctttc

SEQ ID NO: 176406 - DNA, 453 bp, Homo sapiens
actgctaaacactgtgatagatattattacaaatgcccagttaattttgctagaacttgtataaaaatcaggtatacctgtgctgacattaagttcaggcctcaaactatgcaattaccgtgacgttctttatgggaaagccaagttacctccacatattccaaataaagcctgttcctaaacttgggtcatatagtcattcaacaaacttatttgtcctattttaagtctgactatcattttcagaaacacaaatgtgaactagattatgtgaacatgaggttacatcaagtttatataattactttaaatgcaaattactggtatataaataaaaacaaaacaatttaaggtaactatttctgatgttgcacagtatagtgttggatgtatcactacttctgggagtggcgcctgtacacacattctaaatcttatttccacaaacaagaa

SEQ ID NO: 176407 - DNA, 644 bp, Homo sapiens
gatgaaataagattgactatgtgttgacaaattgtttaagctgggtagttcccactacttttgtatgtatgaatgaaaatttctctattttgtttaaacattaagtatgctagctgaagatttccccccaaaataggaaagctttaaaaaaaaaatatcaagactctgggcaagtcaatttgagcattaaagaatttgctggttgggcaaagtggctcacacctgtaattccagtactttgggaagccgaggcggacagatcacttaagccatgagttcaagacaagcctgggcaaaaaaggcgaaactcagtctctacaaaaaaacacaaaaattagccgagcatggtggcacgtgcctgtagtctcagctactcaggaggctgagtacaggctcaggccaacatgcccagctaatttttaaaaattttttgtagggacaggagtctcactatgttagccaggctggtctcaaactcctgtcttcaagtgatcctcctgcttcagcctcccaaagtgctgggattacaggtatgtgccagcatacctgacctatgcataatatttttttaaaactctgaggaacctttataacctaaggtctgccctaatcacatttcagaatacaacaaaatacagtaaacc

SEQ ID NO: 176408 - DNA, 283 bp, Homo sapiens
tctagtaaattaatcaaaccaaagagggggtcctgggaaacccaacttgaagtccaactggaagttgattagaagttctggaggcccagacttgtaactgctgtgggggaatagccttgtggtactaagccctcaacctgtgggatctgacacaatccccaagtagatagtgccagaattacagggcacccataggaattgattgtttgcttgttgctggggaaaaatacatatttggtcacagaaatcttctgtgttgatgattgttgttgcggtgtgagag

SEQ ID NO: 176409 - DNA, 220 bp, Homo sapiens
tttgagacaacatggatgaacctgaaggacattatgctaagagaaagaagccattcaagaagggtaaatagtttattattacacttatgtgaggtatctataatagtcaaactcatagaagcagagaatataacagtggttgtcaggggcaagttaagagaggtgaggagttgttcaatggttataaagtttcaattatgctacatgaatgaattctaga

SEQ ID NO: 176410 - DNA, 754 bp, Homo sapiens
cgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtctgtgtcgttcaagactgtgcaacactaaacgagaaatggacagccctttgaacggagaatagagtacatggaagctcgggtgacaaaaggtgagacactcacctagaacagtgccgtgctgctgctgggaagtggctttacacaacacaggccacatgggaaagggccccagcagccttcagctccttcctttctccttaaaggagcaacaggggcttattctggttttcttttttcaaaaggtgtggccttgggggctctgccatctggggtgtgggtggtatgtgggaacgaagttcagaggaaccgtggaaacgacgttaggcattttaccttttccagtaacatttttatacatctactgtgtcaatgttatttcgagacattcacagccaaaaagcctgggactctttgtgaaggtcctcctcaactctatctttctttctctctctctcaaaatttccttaaagttctcatgtgcctttgaatggttctgtgaacagtcttggtctcttccccaccttgtggtggaaagtgcggggcagtcctggtcaagacactcatgcctggaatgtggtgcagaaatgtgtggctaccacagttctgg

SEQ ID NO: 176411 - DNA, 558 bp, Homo sapiens
gccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaatggtagagctaagtgtacagtatggacagaatgaggagggaatgggatgccaacttataagcttctgcgccagggcgcataaagagggagcgacctgggagatgctgaactgttgagaacgtgagtttgtggacgcgagatgtggagaagcaaga

SEQ ID NO: 176412 - DNA, 455 bp, Homo sapiens
ttaatcttaccatatatattacaagtttatattttaaaaataaaggaaaagaaatgcactaatacaatgctagtagtcctgtaagccacttctacaacaacaagcaaaattagaaatgcaagcacactttggcccagcagaaattttgcaggtcaggtatgtgaggggtattcattgcagccctgtgatattctgtaatggttaatcacacacacaggagctcttcatgtactgatatggaaagatcagtatacatctttccaaactatactttacattaaataaataaaagggcagatatgtatgtagatataacttgagaagaagaaaaatatgtttttatggatctgtgtatgaatttttttaatttttgggaagaataaacaagcaatgaaaatcactcactaccagaagggaactgggagttaggcaggtgtgggagaggaaagtaagac

SEQ ID NO: 176413 - DNA, 426 bp, Homo sapiens
gggacctccccactctctcatgctccctttcctgtcatgtcacatgcctgctctcccttcatcttctgccatgagtggaagcttcctgaggcctcaccagaagcagatgctggcactatgcttcttgtacaacctggagaaccatgagctaaataaaccttttttctttataaattacctagccttagatactcctttatagcaacacaaaatggactaacacatgattcatgaacattaaatgtcttttcagttatttatatttcccttaatttatttcaatgatggtttttagtctgcagtgtacatattttatgcttatgttaaatttattcttatgtattttactcagatactattgtaaatttgaatttttaaaaattacattttctgattactcacgggtagtatatagcgatggttggt

SEQ ID NO: 176414 - DNA, 639 bp, Homo sapiens
gtcatctttgattccctggtcacatttcatgcacacattttctgtctttctttttctttttttagtgtcaagatgatggggatgcagaagaaggaaagtagagaggattataagtttaggagaaaataaaacatacaatctccacctaaatgtcctggctgttatgacttaggagtgactactggtacagaggaaatagttctggttttcttaggactgttggatcatatcggactcttaggagattctcaggctgcactaaccgtattcacgtttctttctcttcagtctgtcaattgaaggcttctcattattatcactcttaacgttaaaggcattgtatttcataccccttttatgtttaaaaagcctacatatcacctcaaatgatggcaggtgaactggtgaaatctgaactagctttggctttgttattgccctatagttatgcaagcactgggggaagcttcggaaagggtgcactgggcttcttcttacatttccttgcacttcttatgaatctataattatttcaagccaaaaggttaaaaaaaaagttgaaagactatgtaaaagataaatatgtagagacaaaaaagtctagatcaggagctggcaaacttattctggaaaggggca

SEQ ID NO: 176415 - DNA, 168 bp, Homo sapiens
catctaggcagggaggcaaacctcaacagtgcatttctacttagcatagcagctggtcccatccatcccaagcagtgattctgcctaacctgaagacccagcctacagccctgtccaaatacaaacttcaaacagtggtgctacctggccatggaatacaccttgtgg

SEQ ID NO: 176416 - DNA, 691 bp, Homo sapiens
tgggaggcctactgatctaattaaagagtacactaaggaaatattaccacacaaatactggcttcacttctaaaggatcatcatgagaaacaccaccacaaaggaaaataaatgaaaaaggaaaaggttaaagaaaaaggatactgaaatctaagaatttcacagtcatctgtttttatgattcctgaagtgctaagagccgcctatctgctcccagatgcactactgtttatctttcacgggattgcttcttacaggggaagtgttcctcgcaggtcagtttactcgcttcttggaccgacaaatcaattgttccacaagcctaacattcgcggatggaacactgccgaaccacaattccaggttacattatttatatcctgaaaataaacagcccaccagtctatgggagactacatctagcaccaccaccagagaaggtcagaccacattaggctcgagatggctggctaattcctaagccactcagaataatatcaggcttattgctctgtcatggtggaggctataccagtgaagtccccatagcacctaactgttccagtcccaagataaatacctagtatacttgtataccattttaataaaatttaaatgaaactaagtatttggacctttgcagtagctgggtctctgaagagtaaagacttgtccattcaggtgcccaagt

SEQ ID NO: 176417 - DNA, 441 bp, Homo sapiens
tggctaggccccccttctcctttcattcccttcttccttccttcttgggattcagaattgctctctgggcagagggctgcggagcaggagcgaggctgcaggtgtgagaaggaccccgccgtgccagggcagcctcaaggagctgttgagcgagttgagcccagaagacaaaggtcgctgaagtccttccaggagaagaagatcaatgcctgggctgagcctgcggttaacatcttaatagtaaccggagagtttctgagagattaggctcacatacctctcagagtccaggaggcagtgagggaaagcttttaattcaaagccctatccatcttcccaactcaggcccttctgccccctttgtcagtgtgcccttgtgggaagccggtgcgtttccaggggagctgctggaggcttcttatggcatgcagatcaaggaag

SEQ ID NO: 176418 - DNA, 212 bp, Homo sapiens
tggccaggctggtcaagtgatccgcctgccttggcctcccaaagtgctgggattataggggtgagccaccacgcctggctatttacatatttttaaactagagccccttaacatattacaattttcatgtatggaatctctaatgtattcacccctgccagtctagatagtaacacaaattgctgtctagttcttgtgtcccagaatgatgg

SEQ ID NO: 176419 - DNA, 260 bp, Homo sapiens
tatgcctcagatctgatcttgagtatccccgactgcttagccacagaagagcagggaccaccgggaagcgtgacctgcccttgcgcctttctgcctcactgctgaaggccgcacatcagcaccctgaccacccacctcctcaggagctcagcaggacacgcccatcacgaccaccaaaccctgactctccgtaggcttcacacacacgtgtgtccccgcctgtgagctcggcggtgtggtgctgaccaagcactggcttc

SEQ ID NO: 176420 - DNA, 108 bp, Homo sapiens
ctgtgggcaagtggcactaaccccattgcattcgtgtcatcactgaagatggtacaaagtgcctcgggaacgccaggcgccgagccatggcctctgcatgggaatggg

SEQ ID NO: 176421 - DNA, 416 bp, Homo sapiens
gtagcactgttccattagttgtttttttaccccatgtctcgtgatcacactattttaatttaccattcctgtatggtaaatcttggtatttggtaagattaatcagctttagtgttcttcaaaattatttggctcttcttgctattccttcccatgtcaatttcaaatcagattggcaaatattgtaaaaagaacatgctacttgggattttgattgggactgtattgaacttaatggattaattttgggggactttctattcaatcacagaaattacagaatagaaactatagaacagaaattcctgttttcccatccaaaagcataacactgatctccatttatttagatcctatatctttcaacaaagttgtattatttttttccataaaggtcttatgtatcttctgttgga

SEQ ID NO: 176422 - DNA, 305 bp, Homo sapiens
catattttaccgtgtgttttttaactgtgaagatcagcaataaaccccttaaaataagatcagccacattaataatttgttgaatagcaaacaccagtgagtgcgaaggagtagtgatgcctttcaaaaggaaagggaaacagggaagagaaagagacagcctgagaaatggtcccaaggccagaccaggccagaattcatctgaatggccccaattccaacccactccattcctcctggcccctaatttatgagccaatcaccaatcatccaaactagagatccttttcctggcttgttctcca

SEQ ID NO: 176423 - DNA, 179 bp, Homo sapiens
acatttgtagacatttctctcgcacaaatgacaacttatatttacacaaaagcctgtatataaaatgtgcataacagctttattcataatagtcaaaacttgtaaacaactgtatgtctcacaatgggtgaaaaattaagtaaattctgttataggcatacagtggattactactcagc

SEQ ID NO: 176424 - DNA, 320 bp, Homo sapiens
aggaaaccaacgaagcctctgtgggcttgtcctggggccctcgccccgggaccattcagtggccagacccggaggctgctccacggagaggctgttgagacagaggtgcgccagaggagtccaggtatgggagcctcagtctgaggaccaggtgagatgaaggagacgaccccagccacagccaccatctgaccactgctgaacaagagcagccctgctgagcccagtcaccccagacctgggaacaacatgcaaggtcattactatttgaatttgaagtcctgccttagggtggcttgactgcagcattagacaaccca

SEQ ID NO: 176425 - DNA, 532 bp, Homo sapiens
aatcaactctttccctaaaaactgtggtttcagagatctggactgtagttttattaagatgttcatatatgttactcttctccacagttctcaatgctataggtagttaccagtagaaacaaatttgttccaggcaattagtgcatctccttggaacaaaatgcaacagttttcttcccaaacacacgagtccacttttaactgtggcttagctctttcgtaccattcccaattcttcaccaggagactaaaacaatcattacaatgaaccaaaagctagagattctaaaagtagtagaattatttgacagtgactgaatgatgcagctacagttatttacacgtaaacattatctcagtgaggttctacaacatatctctatgatgtcccttactaagagttgaagaagtgtttttataaatgaaagcatcgtgcaaatgtcaagtagtaggtattattgttaaaataattccacaaaaattgcttcatctgcctggtactaattgaaattttgtttatatatccatactt

SEQ ID NO: 176426 - DNA, 217 bp, Homo sapiens
ctagattactgatgttctttctccagacgttctgatctgccctcttggaggactgcacagtccttcatccctcccctcctttccacgatcatgcctgtgcagaagccactgttcccaaagagtatgacacttctccttggcatgttggggaggagtaaaagttagggccactgtaagtgagcactgagagccagggctcctctgtgtgtctgtgaaa

SEQ ID NO: 176427 - DNA, 641 bp, Homo sapiens
tcttccatttataattgtcataaatattacatctatatattcaaaaccctaccagataagattttaatctttgtttcagtaatcttacatattttaaagaactgaagagggggaaagtggtcttttgtattcccagccatttaccatgttcagtgctcctttatccccagagctccaggtttccctctggtagatttttcttcagcattaggaacctccttttgcatttcttttagagcagagctgctagcaataaatactgttttccttcatctgcgagtaccttttttttttctctcattcctgaaggatatttttgctggatgtaaaattctgggttgacatgtcttctagcactttagagatagtatttcatgttcttctgtcccctgtggtttctgatgaggaatccatgttcattccaattactgtttccatatttgtaatgtgttgtttttctctagctgttttcaagacacctgcttatctttagttttctgtaggttgattattgtgtgtctggacttggtttctttgattctatcctgtgtggggttctctgatcttcttgactgtaaatttatgggtatattgttatggtttcgtttatcaaatttgagaacttttggccttttttcttc

SEQ ID NO: 176428 - DNA, 472 bp, Homo sapiens
tgcaatgcctctcctaggtcctcttctgcattctctcaccacgaacctcacccaggccagtctttcatgactgctctgctaagcccacaggggttctaaattttttgactattcgtaaccaaggcaacccataaatatagcacaaaccgattcttgattcctgagacagtttttgtagattgctactcagtttccatctttccttttggtcctggttgtggcggtccctgggacggcccacacacttggtgatttgccagaagggctcatgggacccagtggagtctgcagcattctgttacagccatcaggggcttcctccttccctcgagggcgctcacagagcatgctccttccccagccgagagaaacacatgtgcaatatgtctgcccagggataccccttagagactcagaacccaaggtttttactgagggctggtcacataggcaatccctactgagcaacttt

SEQ ID NO: 176429 - DNA, 307 bp, Homo sapiens
gaggctgcagtgagccgagatcaagccacatgccctgtcaggtaggctcaggaacacatgggcccaggttggaagagcaccatttatataaaacactctaatgaatagtcgcatatttgtctagttatttcatcaggataaattcccgctcataagaatgataggtttaaaagtatgcacattttgacagtgatgccaatattcccaaattgtgattgttgacaatcccggagagtcagtgacattgtttcccataccctgacttcattgggatagtcttttttcattttacacctgcttgaattcc

SEQ ID NO: 176430 - DNA, 465 bp, Homo sapiens
aaagcctagctccttccttccctgtggagctgtcaggaatcaactcgaggaggctcgggtcctggcaatgtccatcccgaggaacatggccggcccaaggaggagtggcatagactccctgttgtgcttgccacttagagctcacactggcttgcctcatagttttctctctaggataaaatacctggttcggggctgacatgggcaggagagaaagcacgctggctggttgcctccactagtgtggagtggcatttgctgacatcctttgaccttattatcttttgttctcctgaccaggcacccattcacttccagctgcagacacttattgattccggaatcttgatgaaatggttatttctcttatgtcttcaagggtaccttacccttgctgtatcctgtaacaaagaagcacaggagatttctgcaggttaatctgtcaataactgcctaacctttaca

SEQ ID NO: 176431 - DNA, 333 bp, Homo sapiens
  misc_feature (190)..(190): n is a, c, g, or t
  misc_feature (195)..(196): n is a, c, g, or t
  misc_feature (237)..(237): n is a, c, g, or t
tttatgggtaggcatctaacaagaaaatagaatggggtggggaaggtttgaagagaaaatgaggagttttgagaagtatctgtgggacatctaagtaaaagtgtctaaaggacagttgaataaaccatataaataagaatataggtgttcatcttccagatgtacttacgagcatgtgcaaagacaccangatgnntggtagcagtatgtggtaataacaaataacaggaaaagccnttaaagtgttcattacgtagagctgtggaaaagaatgaagtgtcctgatgcagaattatcctcaggttagattttttaagtgagtggggcatttgg

SEQ ID NO: 176432 - DNA, 411 bp, Homo sapiens
tgtcttcgagggaagtgagcagtggctcttccaaggacacagagatgtcaggcacctctctcatgcatgcaagtgctacatattatgtccacagtatctggagtatttaaaccaggaataacacgtagtctttattattggaagaaataaattaggtcagagttagtatgccatcgtgtgatgccagtttgtattctttattttctgtacttgcttctagagggggagtaaatactatgagataatgaagaaagacatgtttttgtgacttttctgatttaggacactttatgttatggaggttattttgaaggatttggaatttggttgcttattgagaacctcttgagaaaatcagattatctctgatgcacaaccagtcctacattgagttttttccatttattgctg

SEQ ID NO: 176433 - DNA, 368 bp, Homo sapiens
aggacatgattacgaactttagctcgcacgctgaataggcactgttaatctatgatcttagatgaagtacatcgatgtatatggatgttagtatctacaatatggtcctctcatcaagcgtgtagctgtctctattccgtgatcgttgtgctcccttctcccttgtttgtaaaattttcatctccaataacaactcgcctctaattccactcagagagtagtcctgaaaccaccagctcaattgtccccagtgacctctaactgccaaaggatactcctcaagggcttgccttgatttccttgtaggactttacactatggtcttcccttctttttaaaaattattttcttctttggctttccctacg

SEQ ID NO: 176434 - DNA, 107 bp, Homo sapiens
aaaatcttcttgaccttgacctaaactgataagttataatgatctatttatttatccaagctggactttacaggaatgagaaaaagaaggtctttaaataattgcct

SEQ ID NO: 176435 - DNA, 294 bp, Homo sapiens
ccttggcctcccgaagtgctgggattacaggtgtgagccaccacgcctggccttttatgacattttgatctaacaaccaatgctccatcagcccagagaggtcaggtccatgagtgcaccgtccaccccagggcagcacaggtgacggttgtgccaactgtgtcccggagcatagccagccatctttccagcctcagtgtcggcttctttcctgtccacccattaagcaactgtcccatgttttagatttggagttatggcagaaccccacttctggtactacttttgttgttg

SEQ ID NO: 176436 - DNA, 701 bp, Homo sapiens
aaagtatggaaaacttttcatttagaaaagtatttgttcctgtattttagaattcagttttgcgtctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcagg

SEQ ID NO: 176437 - DNA, 522 bp, Homo sapiens
ccaggacacagacagaaataacaagagcaggacgtgtctccctcccactgtcttgcctggtgttgcacgtgggcacgcatgtcaggtcggctgcggcctgctcccgtgcagtgtctggaggagtggtctctggacacggcccaccatgggttacagcagcccctctccagagccacctccctggagctggcttcagtggtcttctctggtgtgccacttttctgattggcgtgattgggctcaacacaccgaaggaccgaaaaggattaaagggacagcctcttctgcctgttaaccatcatccagggacagcctcttctgcgtgttaaacatcatccagggacagcctcttctgcgcattaaccatcatccagggacagcctcttctgcgcgttaaccatcttccagggacagcctcttctgcacgttaaccatcttccagggacagcctcttctgcgtgttaaccatcatccagggacagcctcttctgcacgttaaccatcttccagggacagcctctt

SEQ ID NO: 176438 - DNA, 483 bp, Homo sapiens
catgcctttagccccagctactcaggagactgaggtggggggatcactgtagcccaggagttcaaggctgcagtcagccatgatcgcaccactgcacaccagcttgggcaacaagagacactgtctcttaaaaacaaacgaacaaacaaaacaaaaaaacctcataaaacatataacccaaagatattaaggtcaaatgtagtggctcacgcctgtaatcctaacactttgagaggctaaggcaggaggatctcttgagcccaggagttcaagaccagcctgggcaacatagtagtcatctctactaaaaataaaaataaaattagctgggcgtggtgattgcatacctgtagtcccatctactcaagaggctgaggtgggaggatcgcttgagcccaggaggtcaaggctgcagtgagttgtgatcatgccactgcactccagcctgggcaacaaagcaagaccccatctcaaaaaaaaaaa

SEQ ID NO: 176439 - DNA, 423 bp, Homo sapiens
gcccccataagcagttaagggtaagaatttggagctcaagagtaagctcaaaatataatctgggaatcataaggacataaaagacaattgaaactgtgaaaatggctttgtgtaagagagttgattgaattctggcactctgaagaaagaaaaaaagaaaaattaaaatattaaaaagaacaaacaaaaaaagagttgaactgagctttagaaaagactaggactttaattgaactagaagacgtataggtagaagctgaagaaaagagcaagtcaaagaaagctatgaagttaggagtaaatggatactgtcagtggtgtgctggtaaatgcttaacaactggctctctagggaggtgaaaggaagccctgatttatagtgtttgctgaattccatggtgtaaatactcccatcacagtcaa

SEQ ID NO: 176440 - DNA, 437 bp, Homo sapiens
atgtcagtgttctttctcttgtaccttactcactctctccttctcaaagagctacatttaaaaaaaattagttatctcactggatggtcacacctatctggagagttaggccagggttagttatctttccaggaaacatacagggaggctgaggcccaagaggaccattaacttgtccaaggtcaaacagtgggtaagtgggatgattatccactggattctcacatagatgtgaatccaggcatctgacccctcacctccccacagtgtgatgccattccccccttcttcaggtggaattcatgtgtgcccatctcagccttctttgccatggggccttggccaggaatcttgggcaagaatcccacagtcacccctcactcaaggcaagagcccttccccacctcactggccatggcaacctccgatcccctgga

SEQ ID NO: 176441 - DNA, 539 bp, Homo sapiens
gggctggctttagctcagcggttacttcgagtacattgtaaccacctctctgggtggttcgagacccgcgggtgctttccagctctgttactgctgaagttcagctccttttccatggggaaccatggagaaatggctgattttagcactgggcaggaaatacagagatggacagggtgcatctcacagtgctagaaagtaaggaagtgcttgaaaaccaaaaacaggccgggcgcggtggctcatgcctgtaatcccagcactttgggaggccgaggcgggcggatcacgaggtcaggaaatcaagaccatcctcgctaacccggtgaaaccccgtctctactaaaaatacaaaaaaattagccgggtgtggtggcgggcgcctgtagccccagctactcgggaggctgaggcaggagaatggcgtgagccattcgggaggtggagcttgctgtgagccgagatcgcgccactgcactccagcctgggcgacagagcaagactccgtatcacaaaaaaaaaaaaaaaaaaaaaaaaaa

SEQ ID NO: 176442 - DNA, 806 bp, Homo sapiens
acagaaaaactcatttcagttaaggggaaaaaaagagtaagtgagccaggattacagtccaactccagtcaaagttagtataagaaataagagaataaatagatcaacatcctcacagacaatgaaagcacaccggaaggacatgaccacaagacagataaaaacctaatatttgccaaaaaataaaatgcaaatatgacaggaaatttatattaattagtacagttatcaataaaagtaggaaaaggggaaaattaaccaagtaccaaacacttggagtaaaaagcaaaataaagcagaaggaaggaattaataaaagcaaaaaagaattactagtagaaaaccaaaacaatagaggcaataataaatccaagttggtgatgggtagtgcggggagttgagtcagataaactaccagctaacctatttaagaaaaaaaggaggaagcacaaatacaaaaatttaaatgacaagggggaaatagtaaaacaggaaatttgtttaaattgactattttgagcaattttacacaataaattcaaaaactattttgagaaaaatgcaaattgccaaaatttactctaggtagataaagtcacaacaaaccaattaccgtagaagaaacaaatagttaaaagtaccccttaccaaaagaagcatcaagcccagattgtttcaaggggatttctaccaaaccttttaagattaaataatcccattcttgcttaaacaattgcagagactaggaaaagaatcttgaacctcaagtgccaaaaaaagaaaaaaaacaaataaagaaaaactcc

SEQ ID NO: 176443 - DNA, 414 bp, Homo sapiens
tggtgaatggccaggactagggccagatgccctgattccctatgcaactttccttccccctaccctggcccctcccatcaccactgcctctcccaccactcagcacctttgcagccctgctgggtcccattgcctccaaaacccttcttcatggtaacttctgctgtctggggctttattttctgatcattcgttgtgactcttcttcttaaaccatcatttgactctttcatatatatctgtctagcgaaaaatatacatgtatatatatttgcaaccctcttaggatatagtatagcaacaggcccataatgagcactgaatatttactgacaggatgagggaataaatgaattgctcttgatgtttgcagagagcactccctaacagttctctcataatttttcttctcca

SEQ ID NO: 176444 - DNA, 2264 bp, Homo sapiens
  misc_feature (1893)..(1893): n is a, c, g, or t
acacccagcaggcagagaaggcagcagcaggcaggaccgccaccctcccatgcaaatcacccccgggagtgcagctgggctcctcccgctcctcctaggcaatgctcctggggagtctgtggggaagatgccatccagggtgctgtgcgctcttcctcatcctcgccctcctgctggacgcggtcggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagcttccacctagcaagccacgccgggaccaggtgagtgcacacaagacctacctggcagggtggccagagaggcttggacaagcaggggcaagaccaggcctcctgaggctgcataagcaaatagccagacactgcaccctgactggggatcctgtggccctggcctcaggtcctgctggggtggccagccaagaggacgtggggcaggtgttttctcctccgggcccttttcctcgcagaggctggaaagagagtctcaacagccccttccacccctgatataccacgaatgatcctggcttctgggcacaatgggaagttatccctttacctcggaacttggggacaaaaagaccccatctgcattctctgttgggaagaatctctgctggggagaaaagtctttagcacaggagaggacggaaagttccccaatgactcttgtgcccttgcatacatgaaggggtgtgaactgggccacggtaaaagcaaacagagcagaaccacccagaacggcccctctcgttcacttcctccctgcacctgcccagatgggatacaagaagcggggtagggactactcgcctccatgcccactcagtgcacacacctcctctctctgcagtattcccaccccaccctcactcacactcacacgcagccaacacatgtgcccagccagtctccaaggcccagaagtcaagacagtttggcttcatggatttcatccgctgagttgcatgtcacagctcagtctatcgcgtgcaaccaaagaggcagagagttgtaagattttttcacatcaagacagagtcccagagatagagtggtctggtccttacaaccctgaattagagatggacagctgtctccaggggactgaagtcagagccacggtccattgggcagccataccctcctccccaggtgggcccaacctgcacgcaggtgtatccaggcactcccgtttcttactcccttaccagaagtaagagcaaaggtcgttgctgagttgaaagaaggaaataataattgtgtcttttgtgggggattacacctgactctcagaactcagagaaaagagaagcaaaatgaagaggtctcagtagagtaaggtaagcccatacctaggaaatgatgtagaaagagatgagaagtcagtcccactctgatcttcagcacttgttagctgggtgtttttggccaggttgcacactctgagcctcaggattctcatctgtaagatgaagagaatatttctggcccttattgctgcaaggatcgaaaagagataaggcagggaaaggctgtacaattgatgtggttcttacaccagatgtcaagcatacaaaacacataatctgggatgagttaactgacccaaagtccaaatgtgaagtaccttggtgtctctcaaattggtagtgatgggggtcaactcacactttgcatcaggaaacttcngagcaaaaagggtccctgatttgtgtgctggtatgttggaatgtgtcaggcactgtgcaagacactggggataagaaatgagacacatggaccaggcacagtgactcatgcctgtaatcccagcactttgggaggccgaggcgggcagatcacttgaggtcaggagttcaagaccagccttggcaacatggtgaaaccccatctccaccaaaaatacaaaaaattagccacgcatggtgatgcacacctgtaatcccagctattcaggaggttgaggcagaaggattgctggagcccaggaggcacaggctgcagtgagcagagattgcaccactgcattccaacctgggcggcagagtgagacctgtctc

SEQ ID NO: 176445 - DNA, 414 bp, Homo sapiens
attcggcgcggcatgctgtgtgtctctctctctctttctgtttctctctccctctcctctctctctccctctcctctctctctccctctcctctctctccctccccccccagcatcatgcggggtgggactgttttatcttaagttacaggtggtcaagtccagcccaaggacagcaactctgagggtcaagcctcataggctaactggatagatgttctctgctttgccacccactggagcccgacctgccccactaatttatatttcccctggtctcattttgtactttttatttataattcacccttaaagtgtatgtgtctcttataagctgcctccgatctttcatggtatgaggtggttacctaaataaagaaggagatttggcctttgtttttatgtaaaggacaga

SEQ ID NO: 176446 - DNA, 1162 bp, Homo sapiens
ctagagagcaacatgatcaagctttgcctgtagaagagtaactgagcatcgtgtgcagaatggatgagagagaagcagcagagagacagcaaggccattcagcaagctcaggtggcaggtcccatctgatggaggagaatcaattcaaggagatgcccttcctttacagaacaccctttaacagcatccaggaggaacgagaggctgcaatactgaggctttcaaagtactcacgaggatgtccgagaatggctgtgatgccaggcttctggcaggttccagactccatcacaagcccagcatccctgcaccagatctgacatcgctgctgttgtgccagctgtttatgaagggcctgagtagctagcaggtttttatcaggagccctgctgggggcttagacaccaaaagagaagtctcatcctctgtagttcttcttgtgaatgtccttttagaaaaacaattagaaccaaccacaagcaccaaagtcctaatgggatctcctgcgagcacatatcaagcaggattgttgctatttctcctcactggctctttggacagactgtgtgagctcctggagggttccactgtatctaccctttgacactgaccagttggcacatggtgacatattccaatgtgttgattgcaaatgtgaacgtacagccagtgctgtgtgcgggaggactctctcctcctcagtggggccacaccgtgcactattaatggagccccactcctttgcacagcctggccatgcagtggctcatattgaggttttagccaactgaaatctcccgtgcatttttctgacaagccagctaggcctctgctatgctgtccttgtgtctttcatttgatgaccttaagggtgggactgttttatcttaagttacaggtggtcaagtccagcccaaggacagcaactctgagggtcaagcctcataggctaactggatagatgttctctgctttgccacccactggagcccgacctgccccactaatttatatttcccctggtctcattttgtactttttatttataattcacccttaaagtgtatgtgtctcttataagctgcctccgatctttcatggtatgaggtggttacctaaataaagaaggagatttggcctttgtttttatgtaaaggacaga

SEQ ID NO: 176447 - DNA, 1503 bp, Homo sapiens
acacccagcaggcagagaaggcagcagcaggcaggaccgccaccctcccatgcaaatcacccccgggagtgcagctgggctcctcccgctcctcctaggcaatgctcctggggagtctgtggggaagatgccatccagggtgctgtgcgctcttcctcatcctcgccctcctgctggacgcggtcggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagcttccacctagcaagccacgccgggaccaggtcccatctgatggaggagaatcaattcaaggagatgcccttcctttacagaacaccctttaacagcatccaggaggaacgagaggctgcaatactgaggctttcaaagtactcacgaggatgtccgagaatggctgtgatgccaggcttctggcaggttccagactccatcacaagcccagcatccctgcaccagatctgacatcgctgctgttgtgccagctgtttatgaagggcctgagtagctagcaggtttttatcaggagccctgctgggggcttagacaccaaaagagaagtctcatcctctgtagttcttcttgtgaatgtccttttagaaaaacaattagaaccaaccacaagcaccaaagtcctaatgggatctcctgcgagcacatatcaagcaggattgttgctatttctcctcactggctctttggacagactgtgtgagctcctggagggttccactgtatctaccctttgacactgaccagttggcacatggtgacatattccaatgtgttgattgcaaatgtgaacgtacagccagtgctgtgtgcgggaggactctctcctcctcagtggggccacaccgtgcactattaatggagccccactcctttgcacagcctggccatgcagtggctcatattgaggttttagccaactgaaatctcccgtgcatttttctgacaagccagctaggcctctgctatgctgtccttgtgtctttcatttgatgaccttaagggtgggactgttttatcttaagttacaggtggtcaagtccagcccaaggacagcaactctgagggtcaagcctcataggctaactggatagatgttctctgctttgccacccactggagcccgacctgccccactaatttatatttcccctggtctcattttgtactttttatttataattcacccttaaagtgtatgtgtctcttataagctgcctccgatctttcatggtatgaggtggttacctaaataaagaaggagatttggcctttgtttttatgtaaaggacaga

SEQ ID NO: 176448 - DNA, 368 bp, Homo sapiens
taaaaggtgtattaacatcttaaaatgaggatctagctgggcgcggtggctcatgcctgttatcctacttctttgggaggccgaggtggcaggattgcttgaggccaagagttcaagaccaaccaggctaacatagcaagaacctgtctctttaaaaaaataaataaataaaaaataaaaaataagaatgtgaatgggtatttctggaggtacggttggtctctggaccacttgactagaagtgcctaggatgctttttgcacattcatactcataggccctaaatcagacttaacaagtcttctgttgagcatcattaggaaccctaaagttgcagaaacactgccttgcatcctagggtcatagaa

SEQ ID NO: 176449 - DNA, 158 bp, Homo sapiens
aagaatctaaaacaagttttactattttaaaataatgagagtgcttttctttcaagctttcatggtaattcaccaggaagagtaaacttcatgactcagctttttgtgcccactcacacatgcctaaaaggtccactgaaattgcttgctatatttta

SEQ ID NO: 176450 - DNA, 181 bp, Homo sapiens
aagcgtttactgccgccgtggtcgcagtcataaattttgctacaaaccacaatgacaggtgcattgatatgcaccgtgagagctccagctgcttaataaccccgtcccctggtcgctgtgagcgccttttatttatttggtatcatattaggtattgatctctagtagcattaagtgcggt

SEQ ID NO: 176451 - DNA, 1478 bp, Homo sapiens
ggcaggtatggaacctatagggggcctgtcacccagcacgtgcatcgggggctgtcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggccacgtcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggggagcgtgcatgttgtccttggtttagactggttatgatttatgccctgaaattggacatattgccaagcaagcgaaattgagattccatcagccaggaagaaggggtaaggatgatgaatattgggtaggcacatgataggggttgtcacaagttttaagatgctttcaattagtaaataactgtcaagattaccttttgttttcacctgcccagtctccattgtgcctccttcagaaacacacactgggttttctttgggtgtgaaggggcctctgtgtccatcattccagtgtgagcacatgatctgagcccggtcagtgaggtttaatttcaggactttggttggaactcttgggaaagacaagttctccctgacctggggtgtttgaaaagataacatgctagcctggaattgttgggggctattttacctgcctacctacctgaatgaatgaatggttgactgaattaagctgacacaaaggggtggtagagggatgaggagaggagaacagagggatggtgagaaacttggtccaaatgaaattgcttgagaccggtatgcagctgtgacagatgattcagttacatgacataataaatctttccctcatcccccaccttatttttttcttttgtatgtaagttagtttgagttgcaaaagattactgacaggaatggtacctagcaatggagtgttacaagtaatagaccctaaaatgtggattggcaaattgcaggtagaatggaaggcaataaagttctcctatccctggctaagaagtt

SEQ ID NO: 176452 - DNA, 645 bp, Homo sapiens
ggcaggtatggaacctatagggggcctgtcacccagcacgtgcatcgggggctgtcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggccacgtcatgctgaacaagagccgagaagtagaatcgccagtgtcaagccgtccacgttgtgggatgcccactgttcccccaggatcactcaagaccctgtgacttgtggtcactgatgagtggaccaagtgaaggattgtggtgaggagcaaatgaatcaacgcatgagcaaaggatggtcgcatctgtgaaaggaaattcaatctcgggaccccaaaatcctacaccaaagagaaaagtcaagctgggaactgcatcaggcaaacctgcctcccatttaattgctaaataagatagctacaaagatttttta

SEQ ID NO: 176453 - DNA, 973 bp, Homo sapiens
ggcaggtatggaacctatagggggcctgtcacccagcacgtgcatcgggggctgtcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggccacgtcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggggagcgtgcatgttgtccttggtttagactggttatgatttatgccctgaaattggacatattgccaagcaagcgaaattgagattccatcagccaggaagaaggggattgtggtgaggagcaaatgaatcaacgcatgagcaaaggatggtcgcatctgtgaaaggaaattcaatctcgggaccccaaaatcctacaccaaagagaaaagtcaagctgggaactgcatcaggcaaacctgcctcccatttaattgctaaataagatagctacaaagatttttta

SEQ ID NO: 176454 - DNA, 784 bp, Homo sapiens
ggcaggtatggaacctatagggggcctgtcacccagcacgtgcatcgggggctgtcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggtgaggatggggcagggggctaggagcttcgacaggcaggaacttccaggcacagggctgtggtaggcccctctcaatggtaaccaggaccgaaatcgggtttcacaacctacttgttttagggtggaaaaacttgaatttccacagccaagtgccacacagttgctgtacccggggccatcccgggagctgtgagataatgagccggtgagactctgctccaccctgggaaggggagttagtctagaggagcatatcttatggggacaagaagtcacaaaaaggctgtgtggtgtgtagagaaggggagggactctgctgttgaggcttcactcttttttagcacttgcccagcacctccttctctcttccagctgcctcttgagtcactgcccagtttagggagcagtaacataaaccaaacagttgcctccaaaatatgcattctgagaag

SEQ ID NO: 176455 - DNA, 1634 bp, Homo sapiens
ggcaggtatggaacctatagggggcctgtcacccagcacgtgcatcgggggctgtcccgggggtcaggggagggaggccagcgggccggcggggtccgccccgaccccatccacgaccccgactcctatccgatcctatccccggccccgctcgggcctttccccttgcgccctggctcggctggctcgacgagcagtaagttcgtagccgccctccgaagccgggcgtgcatgggatggcagagttggcgtgcgtgcgtgagtccaccagtgtggcatgggcatgtaaggtgcgcggagggactgcaccttctccatcaggtgcagaaggtgcgtttttgcaagactgcgcactcacacgaccattgagaggctcactttgcagtggccctcccaggccctccgtggttgggtgtccgtctttgtcagaaaagggccagcagggggcaccaaacccgcacgtttctgccgggagagggcgtctgggccacgtcatgctgaacaagagccgagaagtagaatcgccagtgtcaagccgtccacgttgtgggatgcccactgttcccccaggatcactcaagaccctgtgacttgtggtcactgatgagtggaccaagtgaagtccacaagatggctgctgtggctccaggcatcacgtccacatgcaaatccatccagaggcaggaactgggaataggcttggaggtggccaggacagcaagtgggctgtctgtataaacctcccctccacttgggaaggaaaatcaccccccaagtcgattttctgtccatcttattgatcagagagcgttataaattcacccattaaataatctggacaaggggagcgtgcatgttgtccttggtttagactggttatgatttatgccctgaaattggacatattgccaagcaagcgaaattgagattccatcagccaggaagaaggggtaaggatgatgaatattgggtaggcacatgataggggttgtcacaagttttaagatgctttcaattagtaaataactgtcaagattaccttttgttttcacctgcccagtctccattgtgcctccttcagaaacacacactgggttttctttgggtgtgaaggggcctctgtgtccatcattccagtgtgagcacatgatctgagcccggtcagtgaggtttaatttcaggactttggttggaactcttgggaaagacaagttctccctgacctggggtgtttgaaaagataacatgctagcctggaattgttgggggctattttacctgcctacctacctgaatgaatgaatggttgactgaattaagctgacacaaaggggtggtagagggatgaggagaggagaacagagggatggtgagaaacttggtccaaatgaaattgcttgagaccggtatgcagctgtgacagatgattcagttacatgacataataaatctttccctcatcccccaccttatttttttcttttgtatgtaagttagtttgagttgcaaaagattactgacaggaatggtacctagcaatggagtgttacaagtaatagaccctaaaatgtggattggcaaattgcaggtagaatggaaggcaataaagttctcctatccctggctaagaagtt

SEQ ID NO: 176456 - DNA, 260 bp, Homo sapiens
gatcattgaaggctactatgaccacctttacgcacataaactagaaaacctagaagaaatggataaattcctggaaaaatacaaccctcctagcttaaatcaggaagaattagataccctgaacagaactataacaagcaaagagattgaagtggtaatttaaaagttaccaaccaaaaaagtccaagaccagacgtattcacagcagagttgtaccagacattcagagaagaattggtaccaatccttttgacactatt

SEQ ID NO: 176457 - DNA, 361 bp, Homo sapiens
cttgagccacagagctggctccagaggcattgggaggagaaacgcggcaggcctggctcactcattatatttcaagatctatcccagcttgtcacaacatggactgtgtaactgagacgattcgcggttggtgttcccatgctgaggcatgtgctgccccggcccttggttgctgcgcaatttgctctctatggactgtacctggggtgcctaccctggacttcagacaagcttcttcaagagtagcccctgccagagctggagccaacagcaagagcagcccagggccactctgcccaggctcagaggcatcactgggaaagaggcaggggcagaaggaactggggcgggaagccctgaa

SEQ ID NO: 176458 - DNA, 157 bp, Homo sapiens
cagttcaccaaacacttaacaagtgctgactttgttagaagatgggaatgccctcaaagatttcacccctacgaagggagatgagatgtgagacactgattcacgggtaaaaggaaggcctacagagattgtggaagaaagttcatagcttccttac

SEQ ID NO: 176459 - DNA, 217 bp, Homo sapiens
tctctactgtgttacacttttgcatcctgctagggaaataatgagttgctttccgatgcagtggcagctccgacatcgtcttgaagctaataatgcataaaatcacttttcagagcttacactcataagaataagcctttcaggatgggttatgtcttgtgtccaaacccaagattgggttgcatgttgaactttatgttagtagtctgtcttaacg

SEQ ID NO: 176460 - DNA, 533 bp, Homo sapiens
gtcgcaggctccacacactcacctaattttttattgagacggtctcactatgtggcccaggcggtctggaactccagaactcacgtgatcctcctgcttctgtatagcctttgagttatgaaggcttttgtttgtttgttttcatttttaagtggttgggggaaaagaaaaaagcagaagacgtgaaaacaatacgcgtttgccctccagcatccaggaataatgttgtattggcacagggccgtgcactttcattcacacggcgtctggttgctctttctggctcacagagcctaggcgttcaccctctggccgtgtgtagagactgcccgccaacccctggcctaactgaggaagaacagcgatagtcaaacagcaggcaactggaagaacccaaaatgcaacgacgattcatcttccaaactgaggggtgagcactgctcgaacaggcccacacccgaacacagagactcacggaccacggcagccaccttcagagccgtgaaacgtgcagcaccaacttttaagtttgt

SEQ ID NO: 176461 - DNA, 388 bp, Homo sapiens
acatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgacttcagtctggttccatcatgtgggaattcgatcacaccattttcaaacaatgttaacatagtccagctttggtttttctatttggagaattttatcaaaataataaaacattacgctggacgcaggggctccatcaaaagactttttaaataaaatacggttctcaccttctccttgtccattgactattctgtttcctttttcatgcgaagatccaggtaa

SEQ ID NO: 176462 - DNA, 516 bp, Homo sapiens
cttatggaaaagcctcacaatatctccagtatacacagcctcttctctcgcaactctcttcattagctggtcctaagtgaaatccgggtctcctttaaacatagtgcttctcccacatccctttcaagtgaagatgttttttttcctctcataaaccttgtactatatactagagatgagatatgtgtctttgattctcagtgcttctcccaaatattgttaatcctttaaaaacattatctgaaaatgcctgccagtagattccatactcatcacctacctacctcctaagccctaagtctcacctctcttttcaataaaaaattttagcctccagttcaccatgtttttcctcacccactactcttatcagaatttttgattacttcaatatccacagggacaatccattctatacttgttctctcagtcccttgatctctttcccaatgctcttaaatgctaccccagctcacctcagtcatctactcccagagttataccctagaccatata

SEQ ID NO: 176463 - DNA, 527 bp, Homo sapiens
acaatttacagggactctctcacattctgtcccacatggtcagaggaataagagggtttcaatgaaaacgtgaaggtgcacagaattccttagtgaaaggttttactgaaattcagtttaattcaactgacacttactaaacacttactctgggccttgtgtactgtgctacccttacctagagtgtaattgctaaaggaaacaagtatgaacaaatattagttttttaaagtgccaccatttttccaagccaggcttctttcctttgaatactctcaactggcatgagccattccacagcaatcaacgatacgataacttgacacacccatgccaaaaagtggctgtctttggtcctctgaactagacagatttaggatgcagagagaacatgatgagtctggtttccacgcctggcagagcaggaggtggaggcgagagctatcagaggcgaatgatcctggtttgtagtctcactgcctgaacagtgccaagctggccttctacacaaaagacgaacccggcag

SEQ ID NO: 176464 - DNA, 683 bp, Homo sapiens
cattttattaaatataaaagcctagacagagaattgtctttttcaactttagtgctctaaatgtgctgttccactttcctttttacttgtactgttttggacaaataatttgttgttatttttatcttcttttcctctatacaaaatgtatctcttttctctggctactttaagatttccctgtatccctggttttgagaaattgattatgatgtatcttaatataattttcttcaagtttcttttgcttggggattcattgatcttgggtctgtcagtttatagcatttatcaaatttggaaaaattttgaccattatttcttcaaatatattttttctgccatctattattttgctaactctaaatatatgtatttagtttgctgaaagttgtcacagagctcacttatgctctcctacattcttaagcctttttttctttgtgctttatttcaaataatttctgttgctatgttttcaggctcactcgtcttttcgcctataatgtctcatctcccattaatcccatccagaaaaatgttcacctcagacattgtagttttcatctgtagaagttcaatttggattccacatctctacttaacatttttaatctttcctccaactttagggacataaggaataccttataataactactttcatcttccagtctgttaat

SEQ ID NO: 176465 - DNA, 792 bp, Homo sapiens
atttaatctgtcaatttaatttttaatataatgattgctttttatttctcaaaattttacttggctttttatctacctattttaatctacttaattgtaagagtgtcttatttctttgggttttattttttgtacttttaatccttttaaaaattattattttctcatctgccagaatgttatgttatctggaattttaggaactctaaatgtggtattgctttgtcttctttttctactggtggatttttttcttcctaaagttttttaaatggggtttgtgggatcacacagcacacacaggtctgaggctaaaacaacttctgtgagattttaactatgggaatccagtgaaaaatttttaaaatttttttttcaaaaatgtgtttacttctgcttccaaaatgtactcttttagatttatcacttggctgagatcaattttttttaattgaccaggttaggggagttcctgatgtttagaaagcatcagtttgtactctaaatccataaggcccatacttatgaattctcagagtagaattttcatgcttctacctgaagcctagccaggaagagagcaatctccttgtcttcaccctgtgctgaatttttctggcttacccttttgttgtgtgtgtagtcctcataagtcccagcgttatgtatgttaggggttaggagcttgttcagttccagccttctgttaccaaaacaccaggggcttggtttaggtcctgctgcttgccacacagatagccaatgcctgagacaacgagtattgccaaggaa

SEQ ID NO: 176466 - DNA, 471 bp, Homo sapiens
taacctactaaaatagaatttaaatgttgtgtgtatgtgctgctctctcctgtgctcctccttgtgacaatctacttttttcatctcagaagtgtcaacaagacaaacatggttaggatctcttaccttagcagggaaagtgcttatatccttttcccatatgaaagggataactttgggactttagtttagaccttgttgctgtttcactgtgttggagacttgcagaagattaggaataccctccactgtgccttgtctagcttccactccacagtcatcaaactgactcatcttctcaatcatttcctcccattagctttccctgtcatcacaatcactcaaagaagctgctccttctgccaccaaaaaaaatgttaatggatagaagggctccccactgccatattctgatcacaacttgttgcctttacttattgacacttgaactctatgccttcctctctcttt

SEQ ID NO: 176467 - DNA, 458 bp, Homo sapiens
catctcctgggccaattactgaactactagtgaggacaatatagtcacaaaattacaaactagctctttgatcatgaaacttataaggctctgatttatgctttacgtgtttattttatcaaactgtaatgctatattttctactactatacaatttaaatacacttccatcaatgcagaaagttctataccttgtaaacacagaattattaggataataaaatggttaaaactaaattaccagaaatgtataattcctagctgtgattaggaagtcagagttttgggtggatggaataaaacttagtgggtttaaactcaagaatttttttctagcaaataatacttgacaggccttgtaagaacaattaagaattacgttctaatcataaattcatagcatatataacataattaacttttcaggtatagtaacatcaattttaaaatttaacact

SEQ ID NO: 176468 - DNA, 169 bp, Homo sapiens
cttgggctataatttttctcttaaaccaagagaaaaataaataaactctgtaatgtttccagttggtataaacagaaatacattaacataaacagaaatctgttcctattgattgagaattgtggggataggggataaacacacagatttctctgttcctgaaaacttg

SEQ ID NO: 176469 - DNA, 622 bp, Homo sapiens
ctacaggcatgcaccaccacacccagccaattaaaaaaaaattttgtggagagagggtctcactatgttgcccaggctggtctcaaactcctggcctcaagcgatcctcccacctcagcgtcccaaagcactgggattatagttgggagccactgtgcccagccataaatgcccttttaagtagcatttacaatggctgcattggatgaaggcataataatttatctaagaacagcagcaatgatgatgaggaggaggaggagaaggaggagggacttttgtgtaggacttgctgtgagccgtgccctatgccaaacccttttacaggaaactcattaggctgtgtgggtgtgggttgtctgcccacctaagtgagacactgaccttcccttagggtgccccaatgtgatttaggggccctccaagttttttgcagttgcccctgggacagatgaggaggatcccagcagagtgaagcctgcaggtaccctaagcctagcagacagaccgggctcacctgggctgcagagcctggagctgccaccttcctgggtgcacctcttccccctctatattccggaaggcctcccggagtttctgaagtggctagaaattactatgt

SEQ ID NO: 176470 - DNA, 118 bp, Homo sapiens
agaccccttcctcaggaaggatggttcaggcttgattcttatgattttctactccaaacaagcaactgtgccataaacaaaaccaatttcttcaactgactatgtccacaactaaaac

SEQ ID NO: 176471 - DNA, 193 bp, Homo sapiens
cccggcccatggaaggtttttgagtaaaggagaaagagattgatgctctagaaagatcagggttaggaggtgagaccagaggccatggagcctccccatctctccccttgccccctgcccactgcccaggcctgaaccaggacccaggttttggagattgggtggagtgagagagtctggcactagaaagcaa

SEQ ID NO: 176472 - DNA, 571 bp, Homo sapiens
tgttcttagttcagtaattgtgttaatcagtttcataggatatctttctgctgtgttttcccctcatgtctgatttaccttgcacccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaagggtaagtatataagttctcacagtgtatttacagaataatcgagtcttttgagatttataaatccttatggatttttaattattcatgatagcatagattaagagtataagccatgacaatttttttttcagtaatttagacttgttttttatttcttaactctttaattccttgcaaatttggaggtgggcaccgtggagtgcatagtgaggtattttctttgaattcaaaatgaagccttgtttatgaatgccttcttcagtgactgaattcctaaatatacgagactcatgcttaaatgccgtattctaccgttttcttattctaaatccca

SEQ ID NO: 176473 - DNA, 221 bp, Homo sapiens
atataatgccaaataaaggacagagtaggtatgctgtgtgacattttttctttgagtatcaatagtgaacatgacaagatattagatcccaaacattgcatagtgtttgttgtagtcactgtaaaatgaacacagatgtactttttcagggatcagtgtcgctcaaggacgtgactgtggacttcacccaggaggagtggtagcatctgggccctattgag

SEQ ID NO: 176474 - DNA, 243 bp, Homo sapiens
  misc_feature (88)..(88): n is a, c, g, or t
cagtcaatgtctttctgggggaatagtgcaaaacagtgatgagacagcccttacaggaattaaggatgtcaaagacagaataactgtnctgggctgtctcatcagtgcagtcaatgtctttctgggggaatagtgcaaaacagtgatatttcatcagcatcccaggcttattctggcatcaaattttcatcagcagtgaccttggcaaacttgtcaatgaatttctgcactgcttcagtaaag

SEQ ID NO: 176475 - DNA, 989 bp, Homo sapiens
atcatgtgactattatatccacccaattaataatccttcttcaatcagcttctgcttcagataacactgcaggcggatgtgtttgggtttgtcttgctgtctgcaagcaactccctgtctgggctttgtctcctagatatccataatgcccaggccagcatctgactgcctctccagttcagcctccccatggtttcaatgaataaggggaaggagacagagaaagtcagacatgaggacagacggaaggatggaaaggcaggaagccttccatgaaagctgctgccagtgatacccactgttcacagggattccaagtatagaatcagaggcatgtttcagaggcttgtttgagctactgatactgttcttttggaacacttgtttgtaaacagatatttctgctaacactgggcttcgtaagggtggacagagtggtgggggggttgaaagtgggggttggagaaaaaggcaggtgtgtcctagagccttggaccatgtgtttgttgttgagaatacaaagacctcactgtattaaatgaaaatgcttgttttacaaggcgagtgggaatatgataggtagatgtcgaaaatgctttggaaactgaaacaaccccatgccacaagggcattctgctacatcatacatccagaggcatacacagaatgtgaaggctcagcatcactaaacaagggctttgggaggctgtgggaaaaaagagtcccagaggctaagtgactagcagctcccttctctggtctcacctaagcctgccctttcccaaagaaaggcttccatttcaaacttcctattgtttttccagtacctgctaacctaagggtagaaactgttattgatctaaaatattactgttgataaaggagcctctggtagtctagatccagactcagagcactaccaggaatatttatatgatagaactatgcaggcagaacactttaacttttcaagtgattgttccccgagt

SEQ ID NO: 176476 - DNA, 350 bp, Homo sapiens
atttaaaaacaaagccaaaaatctcacaagagagggctgaaactattgcgggtaaatctgaatgttgattgatactgtttagaatacatgataaagcagtaacaagaaaatgtttttcgattagtctctgtcttttgttgtcttgaaattcctaccgcattgtgtattttggaagaatcaagattggactttgctcaaagaagttactgatgttggcatgattttaaaactggagatctcatgcacagacttacttagtactttgagtctgttcttgttttttctattaaatggaaatagtatttaacatcaattcattgagataagaaagttaagatcgaaaatatata

SEQ ID NO: 176477 - DNA, 645 bp, Homo sapiens
atggtaatactaactcccacctttacctacaagcatttgttgtggagtacctactctgttacaggacccttgggcttggccaactatattgcctctctagccttggagaaaaagtgtatagttgagtcttttagtgtctgttccatggtgagtagtttgaagagtatcccacagttctgggtccttgccctgcaatgcccctggccattctagagatcactttgtccttgacactgtcagtgagctcagagacctgttagaagtatggtcaccaacttccacctacaatgcaactccaggaaggattaccacaatgctcatcccaattattttgcaaatcccaatgggaggttgcaggtataatgacagagggcaggaaacctcatgtttcttgcagagtgttaggaaaagatttgaaggtgcaggtactgaaaggctgttgaggacaaatgcttattagaatgaagttcattagagatcaaagtcctgcttgatacctcaacgtatccttgatacccttgcttctcttaagccaggccctctgaatcttttcaggtacttggattgagaaattacttctttccttcttagaaaaggctgaagatcccaggcatggtggcatgcgcctgtaatcccagctactcg

SEQ ID NO: 176478 - DNA, 286 bp, Homo sapiens
acactgtgcccaccctggggataggatggctggatgatgatgatttaattctcaagacagcgggtgccaagagggactgcatcaatagcttggtgcatagcttgtagcagacagaagggaggtaatagtcttactcctgttctgaggggagcttggcctggagaaagaggcctatgcaaaccacctgcacccaaaccagctcatttactgaatgtttactgttatgtcaggactttgctaagagtttatgtgaattacccaacctaatcttcatggtagtactcta

SEQ ID NO: 176479 - DNA, 394 bp, Homo sapiens
tactcataatccaaatcctcatttctttcaggtccaactcaaggcctacttcccccacaaagtcccctccctcagcaacccactggaagccactcacatatgatatcctgtggtgctcagacagaacactgcacaccagaaccttggaatctattttgtcttgaacagtcctccaactgttaaatataggtcttataatcccaaatgaccactaaggttcccttagccagacatactctccttctcttcctcctcaaagaggttatacacaaagtacccataaaacccctgcacattaaatactgccttcagcaaggaatgagtaagacaggaatgtgaccaaataggggtagaggcaacaagggtgagctgctagagagccgagttcttggca

SEQ ID NO: 176480 - DNA, 264 bp, Homo sapiens
  misc_feature (1)..(1): n is a, c, g, or t
ntcgactctaagatcagctctaatttcttttgcctgcgggtctacttcacactgctggagttgctttcaggcctagcctgcatggacatcttttcatgtttctcctcttacctgactcaagctggctcaaattctaaccctctgtcacttaagtcatgtctgtctggagagggccttccagagaaccatgattcacatgggccattcaagccagtcccctaggaatagtgggaccagaggggtcttcatgcccccaaccctcct

SEQ ID NO: 176481 - DNA, 591 bp, Homo sapiens
gtaagcggaccagcaggttgattagttcttgaaaagcctaacaaaatggacacatctttagttagagtgaccaagaaaaaagggcagtgactcagattacttcattcaagagtgaaagagggcacatcactaccaatttacagaaataaaaaggattatgaggaaatactacagataattgatgacattaacttagaagaatatatttcaagaaagacacaaactactgaaaccgactcaagaagaaacagaaaatctgaacagacctataaaaaatagagatttaattgatattcagaaagtttcccaaaaagaaaagcactggccaagatgacttcactggtgaattctatcaagtgttcaaagatgaattactgacattcattcacactcctttaagaaatagaagaggagacatcacttttcaaagcatcgagattcctaatcattagtccattgttatcctgctaccaaagccaggtgatgtatcacaaaaaaaccctacagaccagctgggcacaatggcttatgcctatattcccagcactttgggaggccgaggcaggaggattgcctgagcccaggggttta

SEQ ID NO: 176482 - DNA, 328 bp, Homo sapiens
cgatagttcttgaaaaggacagcacctcacggaacagtggtgatggcacttctcaaatatggccaagatgacttcactggtgaattctatcaagtgttcaaagatgaattactgacattcattcacactcctttaagaaatagaagaggagacatcacttttcaaagcatcgagattcctaatcattagtccattgttatcctgctaccaaagccaggtgatgtatcacaaaaaaaccctacagaccagctgggcacaatggcttatgcctatattcccagcactttgggaggccgaggcaggaggattgcctgagcccaggggttta

SEQ ID NO: 176483 - DNA, 238 bp, Homo sapiens
caagtcctggtttcctattttgacgttttgataattcattttgccttgacaaagcataaattactattttatactccaggctggagtgcaatggcgcgatctcgctcactgcaacctctgcctccctggttcaagcaattctcctgcctcagcctcctgagtagctgggattacaagcgcacaccaccacgcccagctaatttttgtatttttcatagaagtgggatttcaccatgtt

SEQ ID NO: 176484 - DNA, 403 bp, Homo sapiens
aatcaccctatcagtcagcacacaccttttttcaggtattttacgttgcggcttgttagggtgattcgaattcggtgaattgccacctccggctcccttaagcggatcagcgctgatctgctcaagaaaaacataacataaacttcataaagaaaaaaacacctctcccccaaaattggccccttatgatcatacacctaacagtcacaaggtgcttttagaatacatcctatttgttctatactaaattatttattaacttttccataatttccaattttgaagacagtagctcacatctgaataatgttttacagtttgccaaagtatttttcacctacattttccctttaaatccctgcagcaaccttatggggtaggcatggccataaccccaggaatt

SEQ ID NO: 176485 - DNA, 593 bp, Homo sapiens
cggagccccagcccggaccatgtggtaaaagtggccgagtacaacaaagtgaagctgagcatcttcattgcccgcctctatcacgactgtgacccgggattccagcacgggcttcgcagactgcaggacacagaggcacgcgtgcacatcatgtcttctaaggaatttgaacactgttgagaagactgtgtacaagagagatgtgccatgtcagccttgcaagggacagcgtgaaaactacccatctccggtcaccaagttgcaggaggccaggagccaggaggggaaaccgctcagtttgcaaaacgtcgcttccacaagcctgatggctgaaactgctcactgtaccctgaaaccagctttacctacagcttctgagataaactgctgcaactctgggacccacgatgcctatcacagtggctcatcaatggaacctgccggctcccaacccttcctagggcccatgaactctctgaaaagaggaacagaaatatttctcctttttgtaaaatctttaaccttccctttgttcttcatgtacacgctgaactgcaattcttcttcccaaataaaacattaaatttaaaaaa

SEQ ID NO: 176486 - DNA, 444 bp, Homo sapiens
tgatataaataggtagtagaaatatacataagtgtgaaagttaagttttgagaaacaccttttgtaaaaaaccgatggtaagtattgggtcattcttgtcacacccaactcaaacagaggccaggagccaggaggggaaaccgctcagtttgcaaaacgtcgcttccacaagcctgatggctgaaactgctcactgtaccctgaaaccagctttacctacagcttctgagataaactgctgcaactctgggacccacgatgcctatcacagtggctcatcaatggaacctgccggctcccaacccttcctagggcccatgaactctctgaaaagaggaacagaaatatttctcctttttgtaaaatctttaaccttccctttgttcttcatgtacacgctgaactgcaattcttcttcccaaataaaacattaaatttaaaaaa

SEQ ID NO: 176487 - DNA, 323 bp, Homo sapiens
accttcctaccatgaagcgccttctgaagagggtgacaggccatcccctctgcctggcgtgcccacattcaggttctgcctcagccggcagcagacctgccctcaggaactctgtgtagcatttctgggatgttctcctgctttccagaaaaccagagtgggttgcctgcaggagtccccacaggcatgcgtggaagtggtgaccgtccccaaccatcccctccacagaagagaggctcatgccttcggtttctatttcctgtcaatttgtgtccataccagtctgtttaaggataaacttaatttatgttagtttaaaaaca

SEQ ID NO: 176488 - DNA, 473 bp, Homo sapiens
gctaccacttaagatttataaaagcttcattttttctttcattctcttaacttgagtcctcacagagcccactttcctcatcacagattgccaatttttggtacgttaaaaatcccatcaagttgcacttatattatgtgacaattagcttttaatgatggataaaggggatagatgcttaaagtcattttgcattctattactgtacccatctaataaagaaaagctttttaataaaggtcagaaaattttcttctttaatcaaactctaaaagacacactaacttggaaaatacattaaattggttgggccaagagatatgtaacagaatgtaaagacttttgtcaataaaccgcagaggtaaagaaacgtctctataatgtattctcttaatttctattactttttaaaaaatttttttttttttttttttttttttttttttttttttttttatttttttttttttttt

SEQ ID NO: 176489 - DNA, 360 bp, Homo sapiens
tccttcctgccaaatcaagctcctggctgggctgacaatgtgtcacatggttccccctgcctctgcttatgctagcttctgttggaccactgacctagcccatcacggcatggctatgccctatgtacgtttaaggcttaccttaatgctggcaccttcttcctagcactttccctgctctctccaagatgtaagttgtctcctccttgaatgccacaactcttttatcagtatcttctgatggcctcactttccatcacgtgttctgtgcatgtcataccacttatcctggactgaaagctactctatctcccacagagagtaagacacaatgcacgtcttgaggagtaaccgaagaat

SEQ ID NO: 176490 - DNA, 505 bp, Homo sapiens
tgctggttaccttcccagggttttggcctgttgctacaggtcctggagttatagcatttcagaggaagtattttgcaacaagtattaagagagggagcacgtaagcagaaagtctttttggggtgggggtggggggagaccaatgatgagatccaggtaacagcagccttaactcttttctgtagctttcccatacagcacaaagcagtgaccattttacatttatttgtgaggttgtgactaatgtctatgccctctaactaatacgttagctctatgaagttaggggctgtctctgtgtttgctcatgacccagggcctaacacagtgcctggcacacagtaggtgcttaataaattctccagtcatctaaaccacacctttaatagtaggattgaggaaagtaaaagtttgataggtcactacatatactttttaagagatttttgtctttggaactagtaaaagttttactattcaaactaaaaattaagtcaaaggtaag

SEQ ID NO: 176491 - DNA, 594 bp, Homo sapiens
agcgccggtccaacctgaagttgccaagataaaaattaaaatgtacaaaacttctgaataagtaaaaatatatacaaatatgcaggaagtaaaaggcagagttggtaaccaaaggtatagaagccattttctatggcaagcccactaatgtactctaatgttctgtagtcattgtgctaaacgacttacatatggataggtgtaaagtaacaactctctccttctaacccctattctgcccaaaaacttatttagatgaaactagtttgaaatggaacttaaaatcatcaaattataacaggttcctttgtgtaaacgctgtattactctttgacccctttaccctttccttcctttatagctctcatcacaatttaacattctacatctaagcaaccaatttgcctcttttgctcatgacataagatacatgtccatacaggtgctagatagttacccaaagactaaactgagaacacaattacaggtttgattaaacttgaagatctgaatacactgatcattaatattttgatattgatgagtcattctctctaatcctttgtttcaaatttacaaccaagaagtgaataa

SEQ ID NO: 176492 - DNA, 482 bp, Homo sapiens
gcactaggtggatccggtaccggtaaccgggccctttccaccccgccacaaaaaaaaaaaaaaaaaaaaagcctcgagtttgaacaacgtcttcccgtggtccatgggacattatactagggacatctttcaaaagtcaggcaagtcatatggaaaagtcttggtggctgggtcattctgagcaaacacatccagtactgactaaatcagatgaggcttggtcaccaaaattgagttaactctgctgcgtgcaagaagcaagaagattgcaggtccccaggacagagcctggaaggttctgaatccttcctgtgtggcccgtgtgtcaccatcctccccagggacccaggctcagcccccccaacagtgagggggggtcaccaagcatcaggctgagaggaagcagggcaaacccgggagggccatggggccttgcaactacgcaagcctcacacattctcctccagtctgcattcatggca

SEQ ID NO: 176493 - DNA, 191 bp, Homo sapiens
gctacaaccagccaatgatgaaccaaaggtgttcacacccagctgacagctgacccctcagctcaggggacaaggccaccaaggatgtgatgtgcactgctccccaggggaactacatgtggaggggagtggggtgtcagaaccaacagtcccactgtcatgtatttacaccagaggttaaggacacccag

SEQ ID NO: 176494 - DNA, 428 bp, Homo sapiens
cagtttgctccttggccagggttctaagtgccactcagctttccccaaatctgacttacgtgctcctgcctggagccatgggcagaaggttagtgagccgctggtgctgatgtatctggtaacgtgtgccatgatacgagtactggggcaaggaccagtggctaatgtccccagttgtcccctgagccttgcaggcaggtatccaaaatgctgtcagcagatagacataagcatgttgtccctcgctccttgtgtccagtgaggtcagtctcttaaagccagaagggactctgaacttcatcacacatgggctcttcagtgccctccccaaccctgaggccccttcttcccagcctcttactccccatcaccccccattctgtctgtctcaccactcacttggaataaccaagctctgacctgagaaa

SEQ ID NO: 176495 - DNA, 362 bp, Homo sapiens
attattagctggcttttgggaacagaaggagcccttattctttcagccatcacacagccagggataatccccacagccagggcagagctgcatttatcccttgatgggctggaaaatatatgtattgtgtctcaagaatgcaggccggctcagcaggcaatgaatcaggtggctgcccccttcttcacgatgctcggtcacttcctgcccagctattttctccaccgccgccgtttgatgttcagtcctgagaacggatgctggggctcccagcctcgcagcatcatgcccaggaccgctgtctgccagagcatgaagtcagccttggagagcacatggctcctggatcaagagcgttctcc

SEQ ID NO: 176496 - DNA, 472 bp, Homo sapiens
tgccctggcaggtgtggggttagggcaggcagatacccagcaggtcgcctgtgggtgggcactgtctcctcagcactgtccctgcagccccaggggcaggtgaggaagggggcagagagttgtgcctaggccatgattgaatttgagccacagactcagggctggaaggctgcggacttacctgccgctcactcctccaggccaggcttggcccctgggatccctggggggtcacagcccccttctgtcctgtctcccgacactgcgggctcctgcggagacccatggagaagacaggactgaggaccttgaacaagctgtcacttccctggcttcctcatctgaaggaggaggctggacaggacttacacccctgccctggagaggagccaggcagagtccacctggccctcgccagccgcctgacctgtttcctcgcctgtcagacagagaggggcacagggataaaaca

SEQ ID NO: 176497 - DNA, 180 bp, Homo sapiens
cagcacaagcaggttagaggcagagtacactctgcttttcaaaacccagtgcattctttcaggactgtgacagcagtcactgggcaaacactcttgaggtagttacaatctgggaatcctggaatctgggagatctagacttgaatcttggttctgggaccatcagtgactgttctctaa

SEQ ID NO: 176498 - DNA, 301 bp, Homo sapiens
cagtctgtgtcctctctctactgaacctcacactgtggcagtttcttctcaaggctggttctccttattgcagaatagttgtcagcaacaactggagttgttaattctcatctcctgggagaaagcaccagcgatttctccacatcggagcttccttctgctcggaccgatttgtgtcacatgctcacctctgagccaatcagaggagacgcaactaaggacaatcaggtcccaccagggtagggacaaggacatctataccacatagctagaaatgtggagtcctgataggaagatggga

SEQ ID NO: 176499 - DNA, 443 bp, Homo sapiens
cctggatgaggggtgaggaattaataacctctaatcacagaataaaaatggaatgagaattccatctacccaaatcagacaattaaaaagttgaaagaggttacagtaaaaactgggtaaaactaaaacttaaaaaataatttcagaggatacatgatatactcgtcacacagaaaactccagttgaaccttatggacttgaggaatggatacctttgtgtctccatcacttagcacagtagctggcaccatgtaagttctcacagaattttcctgaactctccaaccagaggcaacctttcactctccattcacataacatttccttctttctcttcttttgggaataacatatcttgcttgaattatatttatctttatgccagtttaattctctcttttagattcatttacatctttgtatcctctagctcattattttt

SEQ ID NO: 176500 - DNA, 531 bp, Homo sapiens
ttcaaggtgctcaaatgtcccacatcacttctgtgaaaacccaaacacagaagccacccctctcagctgctacaggccagaaatgaaaattactgcaatccccaggagccagggaagacctctgctgacattccctatgaccactgtgacggtgccgccttgggctgcctcccccactccgtacagagagcgttccagccccaggctcccagtgcctgctcccagcgcctgctccccggcctccatcactccatgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttca

SEQ ID NO: 176501 - DNA, 286 bp, Homo sapiens
ctactgccccccgtcccccagaaccacagacagaccactctggaaaatgctctaatgggagttagttaagactttggccctggggttagctgtgggttcagatcttggctcccatcagccacttagtggctgtgtgacttggcccagctcccttgcctatctgtgcctctgtctcccaatccgatggactagagtaacagtcctttcccggggccagggtggcaggggttatgaatggaagtgaggttacactaccaaaggactgtgcatagagccgggcacagaa

SEQ ID NO: 176502 - DNA, 165 bp, Homo sapiens
taaagaaggcaaactgattaaaagctaaagaaaagaaagattttccctgagggaaaggctgacatcttagaagacaggctagatagacataaactgtttaaaagccagaagatgtgcctaagtctgtctgctcctaaaaagggaatcagacgtggggagggagag

SEQ ID NO: 176503 - DNA, 458 bp, Homo sapiens
tgccatctgttttgtatctggttctgtgcatgcacaattcagaggtgagcctggaatttgtgtcacttcatacacagaactaggaaataactcttttccagctgtcacctctctgggatttctccatactctcgagccgccaagggtcctttttcctggtgttctagctagaatgatggagcttattaatgacacctgtgctgtaattgcagttctgtgagactgcagttgcccaatctctccaagaaagttagagataagaaagagaaaaatgtaattccaattctcccctctgcccacctttcctgatttctctggctggaaggctaaattttctcttggggttttaggtgcccatgctgtcactgccaaagtactgcaccttgactaggggccccaccctcagggcagggccagggaagaaaaaatagacaatacaaaaaaaaaaaaaaagcacc

SEQ ID NO: 176504 - DNA, 435 bp, Homo sapiens
acaggaaataaagcaggcaatagaaactacctgtgggagggcccagatatccagcttaacaaaaacttcacaatagccattacaagtatgttcaaagaaatcaaggaaacaatgattaaagaagcaaagcaaggtaaaatggcattgttgcatcaaacagagaatatcaataaagaaatagaattatctgtgaaaaaaccaaatggaatgcctggtattgaaaatacaataaccaaaataaaaaattcactagagcttaacagtagatcaataaagaaatagaattatctgtgaaaaaaccaaatggaatgcctggtgttgaaaatacaataaccaaaataaaaaattcactagagcttaacagtagatctaaactgacataagagagatttagcaaacttatagattgataaagactgtgcactctgagtaaca

SEQ ID NO: 176505 - DNA, 683 bp, Homo sapiens
tagaactcccatctcttccaaatactgctccataatacagaggctctgccaagggagggggtcagggcaagccttaaagactggcaagaccctggcccttcctgagaggcctgactttatgtggagactaacagcatggtataatacctatagaggaagaccagccagaagtttaaaagggagatcagagaaagagcaaaggaggccttgctaaaatcacggtcatacttggtgatatggaaaagtgtacacatacgtaaatctgcattctctcagaagcaactgaagaaggaattgctttgctattagttcctgactaaatgtgagacaaacttataaactccctgaagtgtgaaagcagtctccaagctacagagcaaacagtaatgaatggaaaccttattggggccaggcatggtggctcacgcctgtaatcccagcattttgggaggctgaggcgggtggatcacttgaggccaggagttcaagaccaccctggccaacatggcgaaaccctgtctctactaaaaatgcaaaaattagctgagcatggtggcgtgtgcctgtaatcccagctactagggagactgaggcaggagaattgcttgaacccgggaggtggaggttgcagtgagccgagatcgcccactgcactccagcctgggcaacagagcaagactctg

SEQ ID NO: 176506 - DNA, 247 bp, Homo sapiens
cccagggtatgtgaaatgatgttattctctagtcctgtctgaattatccctggtggggctcccttcctgtgcctcgagatatacttctaccaatgtggtcatctctagtctttggaactaaagggggctgtgttggagagcttgtggcatctccttcgggggaagaaggtctgcattcttcagggttctcatctaggacacgtacttatcagcacagagatggtgggaatgattgggccactagtta

SEQ ID NO: 176507 - DNA, 190 bp, Homo sapiens
gtaattatattggggttgatgggatttgggggttgatggaagtattctgaatcttgattgtgttgatggttacatgctctatatatttgtcaaaactcattggaccgtatacttacatgagtgagttttgttgcatgtaaatcatactacaataggccgagcatggcagctcatgcctgtagtcccagca

SEQ ID NO: 176508 - DNA, 618 bp, Homo sapiens
tacgtgaccccataaaaattacattgaggatgagatagtgtcgtatgtagagaagaatagattaattcaaagaatagactttaatgttacaccatagttgctatattactttcgataaatgtgtgtgcagagttttttattattgctgaattatttaagagtaaattgcaaacgtaatgcccctttgtccttaattgcttctgcatgtatgttttaagaacgaggagttcttttagggcaatcacagtgaaattctcaaattcaggaatgtaacattgatatggtgctgtttgttatctaatggacagttcatattcacattcactaattgcccattatgattcagcagttcccacccatttgcctacccaggatccaatccatgcttacttgctgcatttgcatttaattgacacgtctcttcagtctcctttaatctgaaactcttccttactttttcttcagtactttcttttattaagcatctagttagatactgttgctaacacaaagataacaggctctgcccacgaggaattcagattatacaatttacttttagcataatttccaattatgcagattcatatgactagctatgtatacttatttctgatt

SEQ ID NO: 176509 - DNA, 806 bp, Homo sapiens
atctgtgcaaagattcttagtgagcagcttccttgtaacgattacatgcagaagttctttgggggaggtaggagaagaaagaagcaagatataattttaaaaggagctgcactatttcagaaggaaattgccacctaaggtgggaggcattgcagcttcctggtgctggaagcactgaagattgccctgtctcctgtgttgcctgtaatctctggccttggttccttcagtctggctacttagagctttgtgattctttagcaggggctgggaggtattaggagcccctggccctgtatttctgtggcattttatttggcctctctagggggtgtattttcgagcagcagctgtgaggtcaccctgggtgcagccagatccccatacctgctaatttagctccttttgtgagctattttatttcggatgccttctgtggaaattttgttccagactgacttgaaagtgttttcagcatcgattctctctttgaacagtataaccagggtttgccacttgtggggaaaaaaggagctcatcttgagctttaagaacagtatgaggtgggcttcctgtgtccagcccaccccagtgagaattatgccatgtgtcttctctccaggataaaccgacttttccattttacataaaatcgaatctcttgaataacaaagagtactgtagatactgaactggcttctcgggactagatggacacccttagtttttcagggctaataattgttttttttccatgatcaagttccacatggacttcgcccacagtgcttgtttttctgtgttgt

SEQ ID NO: 176510 - DNA, 635 bp, Homo sapiens
taactgaataaatatttctggaatatctacctagtgaaagatatgtaagggaatgaaagatagatttttaaaatctagtcagaattaataaatgggttcaatgcctttgtcagacttatttttcagataacactttttcttaacagattttcttagattttaaatgaaccttttcaaatatgtctgaacaatattttaataatttatcaattcacaattacatatttaatttccaaatatgctgcacataacaagtaagctcatatatttttactgagggaagtgatagtggataatcagtctaatcattcctttgcttaaggcatttaaatattgccatataagaatagcacttactagctttgttcacttactggaaattagatggagctgaatacttaaaagtcaattttagccaaaacccttctgctgatattcccactgcctataattgccaaattaataatgaatatgtggactttagaattaaatgtcattccttgcttgccttaagattttaaaatattaaaaacaaaataatcctttaaattgtcaaaatgtgaggactatcatgacaaggaagaggagtgattttctttttttccctatgtagaaaattttccttaactgagttt

SEQ ID NO: 176511 - DNA, 411 bp, Homo sapiens
  misc_feature (354)..(354): n is a, c, g, or t
taacatctagttgcctgctggagatgggagtggatcattcatgaggacggatgagctaccctaagaagtgagtgcagatttaaaaaaaatcctgctaggcgcggtggctcacgcctgtaatcccagcactttgggaggccgaggtgggtggatcacgaggtcaggaggttgagaccatcctggctaagacggtgaaaccccaactctactaaaaacacaaaaaattagccgagcgtggtggcaggcacctgtagtcccagctactcaggatgatctcatctccacatccttaaattaaagaggaatgaaagagagatctgagacatacagtggagaaggccatgtgcagacagnggcagggtttggagagatgcaggcagtagccaagataagccaggagccaccagcagc

SEQ ID NO: 176512 - DNA, 295 bp, Homo sapiens
gcttaagcatgttgctgtctgtgaatcttaacacagatatgccaggtgatatctttcagtgatatgacacaataggtaatctacagaaatgaaaaaatgcaaacaaaacatagtaattattaaaaatgtttcacaaggaacattgtttttcagatatagatcatgtaaccctaacactaataacctgaaggctaaaccaagtttcatctctgttaaagagaagaaaactgaggccaggaaggtaaaatggcccatttagggttacaaagtggtggcccctgaattaggatttctg

SEQ ID NO: 176513 - DNA, 509 bp, Homo sapiens
gattaggtaaggagagtgacttcaaatatatggaagaagaagtctgaaccagatggcaaggttctactaagggcaaagaaccttctgacctctcggacttcctaaggaactttctccagcctccctcccacattcccaggtcaccacacatacccagacagtctgtttgcatcagattgcacgctttgcttgttctgtcggttgcctctgctctctcgtgttggttattaagctcttgtctttcacagccttctatattctgttttgtgattctgcagtttggactctgcaaactacacttctactctgtcagctgtctcctgttagtttctaccactgcatagagattggaagtttggaggagaaagaagggaaatgctcatttcttttcatttgctgttctttcagcaacaattcttcatccccctcaggcagcagcagctgcttccagtggtcattggttatgattttcacttttttttttatttcttcatttcacttacaggccc

SEQ ID NO: 176514 - DNA, 605 bp, Homo sapiens
tcaggtttccttctctctcctctgcaataacacaatcttaccaaagcaaaaataaactatgcactggtcttacttgaccactcggctgtatttgacagaattagccactttctccttctggaaatacagcagtccccccttatccatgggggatgtgttccaccaagacccccagtggatgcctgaaaccataaataataccaaactccatattgactgttttttcctgttcatccatacatatgatcaagtttaatgtataaattaagcacagtaagagattaataccaataactaataacaaaatgaaacaattataacaatttactgtaataaaacatatgtaaacgtggtgcccctgtctttctctcagaatagtttattatactgtattcaccctacttcttgtgatgaagggatgaagtggaatggtgtgagatttcatcatgccacataagaggtactactgggagccaggcacggtggtatacacctgtaatcccagcactttgccaggccaaggtgggcagatcacttgagctcaagagttcaagaccagcctgagcaacatggcgaaacgccgtctctacaaaaaaaaaccagct

SEQ ID NO: 176515 - DNA, 120 bp, Homo sapiens
taaatgataaactgtggattggtgctggttagtgagaaagttttcactgggccttggtgaaatggaagagtaagcaggacaatgtaatgatatcataaagttaaccttaactcagagctc

SEQ ID NO: 176516 - DNA, 352 bp, Homo sapiens
catcctggtgtcaggctccggtcttgctttctccctgatagggtgaccaagaggggttttctgagctcctttccacagggtatcccaaggacacctgatctaacaagggccagactatatatttactataggccctacacagggccagaaggtgagcagaggggtcttcagacattcagagcacacacccataccacagcgagagatggaacctctaaagctggcaggttttaatgcaagatcccctgaccaaaagcaggatgctggctgctctgaggagtcagcgagggtgtgacccccactcccactgcggtggaaggagtgggcatcttttctgtaaacttgagattcc

SEQ ID NO: 176517 - DNA, 333 bp, Homo sapiens
cgaggccccgagaggtaaagcagtttgcccaaaggtacacaaccagtaagggatctacccagggattcagaccaagtcggagggacccacaagcccaaactctttgtcttccattctccttgaaatttaaaaatctaattttttccccttgttttttcctctgtccttatctgtgatgctatgtgaataattagcccgaagttcatggctgtcatctgcatttgataagaactatacctccttgcccccaacactcccccacaaacctgagttgagttagaggcgcagagcattcactcaagaatgttagtctcagctctgctgctcacctgc

SEQ ID NO: 176518 - DNA, 728 bp, Homo sapiens
tcagcacctgaggcaaccaagccactgtttggtagccgtggcggactggaacccaggggtcctctgtcttctatgtcggccaccaccacctctccctggcttcttcccttggaagccagcagagctgacctccagggtctgcaggttcatgacgtcttctggaggcataaggagagaggtgactcttgagggactgacaactgccttgtccagtcagcagccacaaccctccaacgtccccctccctggccccaccagtccactccagagacatcctgtagaaggcccacccgctggcatgggctcctttctggctgctgagccattctgctcgctctgtgaggacagagggaaaaaatgtgttttcctagctcttggcagtcagcactgctggagcctcctccctgctggaaggggagcaaggctggaagaaccaagcaccacagagaagcaacggcctggggttccagccccagttcaggtaccctctcacactcgctgtgtggcctcaggtacggcactccctctctctgggcctcagttttcccactatgccaaacgtcctccgagcctaaggtaccttccaacaatgactgtctctgagtttagagtttcagattctggcccagagctccaagaccaccagcagaatggaggtagggaaaggaaagcggtgaaggcttcctggaggtgggggcatgagacacaaactatcagactatcagact

SEQ ID NO: 176519 - DNA, 524 bp, Homo sapiens
attaccttcctgtacatcacaaataatcctggagggcgtgacaggaagtagccctactcatactaataactcttgattaaattaagatttttttctattggtgttaatgttttaaattttgtttaatgttaaaattatgttgatgtcaaatctagttggattatttggaagttcattgtacccattctttaaacttttctctatttgcaaatttggggaaatactattttggtcctgttctatggatgtgaccttgtagggtctcatttgtgtgctatgcagactcaaaacaatttcctggggtaaagcttacacctgactttggttttcccttgtgggtgagaaagcctttgatacaaccagctgttcttaggtacctcagctttcacaacaggtcaaacctacgtttgaattgtctattaaggcatatggatctgaattttaaacaacacagaatagaattccaggatttcgctgagagtataatctcatcctgtcatcaaatatttattaaaaactcagta

SEQ ID NO: 176520 - DNA, 303 bp, Homo sapiens
ccctaacctatataaatgataaaaaggaaccgaatgggagatattaatgtgatgttgctgggaagagaaatgcctgtcttaaattagtggttgtcagggaccaatcccctgtgcaatattttgattagtggtgtctgggttggggccaaggtacatgcaattaaaataaccctctatagttgaattcagtgtccagccagaattgaaactatatagattaactaatgtcgtatccgcattttggtcttatgggggtaatatttgtaataatcatgcttttggtactgatgttctagtgaagtt

SEQ ID NO: 176521 - DNA, 536 bp, Homo sapiens
taggcttaggtcattctgtctcttgatattatattaggttgaaccaagtgaaattgctatttctgtaggtcaaaacagttgtatacaggttgagcatctctaatctgaaatccaaaatgttccaaaacctaaacattttgagccctgacatgaccctacaagtggaaaattccacacctggcatcttcactttctgatgattcagtgtacacaaactttgttctatgcacaaaagtattaaaaatattataaaaaattaccttcaggctgtgtgtataaggtgtatatgagacaaacgaatctgggtttagtcttgggtctcatccccaagatatcttatatatatgcaaatattccaaaatctgaaaaaaaatccaaaaatcccaaacagttctgatcccaagcattttggataagggatactcaaccggtattggcaatttaatactggttcaccctaatatgttttgaaggatctatactgtatacattcttatttcaataatagaaatcataactttggccttctctctaaa

SEQ ID NO: 176522 - DNA, 544 bp, Homo sapiens
ctctatccttaatctataaacacaggactccattctgacaattgtcacagaattgtcaattcctctgacccacagtgttagatgtccagtggaattgacaggacatcatacatttcaattagttccactctccattgctgtggagggtgaggtgctacctcaccttcacggggaagacccaatgttccaaggatgtgcagcgcgggagggccccgaaccattcagaccatactcatgttaaggcccatgtaacggtggggtgtgctcaagggcggaaaatagccctgtgtgctttgaaggcaagtgtgtgcaaacatacccaataacagacatgttttgtgtatgatactatattcccatattgtcaatttttcttaaattagtaaacaatgactaacagaagtggtaactgcctatatttgaatttatgcaaacatacatgatttattaaacactttatctggagaacataatggtataaatggaggtttccaggcgactggatttgtgtgtgtgtgtgtgcgcgtctataaaggaagactat

SEQ ID NO: 176523 - DNA, 198 bp, Homo sapiens
attattgcccttagaatacattcctagaagtgggtcgaaagggttcatttttaagcttctaacatacactaccaaactgccctccaaagaagtttctccaatttaccctccacccagccatacacaccaatgaccatggaagctatttcatcactccatcactctttgcaacatttgtatcttttttttttttttttt

SEQ ID NO: 176524 - DNA, 717 bp, Homo sapiens
ctgctggttaagatccgttatagtgctttgtttatttagagtgcccttacttagtggcctctttaattctccacggtgctatgagaacaccataggaagtagggttgaaatagggccagggcgcaccacgggtggtggtgaggtcactgtccaggtctgggactcagccattgtgggagggggacatgaacagacactctaccacatcagggaatttgaatactgtctttggatatgttgatgaagagactgtcagccagggcatttcggcttcctatgtgggttctggaaagcttgttggaaacagactcgtgagacacactcaaaccagtttgttttcttcagcaaacacctggtagagattggaattgaacagtgagtgaagaatgacctcacgctgcccagaattctgattccatgtgtaatgcgaattctgagaggcctctgtttctcagcttttgggtggtattcagagaggtctagtaacacttggtgtcacctggctggtgagggcaggctccggtgaccgcaaagctaagtgctctgtagggcacctccctctctttcaggggctgcctgggcctctggtgcacatgatccatggagtcagagtcagagctctcgtctgacaagtgcttttgctttctttctttctttctttcttttttggagacagaatctcactccagcctgggcaacagaatgagacccttccgc

SEQ ID NO: 176525 - DNA, 153 bp, Homo sapiens
ttaggatgcttcatattttatattatttaaaatagcacaattttcaagaaggcaaaacagtagcaattcaaacatggatttgttcactttgggttcttgtttcttctgtcttcccccagacactctataattggatttgcttctaggtttaca

SEQ ID NO: 176526 - DNA, 385 bp, Homo sapiens
tttatttcttgctgtgactatttccttagtattataatgcccacttctctgaaattcaatccctgcacccccttcaacctgcccaccaacatccaacagtcacatctgtccagaatgcaaatctgactctgtcacctctagctgaaagctcttcaataaaatctgaattatttgaaattcccccaaatgcacctggttctttaattatcactttatttacttggcttatcttctatttccagtgcaccattttgcagaatgtttatgccttcccaggattttgccagagttttctctcttctgagaagcccttcataacttccccaaagtgtaacttgttccctaccttgttcatctgttcccactatgctttctgcacactttt

SEQ ID NO: 176527 - DNA, 414 bp, Homo sapiens
ccggcaccatctgtgccatctaagaccctacacagggctctgcatgtgggtggcaaacctggggactgtgaggtttctggcaaaataatgctggcatgctgtggtgggcgtgtcctgctcagataacgtgaatctattccgctttgcttccagagctcctgaaatcaagagtggcaatgataagcttggaagcaacactaaccccgtgcacatgctctccatcctcccaccccatcactggacaccacctataacctgaagtgggctgacaccctgaaaaccacgtccatgcaccttggttttgcccacggtgaccaggtaggagggaacttgagttttacattcttctagggttttctctttctggagcattgcatatcgtttttagaggaaaataacaaaaatggaatcctt

SEQ ID NO: 176528 - DNA, 456 bp, Homo sapiens
attggtgtccctagcatcattcctaggggacattgtgtgtgccaccattacgtgcctcgccagatgtaaagatggtgccacacacacatgctaactgtgatgtgaaattcacaaagacctcacacatgcatgatgccaactaagaccacacgcggtgggtgggcaagccttcaggagagctgggcaggcctggttgactctgttccactcttaaaaccaccttcctctctatcgatttggcatgggaagccaatatgcacgattttgttttttctatggaaggcccattacatgattctctttagtgcaatcaatactaatctaattgaggtaattagaaaatttttacaggtaactggcttacaggccaatgcagcagacaataaaattgccattcgccaccatcagtctcaaactttcacagtattcttcctccacggtaaccagaaaacaagt

SEQ ID NO: 176529 - DNA, 460 bp, Homo sapiens
ctccatgttcagaattaacaccctcagtacatgcttctgtgcttctttaccagtgcctacatccatgccatcctgttgttatccatggatgaacaactcagaatttggagaaatggatttggggaaatctctgagacacattttgaaaccagcgaggaattaggctgcaagcggcagcagcagtaacagtgacagcagcaagaaacagccacctgcatctcaagagtggcacagggcttccaccggctgaggcggacacatggcggatgtgtaagaagcgtgcagaaagtggtcagtcatgtgtgcacacacgaatacatgctcagtgtcaggccaaggccctgtgggcctaaggaaaacaatgtcacgtttcaacatgatttgggaaaccctactctccactgaaatctcatattggcagcagaaaactctgccgatgcctcagaagccaaagataact

SEQ ID NO: 176530 - DNA, 137 bp, Homo sapiens
tgctgggattacaggtgtgagccaccatgcccagcttcgattcctttttaacgctgaataacattccactgtatgcctatactatgttttgtttatatagtcacctgttgatggacttttgggttatttctaccttt

SEQ ID NO: 176531 - DNA, 163 bp, Homo sapiens
gcagtgccatgtttcaaattcagatgcctgacaccgataaccctattccacgcagtgttctttatacctccagatattaagtcatttggttcacaagatggtccggtggccacaaagtctaggcaacagtacatccaatgcccctaactttgcacttaaacca

SEQ ID NO: 176532 - DNA, 703 bp, Homo sapiens
caaaagagaagccggggttaatcggacgagtgtgaaaggcctagcacagcatttagcacactgttaatggtatgtgctaactgtggagataagcaggaagccagagcccctgaggacggacacttaaaccatatcagcttaaaaagaggtggatggagaccagggccttcaaacacatgaacagttttcctaaccaaattattataatgtgggcccaggcaataatcttgctttccactgtatttaccagtttaattactgtatgcccctttgatcagtctattgagacccagaagcttttaattaggaaatgaattatggattcatgaagttagaatataaaatagtcaaattagtttttaccccacagaagctatgtttggtggtgggggtggtgggaagcttgtttttacaatgtagggttcactcgaatggtaaggaaatgcggggaattaatatattgactgcctactgcattccaggcatgtgctgggaactttaatacagggctttacaaactgtccacaatgaagggccaattttactttttccagtcggccatggactgatatgtttgcatcaatatatttgaatgctgtgtcacgtcaaaatgctataaacagccaggcacgggggctcatgcctgtaaccccagcactttgggaggccaggcgggcagatcacttgaggccaggagtttgag

SEQ ID NO: 176533 - DNA, 356 bp, Homo sapiens
tcacacacgcgcatgcacacacacacacgcactcacacactcacacacacccgtttcactaccagacttccctaagccactttaattgaaaaggcatgatttagactaattgacagcagatgggttcggttgcaaaatgcagagaagcatttgttgaacatgatttacagcaacgaggcaaaactttctcctttttatatctttctctgagctccatggccagaacagctcagcagaaatgagaggagaaaaaaaagtaattagtgtttaattttttaacaatttttaactccctttttaattgctttacataaacctgtcctagaattttacagccttcaaatctctgtctaagt

SEQ ID NO: 176534 - DNA, 478 bp, Homo sapiens
atctttttcctcttgtcccctctctctggcgtgccctttgattctccttctctgcttgtttctcagggcctagctcaggggccatataccttttgaaatgttctcttttctatcaaaatcagaattgcccctccttttgaaaagtaaccacatttattcaaccattcattgattagtttaacaatgattgggtcagagtccctgccctgcatatgcttagaattttgtaagaaagagaagattttaagaattaccttcgttgtaaggcagcagtaacacagctatagtagagcgtaagggaatcctttattgaagaaataaatgagttttgagtgagaagagcacgcacagagtggaatccgaagggagggtaggctggctgagaaagctgctgctggtctccgctgcgaagttcttccctcttcctgatgtctcaccttgaaaccaccctatcctggcctgtaacaaacacaacagc

SEQ ID NO: 176535 - DNA, 289 bp, Homo sapiens
gtaggagctataagaagggaaacattttctgatgttatgattaagctttagtttaagggagagactgggcatctggggggttccaaagtgctcctcctctagctgtagcactgggcttgtatttcaagaagattttgtatttttgttttattacactagatgccgtaggcttcaaccagtgtactgaggtgacagtctttgttgcacttccctctgcagattcagactttctaccagggagatgggcatgatggatttggcgagtttgggcaaggactgctgtttcctt

SEQ ID NO: 176536 - DNA, 503 bp, Homo sapiens
tcatccattcacccatccatccatcatacatcatccatccatccatcatccattcacccatccatccatcatacatcatccatctataaatccatcagtaacccattcatccatcccccatctacacatccatcagtaacccactcatccatccatccacccatcatacatcatccatctataaatctatcagtaaccatccatccatcatccatccatccatcatgcatcatccatctataaatccatcagtaacctactcatccatcccctatctacacatccatcagtaatccacccatccatccatctacacatccatcagtaacccactcatccatccaaccatccatctgcatatccagccatccatccatctccacatgtacacatccttcagtcatccatccatccagtcacccattcatcgccccatctacacccatcagtaacccagccatccatctatccattcacccacctggtcccccatccatcggcct

SEQ ID NO: 176537 - DNA, 631 bp, Homo sapiens
agaaggagtgcagctctccccaaatacctcaattttagccccgtgaaggtgcttggaactcaggccagctctactgtgggaattgttttaaaccaccacgttggtagtaatttgttacaacagccacagaaaaaatacagacgctcaccaggtctaagtccgtaacaagtgcttcccatggattccataattgttggcatgactgagattgtagcttctagtatccccattacttattttaagaaaacataggataaaaatatgctgtattacttacccaaggtacctagtagggggcctagagtgggacaaatcgagtgtgcaagtgagtgtgcaagtgaaacggcctcattgtctggggcgataccctggaaatcactgtctcatggctgagaaactaaagggtacagacacacgaagagtgaggttgagagtggatgtttaacaggtgaaaggaggaggacggctccctgcagcagagaagggtcccgaagaaatgagctgctggagccgtggtgaaatgtaggaggttttatagatgtctggtgagggggtggtatttgacttacatagagcacaaaagattggctggaccaggtgtgccatttgcatggggtgtgaaaaactggtt

SEQ ID NO: 176538 - DNA, 631 bp, Homo sapiens
ctgcatgcttgctgtatgagactagagcatagctgtttatttatatgaacacaatgctacatggagcattgagagaatataagaaagcagctaggggctggtcaaataaagcagagaagcattccctaagcttttgtttgttttacttcaaacaaactcacacacaaagagagagcccttgaagccacaagtaaatgatgcagactcttagccaaatggggaaaagtgccttatatgtcatgtacccctgtgctgtttctaatttttcctgctccttagttctaagcataccatacacataagtaaaataaaccatattgggctagagcttaagttaaatatcaaaaccactgcatgctgaccgtgaaaactcactcatgctgaacatttgtgggttatcaggatcaaagaaaacttcgatatttatcaaaaaatttagcccaccgtggtttagccttcattaacctggtatgcatttgaagaattcaatagagttaatgcaggccaagcctgaactaaattttttcgacttaggaaaacacttatcctcctaaaaagatagatatcagtttttaaatattggaaaagggcagaataacataaggttcacacatggttgtctgaatgcgat

SEQ ID NO: 176539 - DNA, 596 bp, Homo sapiens
gtcagaggctttgtcatgatgggaaaaggagacctgaattcatataagaaagcagctaggggctggtcaaataaagcagagaagcattccctaagcttttgtttgttttacttcaaacaaactcacacacaaagagagagcccttgaagccacaagtaaatgatgcagactcttagccaaatggggaaaagtgccttatatgtcatgtacccctgtgctgtttctaatttttcctgctccttagttctaagcataccatacacataagtaaaataaaccatattgggctagagcttaagttaaatatcaaaaccactgcatgctgaccgtgaaaactcactcatgctgaacatttgtgggttatcaggatcaaagaaaacttcgatatttatcaaaaaatttagcccaccgtggtttagccttcattaacctggtatgcatttgaagaattcaatagagttaatgcaggccaagcctgaactaaattttttcgacttaggaaaacacttatcctcctaaaaagatagatatcagtttttaaatattggaaaagggcagaataacataaggttcacacatggttgtctgaatgcgat

SEQ ID NO: 176540 - DNA, 126 bp, Homo sapiens
agaatataaatttatattgtgtacatttagcttttaagcaatttctagattgaaagtatgttttgcaagttaatagaaatgttttcctattcttttcataaagaacctattctgtctatatactat

SEQ ID NO: 176541 - DNA, 466 bp, Homo sapiens
cggcacgaggggacatccctgatttacttatttttatatcatctttatggactgaaaaggccaaaatttttttaaaaatatataaactatctttacatcagatgaaaggaaaaagacagaaacagatgcaaacatcaagtccatgttattaatagaagaaacggctactttcatttttgtttttgttttttttgagacggagtctcactctgtcgcccaggctggagtgcagtggaatgatcttggctcactgcactccagcctggcgacggagcaagactccatctctaaataaataaataaataaataaataaaaaaataaataaaataataatgccagctgtgcagctctgattgcagggagcatgaagaagaagttcagttaggtaattaaaattaagtggatgtttgacctgaaaaaatagaggaggcattcctaaaagatttgctatattaatggtttca

SEQ ID NO: 176542 - DNA, 334 bp, Homo sapiens
agcctgatgaatcctgtttccccacctcctttcattcttggtgagcttctgccttatacttctctttcagtcatctgggtacctccttttattttaaagacaaatgccagcctgtcgctgagctccacctgagtgtgtctagactgtgtgaaatgagcttcatgtactcttgtaggaaataaggaatgttctggaaaagtgacgcttccttgagtgagctagaatgggccctggaatgatcagctccgttttcaagggcagggagtgctatgacaggggtcactgccaagcactttgggtctctacagttttatctactattcctaccaagtca

SEQ ID NO: 176543 - DNA, 386 bp, Homo sapiens
agtgagtggctagaaccccagcatgagcttcctctataccattatctcataatccagctcactgatttctgactaaagaagtgatgaaagcttttgcagaaaacttgcagaatatagaagactttagagagaaaaagaatcactaatagtaccatgtaccagaggtaatcagtagttacattctgttgtattttttttagtcttgtgtgtgtgtgtagacggagagacagttttttttttttttttttgagagagggtctcattcccatcgcccaggctggagtgcaatggtgtgatttcagctcactgcaaccgtgacttcttgagcttaggtggccctctcacttcagtcgcctgagtagctgggactacgggtgttcaccact

SEQ ID NO: 176544 - DNA, 832 bp, Homo sapiens
aaaccgtagctgtaatatcaggttacatactttctgttttattttcccttttctctgtgtttttggttacttgagatggcctcctctctctcactcctggtttgggaaggccttgcttcctctgaaagcttgtgagcagagggctgatctgatcagatttgctcttctgagtggtgctctagaagccacgtggagcatggatggtgtggggtgtgtgctggatgaccggcaagcctggggttctggaggacctttgggtggctgtcacagttagaggataagaggtattgaagccaaaactgagattgaggtagctgggaaggaggagaggggagagtttagaagctttaggtaggaggcagacctgataggacatggtggtggtcttcagatgatgggtggtggatgggatggagagagaagcctggtttttgactttaacactcgcaaatgaagcctttctttctaggttttgtggagagggcagtgcataaggggatagtaagtgaagttctagattgagttttgaggtgcctggagatatctgggaaaaatatgtaatatatatatttctcttacatgtatgagactggcttgggctggggtctgcccttgaaaactggcagctggagtcttgagtactttcctgagtcattttttgagctctttgcaagataatgttaaaaattcaagaggccgggtgtggtggatcatgcctggaatcccagcactttgaaaggccgaggcgggcggatcacctgaggtcaggagttcaagaccagcctggccaacatagtgaaaccctacctctactaaaaatacaaaaaaaaaa

SEQ ID NO: 176545 - DNA, 735 bp, Homo sapiens
aaagataaaagtttcccttttcagtgtgcatctgaagaaccatccccatggaaaataattaaattatgttaaattggcactcggctggaaagtggatcccacagcccctgtgcatgaagctcttgtctgaagttctttcacgggttcttagactatcccaggaagccctgatggtgcttcagggctcagagtggcccctgtgagcccaccccgctggggactcagaagttgggggaggggagaggtctgaaagcctgaattgctttcctagctgttcaccaggtgacccccgggttcgcttagtttctgcatttgtaacatagctgggagaatcctcctgcagggccaggctaaggataaggatgtgggcttatccaggagaaggatatgggctctgttggaggggctgggtttgtgtctcagctcctgcacacaccatctagccactagagtctcaagttttggttgaaaatgaagactgaggtttgaaactaagctgaggtggtccccacctcataaagttgccatgaggatctgaaaagacaatgggtgaaagggctttataaactgtagggtggccgagcgtagtggctcacacctgtaatcccagcactttgggaggctgaggcaggtggatcacctgaggtcaggagtttgagaccagcctggccaacatggtgaaaccctgtctctactaaaaaaaaaaaaaaaaaaaaaaaaaaaaaatcaaaaaaa

SEQ ID NO: 176546 - DNA, 822 bp, Homo sapiens
ccagagaaaatggtgaatcctctctgcagaaaaataacatcaccctgagctactgcaatgttttacatcagtgctcagtaactcactgaaatgtttatcaggtatatcaagaaactgaaccaaaagaaaaaataaacaatagaagcaaactcacagatgacctagatattggagttatcaaataaggacttcaaaaaaattatgatatcagtgacaaggtggaaaatggcactggagggctggaaattgttttaaagcatcaaatggaaattctaaaactgaaaagtatggctgaagggaaatgtgaataggtagatttaatagctgatgggacatagttaaagacaagattaatgaacttgaagttagttcataaaaatattcagactacagcataaaaagaaaaaaaaaacaggaaaaaagcataacaaataaaattgtgacacagtgaaaaggtctaagtgtatctggagcaccagaaagggaagagagagaaaatgggacagatgaatatttaaaagggaaagagcccagaattttcagaagctgacatcaagtaacattcaagaagtagtacaaacactaagcaagaaaatccagagaaaaccacacataggcacattcacaggaaaactgctgaaaaccaaagagaaggagaaaatctttaaggcaggcagagaaaaatatacattcccttcaagggagacaagaccttggggaatattattcacatgacctcttcctgaaggacatggtagacaacaatctacagccaaacaagagatgatagaaaaacttcagccaaaggactggtgggaagcc

SEQ ID NO: 176547 - DNA, 116 bp, Homo sapiens
cacttccctcacagtctatgtaaatttcagctttatctacctttcaaagcccttagctactcaaaggtagagcacactgcccccagaatgcctatggacatcccatttgtttatgt

SEQ ID NO: 176548 - DNA, 507 bp, Homo sapiens
aaggcaatgtctgattaggaattgagataacagtttgtatatatgagtaataatcatacctgtactttatggctttcttatctattatgtcatttgatctttcaaccatttcattagatagctagagcaggtggtatccccattttgtagatgaggaaactgggacttaggggttacttacccaattatttggttagaagtggtgtgactgaacagtaggcataatgtggcagtaggcaggagagtggaaatgggaaagagtctggcagggcaggggctacttagtgaggacccatctggaatgagaatttgtaggaaataagattagaagataggctgggacagatgtcagagccttgaaaacagaatcgtttgcctattgaaaacagcctcaatcatttgcctcttggatatagggctgtaccaagcccaggaaaatgttgggattttttgaaggctttaccaagagcaaaatcagaaagcttcacagtttaaatgttgaattta

SEQ ID NO: 176549 - DNA, 665 bp, Homo sapiens
tccggttgcgaagactgctggcctctaaagcaatttcaaaaacgtttattgtgtacctattaaatacaaggtgttgagagccacatagtagaattagggataggggccctagagatgtggtatctagcagagttgatccaaggctcagctgggaggcagggggtgggggatagcgcccatactgatctcccctcctgggcagtactggtgcgataccagcgggaggatggcaaagtccacgccgtgaacctacagcaagcgggtgagacagctattaaactgttttaagcaaaggaatgacccttggcagctgcagccaagcatgatttgcagagaaataaggataagtctcttcgagaatctataagatagcagctcatttttgttttacaaacaatgcaatttctttcagatgggctacaaagagtagacacaagaaccagcacttaccaactttcatactcagtctaggtccttttttctccccccacaaaacttccaccaggccctactgatagaatatagttgctaagaattaaaatgtaaactttttggttacatgtcacgtgtttactaatcaattctgttataataaaatgccattataaggaaaagaaagtatcttgcgcattagggtaatggggcaatattcagttctataaaag

SEQ ID NO: 176550 - DNA, 450 bp, Homo sapiens
ttcactcacctccccttaagtacccagttgctccaaagaatcagagaaagggctttgtagctcataagcaagacacagaaccagtctccctccctctgggaaggcggcagaaattccacatcagccgtttccatcatccttgaaaaggtggtcaagttggtcaccctggagacctcagccctgtccaccctgactctggctgaaaccattgtatatttctgtcgtctggttatgcataagttctttaaatgatcctaaacattttgaccagcagaagtaaaagtgcagaagagactgaaacagaagagactgaaacatagagggatggttaagttacagtgtcactacttgacagagcattaggcagcctcccaaaacaactgtgaatcctcaatatagaatgtggccaagggcctctaatgttaagtagaaaaaagcagataattgaac

SEQ ID NO: 176551 - DNA, 442 bp, Homo sapiens
aggctaagtaactccttgaaagtctctcaagactttctttacctttcaagaaaggtatccatggccacttgattctgaagctcatggtctttccagtctactcacatactcggcagtgttagagattaaaaggtgctttctataagtatacagacatgcaaacacatatttctttactgttcataatcaagtgtcaattagtccttattagaatgtgggatgtataaatgtaagagaattttcagttaaaattgacagatacattttttaattgtcctaaaatggatttaattatttttctttaatgttatttttatgagaagtgatataactttattgataatgcatacaataactctttgttttgcacattgtttggaaatacaatgtattttgcaagtaactaaagcccaatttaaattaaaattttaaattttcaatc

SEQ ID NO: 176552 - DNA, 284 bp, Homo sapiens
cagctgagtgtaaagatatgccatgttcaaatatttgaagacagcattaaagatgccaataatctcaaaatttaggtcaagcgcagtggctcttgcctgtaatcccagcactttgggaggctgagctgggcgactgcttgaggtcagaagttcaagaccagcctgaacaacatggtgaaatcctgtctctaccaaaaatacaaaaaaaaaattagccaggtgtgcacacctgttgtcccagctacttggaaggctgaggtgggaggattacttgagcctgggag

SEQ ID NO: 176553 - DNA, 658 bp, Homo sapiens
tctgagaaaacgaaaacatacgggatcgtattgaagagggaaactgcagcctaaaatgctgctagcaagcgtgggagaatactaccataaaagttgggacccctgccaaagagcctgtcatcgctgcaagtggtggaatccaggagcaggagggggcttactgaggcaacttgcagagggaggacttggggtgtggcaggggagcagccaagccggcagatgactacgcatctccacgtacacacaggtctccatctcaccctccattatgggccggagagaacatgtttcctgcagtagcgaggataagaataccaagtctggaagagcagccaccgggccctctgctcagcagcacatcgttttcatccgtaatgctgggaaaacactgtgcctctccgtttagtgagaccctcaagcagtcatggctggccgtccagccagggggtctccatgcaaagaggatcacccaacagtgcaggaagaaaacaaattcagagaactcaccactgaggaaacaatggaatacaccgaagctccgtttttacagttttaagtattggagccacccaccggcctagggagaccctagcaactgttgtacaaagtcaggctgatgagggttaaagttagagaacattttacattttttgcaccc

SEQ ID NO: 176554 - DNA, 697 bp, Homo sapiens
tcttgggggcagggtgtggtcgctcacacctgaaactagctctttgggatgccaacgcaggaggactcctgaagtcaggagttcaagaccaacctgggtagcatagcaagatcctgcctgtctctataaaaaattaagttaaaaacaatttgccagacttggtagcatgcacttatagctccagctactcaggagctgtggatctcttgagcccaggagtctgaggctgcagtaagcactgcactccagcctgggtgacagaacaagatcctgtctcaaaaaaaaagaaagaaatcaaatactaggcatgggtcagacatagaagtcagttaggactagatgaccctaaattattggctattttttcctattgaactgaaacttgacaaagttgaaaaactgtcagattttaagagcaaacaggagagaactttgttagaagagttgcccagaactgacatgaccaataggtcataaattgcaacacagggatttttatctatacatggctcaagcattgagacttaggaatctcatcaaggaataccttgatacctgtattgctatatatatatttaatgagattaatctataccccaggcatccaagtttttgaaactttggacaaggtttaagctgctttacatttatactgtctggttgcatagggtaagctaaaggttgtatcaagataaca

SEQ ID NO: 176555 - DNA, 198 bp, Homo sapiens
ttgaaagaggaaaaaataaaaataaaaaactttattttcaaaagcatatacaggcatttctgcttctggctggcaaaattttcctatgatggctatatagatgtttgatataaaatcttagtctcggtatattgtggaatatgtcatgaagaacctgtgtagcttacttacaacaatggttttggcctttactccact

SEQ ID NO: 176556 - DNA, 339 bp, Homo sapiens
tattgtggagatactgaaaagtttttctgtgttaagcttagtaactacaagaagcaaaatatttagaggcagaaaagttggagacaactaaaaaaattaaaaacaagaataaaaccaaaatactatcttcagtcttcttttgctgaaggacctactaactaacgtacaattttgaggagcaagaagcaaatacataatgatcaaaactgctaaacaatatattcaaggggattcaatactacatacaagaccataagagaccttgaacgctttaatgtactgtacaaattgtgacaatgctcatctccacatcacagggctttttacacattgtgtttc

SEQ ID NO: 176557 - DNA, 194 bp, Homo sapiens
gggtcgaggggggtgcccatctctgctcaacagccttctcactgacaaggctcttcaacaaggtgtgccttattactgtgggcaacagaatcagtaaagcttcaaggaaaaggagtcactgtttagggcccacaccaaaagacagacccaaaaggtggctagggtgtgcagaaaagacccagatcccagtccca

SEQ ID NO: 176558 - DNA, 906 bp, Homo sapiens
aattgggatttttctgttttggttggtattggtggtggtatatcatactctgaaatatccagatctatttttgatgtctttcaatggcccaaacattttcagatctggaggagaccccatgaagtttgggacagcatccacgaaggaaaaggttgcttcctgctgattactcagttatagctgtttaaacagacgttcatgaattcaagtcttacagcaacactgcatttattagtcaatcacagacgctaaaattcacttccgaaatgtgaattagaaaatcaaatgccctttttctatttttttttcactttcttttctccctcatcattttcatttgagctataccatctgtcccagcctatcaaataatgtactgtgcatgcctggcaaaaacaagtggaacagtacacctcataaccccatgtaggcaaccactgagcatctataaaagtggtacataacagaatctggccatctggggataactagttatagcaagcttagcttctcagccagcactcagatttgcagacttttaactagttggcaaagcatcaaccagtgttcaagaagagaaacactaacaaacattttttttttcaaaacacaagaattcagatataaattttcaaaggtgtacttgccaatgttgctgacaagaaggcttcaaaagcaaagatcaaggcactgtcatgtccttgaaatggagccagagtcaatccaaatctagcattttgcagcattactaaactttttgggtatgaacatatttttccttccccatattgcctgaatatatacaagcaagggattaaagccgaacagactttgaaccaaatgacatagtacctttcagagacagctccagcagactgggaagagttcctcctaggactacattta

SEQ ID NO: 176559 - DNA, 477 bp, Homo sapiens
cccggcctaacaactctgttattaatatataccataaacatacatctggtggggggaaatcctctctgtaacaaaactcaacacccagttatgataaaaacactcaaggaagtagcaatggagagatacaatctcaacatggtaaaatgtatatgctttagtttcacttatggactagggaagctctagaggcatttccactaagatcacaaatgaggcaaggatcatcactatcttcactactgttcagtaatgtactacagatattagccaatgtagttaggtcgttaggtctacctggccaggtagacctaacaatgaatgcctctccgtgtccaatgagtaacaaggtggcctgggagagagctttaggacaaaggtcctttaatgtatagttttccccccaaataaataagcatacacttatttacagtatggacaatatatttttctttttttctttttcttttttttttt

SEQ ID NO: 176560 - DNA, 371 bp, Homo sapiens
ggtttgagcctcatggagtgtacaatctgcaacgagatcgtccaccccggctgcctgaagatggggaaggctgagggtgtcatcaatgcagagatccccaactgctgggagtgccctcgctgcacccaggaaggccgcaccagcaaggattcaggtgaggggcctggccgccgtagggccgacaacggcgaggagggcgccagcttggggagcggatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgag

SEQ ID NO: 176561 - DNA, 534 bp, Homo sapiens
gaattacaaataagcgaataggtatcaggtggctactgtgtgccaggcataactctaatcacatcatgcagatcaattggatcctcaaaataatcttttacactgatccttttattatctgaggaaactgactcacagtgagggaaagttgttaatttatccaagacaaaaaggctcgtaaaaactggaggtaagagttgaactcaggatggctgaattcagaatccttacctgctggcatatgagtgacttagccccctaacctgcccactctacttctctgtcaagtcctgttcactttgcctcctatgtcctactctttctttcaagcaggtcctactcttcttcatcccctcagctacctctagttccggccaccatttctatcatcttgaagtcctttaagatactctgttcctcctattttaaactcgatagatgtagtatgaacctggtcatatgatgccccgcctcggtggattgccatagcccttgggatccaggcaagactctttaatctggcccaccatacct

SEQ ID NO: 176562 - DNA, 1076 bp, Homo sapiens
agaaaatggttagggataaatagtagacccttcatggaaggttttcatttgaagcccagccaaaggcaacagggtctgccctttgagctcagaactttcgcaggccttaacgacacactgggaccttctttccttttccaaatggcttcagccttgcagtttggaatgatgtcaacatgtggcgtagttttattcaagtcccaagttaatggtttacctttttagaaaactccaaaaacactttcattgttatttaacttttgagttatgtaatgtctaagagtcttgtctctgacccgtgcacctacctgccactgaccaacagtttctcatttccttacgcaacaactagtctggctagcttagagttggtgtgtgattgtttgagactttatgtggaagataatatttaattgttttgttctggtttgttggggtaaattatacaaatggaatgcatcctttctcggccttgaaagaggttatatgacagtacaattataataaattcagtgtatgactttgggtacattctattataaacgaatttttttaaaggtgcagttagaagaaggtggaagaaaaaagaagttgacactccgattttccacatcatctaactaaaatggatttaaactaactttctctaactattaaatctttcttaggtaagtacagttgtatcccagctctagagttaatgtgctgggtgggtttttacaaataaaaaatctaaaacctaaaatagttgtgttttatcttctgtcccaatccaaaacaaaacaaaacaatcatgtgatagtaactaatctctggagatacctgacaagcgtggtccaatagtgacgcgggtttgtcactttggtctttaggtgacattgacagctggtgtggcatatggatcacactgtggtcattgaagtataatgttgcttacttctgagaagtgatcatggggccttttttttgagacggaatttcgctcttgttgcccgggctggaatgcaatggcgctatctcggctcactgcaacctccgcctcctgggttcaagcgattctcctgcctcagcctccc

SEQ ID NO: 176563 - DNA, 276 bp, Homo sapiens
tggagcctggctgtgtgtcaaaggcgagacattccatgctgcccaaggcagagaaagcgtcagcctgcaccaagcctcccttctggggccatcattacagagaaatgggaacagcagaggaaaggaatttggcagtttaagcacaggttttgaaattcctaccagtgagccgctatttgcttgaaagatggcaagaccggtatttccagagagagcaaatcctctgatcaatctttctgcacttttatttttgagtttcagaataatgggcaatca

SEQ ID NO: 176564 - DNA, 290 bp, Homo sapiens
tctccatcctgatttctaggactcctccttaacccaggactgagaatcctacctgccctcccttagcgagcacccagctagtggttgaggaggagattagaggcaggtggtggtttcttgttgttcacttgtaggaggactcggattctcgctatactgaactgggcacctcaaaaactccatctccctggctccccaactcctgtcatttggaagcaaaggtctaattaccagaatctccaggtttctggaactgccatccagaaatgattctgggagaatatctttgt

SEQ ID NO: 176565 - DNA, 428 bp, Homo sapiens
aacaatataaggtataaaaactatttacgtatcatttatattgtattacgtattataagtaatctagagatgcaccaaggatgtgcaaaggttatatgcaaatattataccactttacatcagggactgagcatccacagattttatgtccaaaggaggggctggaaccaatcacccacatataacaagggacaaccgtactttgccattagttgatagaaagctacctcactctcccccttcctcccagatatacacaatagtgcaaaaattacaaatgttaagacctcgcactttccttaaatttcaaattctatagcatatatttttctccagtttcatcacctacaaatgggaatattagaactacctcccaatattggtgtggtaagatttttacttaactgagaataacaaatccaagatgc

SEQ ID NO: 176566 - DNA, 167 bp, Homo sapiens
ggctgaaaaatacttaggaagtagtatcagtaggactggttaagagagagcagaggcaggctacaggggttggaggtgtcaatcacagagatagggaaaatgggaggagaagcaggctttgaaaaagtggcttgtcttgtaaaattatgtgctgttaaaacagtaca

SEQ ID NO: 176567 - DNA, 111 bp, Homo sapiens
agcaagggaaagagagggaattgtgggccaaatcctttattggggtccaaggtgttacctaacccaatttctcttcaggaggttttagttggtgtgtttagaagaaggaag

SEQ ID NO: 176568 - DNA, 215 bp, Homo sapiens
aggttggggaaaatggtggagcaggaagcaggaataatctgtctctccatgcaggtaatactggcagaatctgtcttacttaactccttctggagtctatagaaggcttgcaacttctagaggaaggtttggaatataagttgtggttaatttctgtcaatttcagcacttagcatagtagcaactacccatccctcaccacacatctacaaggc

SEQ ID NO: 176569 - DNA, 301 bp, Homo sapiens
gtagacagattttctgtttcttttgtgtcaattttggtaatttttgtctttcagagaatttgttttgttgttgtttattggcataaagttcatagtagtcccttatgttagttttctgttgctggataacaaaataccataaacttaaaacaacatttacttactagctcagcaatctaggtgtactttggctgcactcctttttgaaagctctgaaagagtctgcttctgaactgattcaagttgttggcccagttctgttccatgtgattgtaggcctgaagtctccaattccctgctg

SEQ ID NO: 176570 - DNA, 463 bp, Homo sapiens
gctgcatttatctcagaaaaatgttgaataatagtaggaatcctggttgtttctgactctgaagtttccttgttaattacaatgtttgttctaggttggcctgcctcttttatagttagaggagttattgatcacataatttgtaataataatatgattaacatgagaatagttgagagtttctactttttgagtatttgtggtgcaagtgtgaattaatgtaatacgttcattaaacaagtgagctaatgagaaatacaatttcaggcacaattatgaagatgttcccttttttctatgacagtaaatgcactttcttgaaagcctggttggaatagatatgacattataatgtaatgtaaatactctttggattgtaaatggtataaataatattgatgaaataaacaagttatagaggcagggcttcgtggcttacatatgtaatcccagcactttggga

SEQ ID NO: 176571 - DNA, 189 bp, Homo sapiens
cagttccctcctgggtggtcatttgggttgtttcaatctttgctattacaaataaagcttcaacaaataactccacagatatatatgctccttgacttatgatggggttatgtctcaagaagcccatcataaataaaaaacatcccaagtctaatatgcatttaatacttcaataaactcattataaat

SEQ ID NO: 176572 - DNA, 473 bp, Homo sapiens
cttggtattagggttattaatataatttttattaatttataatgttttatttattaataagacacattaatttatgtgtcttcttccccctatacccacacacccccatgctggatgtggtacagcaatgaggcgtgaagagaaaataagtctcaggaccactaaatcactaagccaaagggaaaagtcaagctgggaactgcgtaacaggcaaagctgcctcccatttaattcctaaataagatggctacaaagatttttaaaagctacatacctctctcacaattttctcactaggagattccttgtggtccccaagatccttaccctaaaacagttctgtcgaatttcacactgacaatgtaaattgatagatacgggagaaaggatagaactcaaagtcatccctcagctcaactgagacaaatgcatatctgattgcttcctttgccctgtgtttattttatcttatg

SEQ ID NO: 176573 - DNA, 101 bp, Homo sapiens
taggtgtcagggccatcacaaacagagtacagccgacccttaaacattgtggaggttagaggcgctgacccctgcacagccgaaaatccactacatctttt

SEQ ID NO: 176574 - DNA, 592 bp, Homo sapiens
ctatgtagaaaatgccagtaactaagctggaaagctattagaactaagtcactaagaggtagcaaggttgtagaatacaaggtcaacatacaaagaaaccaactttattccagctgggcacaggggctcactcctgtaatcccagcactttgggaagccgaggtgggaggatcacctgaggtcaggagatcgagaccagcctggccaacatggtgaaaacccatctctactaaaaatacaaaaaattagtcagatgtggtggcgggtgcctgtaatcccaaggtgctgggattataggcatgagccaacacgcccagcctggtgtttaaaaaaatacgtatagtcatgtagtcacctccccagtcaagatatagaacaatttcatcactctaaactcatcctggccctgtgtggtcattaccccccggttcccctgactcccgggcaccgctaatctgtttcctggcttatagatggcgttgtatccagtatgtgggctcttgggatctgagtacattttgagattcattcatgtggtattagcattgattctcatgtgtggctgagtaagtagtattccattgtatgggca

SEQ ID NO: 176575 - DNA, 415 bp, Homo sapiens
aactattagagtggctaaagtttaaaagtttgaccaagtgtttgtaagaaagtgaaagaactggaagtctcctacattattggtgggcataaaaagtggtacaatcactttggaaaacagtttagcagtttcttattcatttaccatcatatccagctatttttatttactaagagaaatgaaagcatttgtctataaaaggactttacacaaatgttcatagcagctttatttataatagtcaaaaaatgaaaacaacctaaatgtccatcaacaggtgaatatataaacaagcaatgaaatgcatgtttatcaatggaatactgctatataataaaaagaaatgaactatttgataaaactacaacatgaatgaatctgaaaataatttttctgagtaaaagaagcaaaacca

SEQ ID NO: 176576 - DNA, 338 bp, Homo sapiens
cccgagatgccaaggactgggggagaggggactgccactgatataactgaacacttagtatgttccaggatctgtgctgatgctttaaagcatcattgcagtgaattcctttacaaccccataaaggtattattatttccatttcacagatgaggaaagtgaggtccaaaagaattggcccagatatcagagatgactaaactcgggagccaggtccacctgacacacaggcctgtggccttttctttctagctcaggtatccctccaacacatggggaaggtgagtgtgtgccaggtggggcatggtgctctctggccccctggaatcatgtttatt

SEQ ID NO: 176577 - DNA, 407 bp, Homo sapiens
cgcagccatcatgttttcttggtgtgtttttagccctcatatgaaaagtgttatactgcatccacctttctgtgatatagattttccacccagcactatgttttaagatttatccatgaggattcatatggctctaatgtggttctttttgtttgtttgagacggagtctcgctctgttgcccaggctggagtgcagtggcgtgttcaagcaattcccaggttactcccaggttccgcctcccaggttcaagcaattctcctgcctcagcctcctgaacagctaggattacaggcggctgccaccacgcccggctaatttttgtatttttagtagagacggggtttcaccatgttgaccaggctggtcttgaactcctgaccccaagtgatccgcccacctgggcat

SEQ ID NO: 176578 - DNA, 467 bp, Homo sapiens
gtctttattttataaagacctataatttaacttttcctcctaatttccatctttcctggaaacaagatacaatattcacctgcttctcatggtctcatattctgatattctgtcagccacgcctccgcctctgctgccgtcgggctctgcactccaacggggccttgtcactggagtttgggttctggattcctgtgcttctctttgttttgttgatgtgattttggttttagtcactgcttactgagaatacaatcaaacgcgcccgtttatttactgaaccttgctttccatgtatccccgtgtgctcctcagtttgtatctcctcataggatggcatctctcaagtatcttttggaagaggaatcttgtggtcaacattctgtggtcctttgtactagggaattcctttctgccatcctcgtggtgcgctcggatctcgggccccggcgtgggctccgcggccg

SEQ ID NO: 176579 - DNA, 305 bp, Homo sapiens
cagggtggggccgtttaaaggccattctggaagtggcggagaggatgggtttagagaggtggaagtgaagtttggaggctccaggcataagcctgactcaggcccatgagaacatcaatggggtggaaggagagaggaaggttaaaggcaggaaccgaggcttagtgactgctgagatctgaatgatcactcaagtgaggcagggccctgatttctggtttgggtggccaagttgccgatggggaggttgcggtcaggtaggaaaccaggtacaagtttcctgatgggagatgggagatgacggg

SEQ ID NO: 176580 - DNA, 475 bp, Homo sapiens
tgttcgctcggcccctgccgggacctgcgctccccggggccatcccgggccctcccgagctccgggcgggtccagcccccacctcctgcggcccccgcggctgcagagctgcccgcgcctcggaggaaccaaaaaaagccggcgcgtggtgcacgcgcgagcggcgctgggccctggcgctgccgtttttagtgtgcctgtagcccagaatatagacttcatcacccccaggaaacgcggccataatatttttggttgcataagcaaacgaaattagaaacctggaacgcgttcaagacctttagatgcgagcgctcggcagcgcgggggaccagagaggagacagatggggattaggcgagttgagcatcaggacaataatttcctcttttaatttgggtttcatcgacaagtaaaacagcattagccgcccggttacgtaaccggcgccacagccggctctgataagcggccg

SEQ ID NO: 176581 - DNA, 308 bp, Homo sapiens
atatgaatgcatagcaggtctttctttacacaccagcattaccaagggggtctaccacacgtagaaaatcaatcatgagtccagcttatttaaaagaaagggatcttttccatctgacacctaatggcagcagcaataatgcaaaatcagctttaaaaaaattggtccccattgttctccattatttgggtctttgatgtatcctacattatgaactatcaaagcaaggcaatgcatccaaggtagggaacgccactaatgaaggaaacattaaaaggttatgctttccccccattacttttgtcttc

SEQ ID NO: 176582 - DNA, 222 bp, Homo sapiens
agaataatggcgtgggaatggtctttaacagatttccaagaactgcccttattgtaagaatattgcattatccaaccccttgtttaaatttactgtcctgacccaactgaaatatgaagccttcctgactctccttggcagatagtctcaccttcctttgtgctcctagaatattttgtttgtacttacagcattgtattttaatggtttatatgtgattct

SEQ ID NO: 176583 - DNA, 462 bp, Homo sapiens
gagctcattgaaaaagtagtacctaagcaaaagacatgaaggaagttagagtaagtcaatgtggcaatctgggggcaaagtgccccagagagagggaacaggaagcacaaagaccccaaagtagttgtgtatcttgcatgcctgagaacagtgggctgcgcagagggcatgagggggcagcagttgagaggaaggcagggaacaggcacccatcacaccaggccttgctgactcccaccaagacattggcttaaactctgcactgagcggggagtgagtggaggtttggggggatctttggtaccagaagcctccagttttcaaagtgtctttctcccatcccataggtttcctctttactctgctgattgtatccgttgctgtgcagaagcttcttagtttggtgtagtcccatttatctattttttgtttttgttgcttatgcttctggtgtcatctcca

SEQ ID NO: 176584 - DNA, 341 bp, Homo sapiens
  misc_feature (213)..(213): n is a, c, g, or t
  misc_feature (253)..(253): n is a, c, g, or t
cagcgggaacagacagtaagggcagtgctcacaccaggatttgggcctcttaagtaaatgtgaccttcactagtttatttaaccctaaggctcacctccctcatcagtaaaattgaggtcacagcacctcccccaaggcttatggtgacagtgaaggagctaaggcttgaatattcttagagccagcctgaccctgctccgctttactgaaancggcagcacagtagcacacttcattgaccttgggcgaccncggatgcagcagatgtgttcttgccttgcgaagatcctccaccaaccccccagtcgtctggggtggacaaccatttggaggagctgag

SEQ ID NO: 176585 - DNA, 140 bp, Homo sapiens
ggtgactctacaggatcccgctcaccgctccttagaaagtctataccactaatctttgcaacaactttattcccccttttccacataagtgagccacacaaggattctttttcttgcaatcaaaatgtagaccttatgca

SEQ ID NO: 176586 - DNA, 753 bp, Homo sapiens
acacttttctcattgctacgtggcatgtactctataactgaccaccacacaatcagacataaaacaatctatgaccaactcacagccaatatcatactgaatgggcaaaagctggaagcattctcctagaaaacttgcacaagacaagaaagccctctctcaccacccttcttcaagatggtattggaagtcctggccagagcaatcaggcaaagaaagaaagggcatcccaatagcaagacaggaagtcaaactatccctgtttgcagatgacataattctatgcctagaaaaccccatagtcttggcctaaaagctctcttagctgataaacaacttcagaaaagtttcaggatacaaaaccaatgcacaaaaatcactagcatttcaatacaccaacaacagccaagatgagaggcacatcaggaatgaaatctcattcacaattgccaccaaaaaataaaatacctaggaatacacctaaccagggaggtgaaagagctctacaatgagaattacaaaacactgcttgaagaaatcagagatgacacaaacaaatgtaaaaacattccatgctcaagaattgaaagaatcagtatgattaaaatggccatactgcccaaagcaatttacagattcaatgctattcctatccaactaccaatgacatttttcacagaactagaaaaaaaaactttaaaattcatatcaaactaaaaaagagcccaaatggccaaagcagtcctaaacaaa

SEQ ID NO: 176587 - DNA, 460 bp, Homo sapiens
ttggaaaaagacttacactgtgatatttccagcagtagacaacattttaggcacttggacgggcagatgacctcatgcaattggaacttgagaagtacacagacctaggatccctcactctcgtaggagagccaaaacagcagggcacaagaggggaatgagtcgatattgcctggtgttgatgccgggtggaaactttagagtaactgtttagaaagaagaaatattcctcgtttttcctcccagtgttgttggtgtggcttctaatcttaaaggcaactcactgctggagtgagcctggtagggataggaaatgagaagagaaatgagcccttgtctgtaaatacacgttttacttcttcattgctggacactccagatcactgaacctcagggaactagaaattcccaatgatgggtcagcaactatgctctttgctaggtttgtttaaaatactca

SEQ ID NO: 176588 - DNA, 592 bp, Homo sapiens
gtggatatggtggcgtggggatggctataatggatttggtaatgatggaagcaattttgcaggtggtggaagctacagtgattttggcaattacaacaatcagtcttcaaattttggacccatgaagggaggaaattttggaggcagaagctctggcccctatgatggtggaggccaatactttgccaaaccatgaaaccaaggtggctatggcggttccagtagcagcagtagctgtggcagtggcagaagatttaaattaggaaacaaagcttagcaggagaggagagccagagaagtgccagggaagctacaggttacaacagatttgtgaactcagccaagcacagtggtggcagggcctagctgctacaatgaagacatgttttagacaaatactcatgtatatgggcaaaaaactcgagaactgtatttgcgactaattgtataacaggttattttagtttctgttctgcggaaagtataaagcattctaacaaagggttttaaatgtagatttttttttgcacccatgctgttgattgctaaatataacagtctgatcgtgatgctgaataaaggtctttttcta

SEQ ID NO: 176589 - DNA, 347 bp, Homo sapiens
ccagtagactaacgaggggaggacagagcatgaaaacaaaatccatgcaaatgaaatgtaattggcacgaccctcacccccaaatcttacatctcaattcccatcctaaaaagcactcatactttatgcatccccgcagctacacacacacaacacgcagcacacgcatggacacagcacacacacgagcacagcacacacacaaacgcacagcacacacagcacacagatgagcacacaactcactacacgtaggtctagctgggttaggtctacctgggtgtctctgcatcttgtctctcaccttcaacctttctaagtgggaaggaatttgttaggttgattat

SEQ ID NO: 176590 - DNA, 2005 bp, Homo sapiens
  misc_feature (613)..(613): n is a, c, g, or t
  misc_feature (1784)..(1784): n is a, c, g, or t
  misc_feature (1978)..(1978): n is a, c, g, or t
ctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctancatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcagagcctgtttcctcatatataaaataatggggatcctaacagccccctcatatggttgtagcaggaatttaattaaataatatatggaaaagcatttttttaactgtaaaaccatacataaatatcctttgtcacttttcccagtgcatgacacactgggtcattaaacatctattggatgggtggatggttggatagatggacagacagattaacagttagggggccagtatgagtgacaagaggagaacttggcatatggaaagcatgatggaagccagaaaaaggagagacttcccagaagtaggaggaggcttgttgattcatccacagtgtcacatgcagtagagcaggcaggagaatgaggggggaaaatcatttaacctgggtggaaggaaatcactggtgacctccagctgattcctcctcagccttttcatgttatctgggctttcaatgacatgccttaattgtaacttaatcactttactgatttctatctttggggggggcggaaatcaaattgatttgcacatatggcaaaattggtaagattactccagctgctgccagcaggtgctgacaagtaaagaactgaatgtcagagaataagaaaatacactaaacatttattttaataaggcctagaaaccttagttatttaataaattgccatggataattggtttcagtttctagagttgtttcatctttaactccctgtgttccagaaggaatcgtgctggatgtgtagacagggccttgtggtttgagacctatctgagctatcacacatttctctgagcattttcctgtctctctgatcacaccccacttcctgccaccactcccagcatccacctgggataggtcactctgacatacacacacacacacacacacacacacacacacacacacacactcactatccaagctgccagtcttcttattggctcctcctccagcgaggaggnttaagcctcacctccctgctgggccctgatcaagctggtctgtttgtgtatgaatcttgggagtgagtggcccaagctggatctgagcccagcatttatcatctcagcgctgcctcccacagaagaaggaagacataatgaataaatgaaaccccatgactgtatcaacattcatcaacccattactccaaacntggctgataaaattgggtacctggatt

SEQ ID NO: 176591 - DNA, 250 bp, Homo sapiens
tccaacaaacgctcctcaatttcaataatttgctagtactactaacagaactcagaaaaacacaagtttgccagtttgttttaaagaatgacccctataatcccagcactttgggaggccaaggcaggtggatcacctgaggtcaggagttcgagaccagcgtggccaacatggtaaaaccccatctctactataaaaatacaggtgcctgccaccacaccccgtctctacctgggttaggtctacctgg

SEQ ID NO: 176592 - DNA, 614 bp, Homo sapiens
tggttgcaccactgtattccagcgtgggtgacagagtgcgactgtgtctctaaaaaacataatgttatatctcacatcaaagttgtataatttcttttgatacataatgttacttcctttcagtataagaatatcactgttgtcctagaccaagattctttgctttccatattattttcaagtgtaataacatgtttctgaaatacatcttctttgtcactagagccattagcattaccactatgaacactaacggtgaaaaagctctccaactgtttaagtgtaagactttgcaaaacaaacttgaatacggctgcataatttgcctttctccagaaaagcctattaaactttgttggcattggatacaaaataaaattcaaaaatttgcattttcagtacttttcgtttcttgacctttatttgaatttgagactaagctttaccaaacaacagaatttacacagtaactagccaaccacagtcctcattatggaatctatgcagtgcatttgttacctaggaaacggaccagagcacaggcagagtgcaatttcagtctagcaaaagaattctccaatcatgctagtaaataaagtccataaatcaactaa

SEQ ID NO: 176593 - DNA, 232 bp, Homo sapiens
tggatgcagtgtgggctgtacgtattacctggacatgactgtgacatggtgtgtatgtgcatgagcttgggagtgagtgttcacagtgtgagagtgtggagtgagtgttcacagtatgagagtgtgcactgtgtatgtgtggagtgtgtgcgtgcgggtgttcacacctgcgtgtgacatggtacacacgagcgtgctcgggtgagtccacacagtgtgcgagtgtgtactg

SEQ ID NO: 176594 - DNA, 367 bp, Homo sapiens
ccttcgaagaccctgttctcacgtcctgatagatttgtatctgtttggtcgacttcctcatattaaagctgttgaaggttagaaaactatcctttttgttctaaactagttctagcctagggttggtaattacagagtgattcctgactattgtgtgaatatgtcatgtgccatgttcccagaagattcttactttatgtccaccttcttgccataataaccgaagcttccttcttctcctgtattaaagatctgcctccactataccacccctcccctcagtggacctcccactggatgccacctaccagtttcagaaatacagcttgcatttccccattctgtcctcttttcctacccttccccg

SEQ ID NO: 176595 - DNA, 322 bp, Homo sapiens
tgaccatttttttcatgtctttattggccatttgttcattctcttttgggaaatgtctattcagctcttttactctattttcctattgagtttttaaaatatattctggacataagtcctataaatacataaataggcttcctttttttaagagtctcactttgtctcccaggctagaatgcagtggtacaatcatagctcactgcagctttgaactcccaggctcaagtgatcctcccaccttagcctctcaagtagctgggacctataggcacatgctaccacgcccagctaattttattttttgaggtcttgctatatt

SEQ ID NO: 176596 - DNA, 550 bp, Homo sapiens
ccttcaaaagatagggcctgatctggacaggacagtttgattctcaggcccaggagcagtagcaagggagcctctgttgcccagcaagatctggcagtgattcccctacctccatctccagccaaagctttgaggagggaaataaggcctagatgtgtggattggtggaggtatgggctgctccaactctgattttattataggtcatgggcccagcctccagtcgtaggatactgagctcctacccctgccatcccctcacagtcccctaccacctgtgttttaattcccatcttccagataatccttctcacttgtttaggccaaaaaggtggagcctagttgctggagttggggaaccagcagtcactttcctgtgggatctacccacacttaaagagtggagtcatgccatctcaggacttggaagagatcaaagagatcaccactccaactctctcattttacagatgaaaaaactgagagagataggcaagtgagatctgcaagattactcaacgttaggagtagacacacacgcacacacaca

SEQ ID NO: 176597 - DNA, 502 bp, Homo sapiens
gtgatgtaaaaaaggccaatgaagaaataaatcactttgataaatacctatgtttaacagaacatcttaggaaggtcatccttaaagaccacgtgttaagttggctgagtatcaatacaatgagtatgcattgattcacaaggaactcatgtccctagggctccagtttctaagagtggtccacagtggtagcttcaagctgaactctgaacgtgaaatgaaatcctatgtcatttgaattttttcttttttttttttttttgagaccgagtctcgctgtgttacccaggctggagtgcagtggcgcgatctcggctcactgcaagctccacctcctgggttcacgccattctcctgcctcaacctcccaagtagctgggactacaggcgcccgccaccacgcccggctaattttttgtatttttagtagagacagggtttcactgtgttagccaagatggtctcgatctcctgacctcgtgatccacccaccttggcctcc

SEQ ID NO: 176598 - DNA, 272 bp, Homo sapiens
gggattacaggtgtgagccactgcgccagcccagaagggatttttaaaattgtcactttgtttgttgcatctgcgtctgcaggtgtcagccgtaggtgtcagggatgcagatgtaggtgtcaccccctctcacaggccatgtccgcggcttcacagagcacctggccattcacacacggagctcatgcttcaggtgggcagagaagctgtgtgtgaagcgatttccccataagagagtttttctctcttcatggcaggccaagaaacccagg

SEQ ID NO: 176599 - DNA, 133 bp, Homo sapiens
ggttttctactttttcatttcttaaactcaagggaaaacatgggtgaaaaacaaaaaattgttctgcatagagtcttctttaatgtctcactttggtgatgtatgaaataaaaaccaaattgttttaaccagc

SEQ ID NO: 176600 - DNA, 297 bp, Homo sapiens
ggaaaggcagtctcctctggtggacatgaagttctagggtatcctcaggaaacatctggggagtcaaaaataacaaggactggggaagttccagtcctggaaatgccacaaaatgtgaccagtacttacctctagtttttattaaagtagagcaaggtctccaatgtcacgatcttggtgatctttcttcttgtttactgcacaatcttctagtctatagctcaattcccaagaacaagtctcagcaggttccccactcttcacagagacccagttccacaggcgtcagtatagata

SEQ ID NO: 176601 - DNA, 234 bp, Homo sapiens
tacattgaatatttaaacatgtttaaaaagtataaatcaaaactgagaaaatccctcaaaagcatataattgcatggaaattaaacaaactgcttctgaatgacttttatgaaaatgataaaatgaaggcagaaatcaagaaattatttgaaactagtaagaaaaaatatacaacataccagaatttctaggacacatctaaagcagtattaaaaggggattttatagtgctaa

SEQ ID NO: 176602 - DNA, 402 bp, Homo sapiens
gcctcttgaggatcccctgactcttcctgccccatgagagttgaatgttgaatgtttactttatgtctacttaattggtttctgagtgcagctttggctgagtctcataatacgaaatatagcgtgataattttggttatttttaaacctacttgtaaatgaccgctattattatttctcaccactctggaattctgtttttggtttcttttttggtacgttgcttatttaggaaagagtttcaaaatcgtaagaaactgatttttttttctttttatcttcttaaacttaggtcattggagattttttttctcctgactttattgctgtggagtcggacattacaactttataattttactattttgcatatatggagggttttactttgggcacgggatg

SEQ ID NO: 176603 - DNA, 676 bp, Homo sapiens
tcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacactggatcacacagatatgaatgactagagactatgcttttgagaagttttgatgtgaaggggagcaagaaatggactggtggccaagggcacctgaggagtcaagggagtgttttctttttcggatgaatgaatctggagtgtgtttgaaaacttggaagtggtgcagtagagaggaagagattagttttgcaggaaagagaggggataactgcctggaattccttgaggaggtggaagagggtgggattgctgtggtgcaaaggtgtggcccttcacaggagcaggaacacctgattagtgaagacagtggatgaagatgcaggtaggcagatacatttggtgataggaagaggggagagtatttgtctgatgagcaaagccaaaggaatattgcctttacacactatcttttctgatatagggaat

SEQ ID NO: 176604 - DNA, 405 bp, Homo sapiens
ctggaggagaaacagcaacaatgaaaagatgcctcttcatgaagctaccatcacactgcacagtcactaagtgcaagattcgggtcgtgcatgtaagtcaacaactatttcaactctctaggatgaatttctcctagagaaatgtagtaaaaagcttccagcaccagaatcacctgacatgcttgtctaaagaaaaaaaacaaggccaggcccggtggctcacgcctataatcccaacactttgggaggtggaggtgggtggatggattgaacctgggaggtggaggttgcagcgagccaagatgacggcattggactccaggctgggcaacagagcatgactccgtctcaaaaacaaacaaacaaaaaaaacgagtgtcacctggggctacttggccagacaca

SEQ ID NO: 176605 - DNA, 335 bp, Homo sapiens
cctggttaacccttcccccacaggaggacatatgttttcatttcttttttcatatatagctagcaatggaatatcaggttcatatggtatgtctttttaacgatttgagaaattgcccaactgttttccaaaacagctggaccagtttatattcccctctctacatagaagcgttcccatttctctacaacttcaccaatacttgctgatgcatataagggttacttataagggttacatataagggtacgatacttgctacatataaggattcccatttctctacaacttcaccaatattatctgactttttgccaccccagtgggtgtagtct

SEQ ID NO: 176606 - DNA, 470 bp, Homo sapiens
tgactctgtgtaggagttcaataaatatttattggataaatgaataaatccctttttttccttttgttttaacatttgctttttaaaaataatgggaagataattataacacctttctgcacttcggcagttgtaaaatatatatataattttaggtatctttttggaaaatagactattttttagagcagtttcggttcatagcaaaattgagaaggtacagagattttccatatcctttctgcccccaaatacacacagtctaagtaccttttttgcctttaaagtagggtttgaaaaattatcccttctctgttgttcattctacttaggcatgatatgtgtacatatctttatataagaacactttatagtgtgttgaatttttttccctagtgtgtcgaaattttaaactagttttttaatcttaaagtaacaaattattaacagttccaggtattggataatta

SEQ ID NO: 176607 - DNA, 333 bp, Homo sapiens
cttttttccttacttcccataaccaaatcttatttaattgccaaaataagattaaaacttactccctcccttcatctataccttattttagatccctttctcttcttgctaagtcgtaagttactaaattggcatttcgtggcaccagttgttaggcactcctattaaaaaaggattctataaacaagtatatttgagaagggctgcataccatatgcctgtcttgaagactcagaatgaacattagcctctagcacccttgagaagtactactgtaaagaaacctgcggccaggcatggtagctcacgcctgtaatcccagcactttgggag

SEQ ID NO: 176608 - DNA, 249 bp, Homo sapiens
tgataatgctgaatggcataaataagaatggggcggacagcggggtaggaaataagaaatggggaaggaatttacaaagcagaaatcacatttcaaagtaacatttaaactttcaaaggagatatttttattctttggactccattgtgagacaagaaaaatcactaatggatggtataccctcaggagacttttgatatattattgaatcaaaaagaaaattattttcttgtaaatgattccctataa

SEQ ID NO: 176609 - DNA, 173 bp, Homo sapiens
atcacattgtgtgacaactcttagaaaataggaggtatacatagttttgaggatggtcatacaagattcttcatatttcagtcaactatttgctaaagaaataacttggaacttaaaaaaaaaatttttttttctctgagatgaagtctcgctctgtctcccaggctggagtg

SEQ ID NO: 176610 - DNA, 497 bp, Homo sapiens
aaaaatctgtcgtctgtatttgcaacacctaggctggagctttgagcgtggtgggcggatcaaaaactgtttaattggtaggtagtacaacagaccccaaaaatgtctgacctataggtatttaatactattgtagcctatctcagtgggaagtgaacaaaacaatataacttagggtcttaactaacaccaccacttagggtcttcccaccacatcctggggattagaacatgggttcttccatcaacagcctgaaatagcactgcagctgcagtgagggggtgcaacatatgtactggcaagtcttcccagcaaatgctacttccgccccccactctcagcccactgggcagggcagccatctagaggaagactgtggcagggggttgggcttagaaatggcttcctaggtggctgatttgccatcatttattgcaagccactggcttaaaagagttctactgagggtagttcatagtcatgcacctcctgtgca

SEQ ID NO: 176611 - DNA, 347 bp, Homo sapiens
cagtgaagagcagccaagtgcggctgtgtggccctgaccaagtcatttcacttcaattttatgctttggctttcacatctttccacggacgtgaatggagatgatcatggtgccgaccccaaaggatccttacacgtcttaaaaaagtgagccacggaaaggcctcagcccagtgcctagcagagaagcagcacatgggagggaaggaacgaccagagaagacccgtggtgtgccaggcactagacctggggctcggtggcacatgtcagctccttgcaagtgtgaaacaactggagtgcagcgagcatcagtaactcaccctaagtcacacatctggtaaacagca

SEQ ID NO: 176612 - DNA, 352 bp, Homo sapiens
ttttacaatgaagactagagcttggggaagggtggtttttgttgcccatgcttacctgaaattcagaaaacttatcttgaaggagccagagccagttggtatatctctgagaactgtccttagactcttagctgggtggtgttttcctagtccttgtgtaaaaggataaagatggtggaatgtataaggtaaagtgtttttaggatatacgtatctgggtgccacaaagggcatgagtagggaacagtgaaggataagggtgaaaccattcattgatcctaatcatggaaagccttgaataccaggcttagaagtttggattttctcaatgtgcaaaaatcggtagcatttc

SEQ ID NO: 176613 - DNA, 323 bp, Homo sapiens
ctctatggtaggcggagaaacccatagtccagcgtttactgtttccacccaggaaggaggtgaggtggcctgagagacagactcttccatgggtggtgggctcaagggcacagacattctggagggtgaacgccatcatttgtacagagggatacgtgggttgctgaggactgagagagccttgcaaggccgctccccttctccccagctgtgaccagggctgtctgggccttgcctgcctcagggccagactgaagtggaggtggagggatgctgggctaggcctcaccaaggttctggtagaagtggtggaagtggataaa

SEQ ID NO: 176614 - DNA, 460 bp, Homo sapiens
ttttacccacacaaatatattacatgtcattatcctgaaatctcactacaatacatctattctaatattctccctctgtttaaattgtcctgcctctctaatatttaacttcacattatcaatacacatagagaaatacattaaacccaaagctccgaatgctcaaatacattttgcaaaacaactcaaggaaaagtcactccaagttcactttaaaataactggttaaatccttaaagtataagcaaagcacaatttttctatatggcttcagataactttcattttgtttcctactagactaaactccataatggcaagttcatctgttttgttcattgttttgtttagctagtatgcaacatacttcccagcacatagatgttcaataaatattttctaaaggaatagatattctgcgaatcttttaagttctgaagtaagcaaacagcagaagtat

SEQ ID NO: 176615 - DNA, 431 bp, Homo sapiens
atacacttccctattgagcgtaacaacaggcatctaaaaaaaaactcatggcattctggctatacaggaaatcacattcagagactaatctgtaaaaactacttcaatagtacattatagtcaattagtctattacatgaagttgatattataaactctggttcaaatcatgtccttcatgatataaatttccacagtatcattttcattttccacattaacaccttaaaatgtgttcatctgtgtaaaactcctttctctcctactaagcaataagctgcttgtgaatgggtacatcttactcctttctgcgtctaaagcacatagaaggtgctgtacattcagtcacaaatatttactgagcaaataccaatatgccatctataccaaatgatggagtatacaaaggtaacaaagaaaaggtccctgtg

SEQ ID NO: 176616 - DNA, 443 bp, Homo sapiens
ttctatcttccttccttgataaatatatatgcataatgacctggaaggctaggtctgaatttggaatattcacctccagatttctagttaggaactgggcagtgtgtgaagcgttgcctctccagccattatcttcccctcttctctcccacctctaaatttattctgcagcacaggtagcctgttgtttacctgcatggacacttcagcttgcatgtccaagctctgtttacctctcctgcatcagtgtccttggccatcttcacctaggatttggcacaggggtgactcagtttacccccagaaggcaggccataaaagtagtctgaggctgtttaggctaagaattctggagatgatctagagggggtgacagactttacttgagcaagccccatggactccctgcccatggttgaggtcaatggcctgaggacagctag

SEQ ID NO: 176617 - DNA, 449 bp, Homo sapiens
tctagttagtaatttgtctaaccttttttcaaggttcttagcttcctttattatgggggaaggaattaaagaggggaaaatgtgattctgattaaggcaatatactcagactatttaggtttagatgacctgagtaagcaaagggaaattacagtccagctttctgtagtcctttccagagctaatttgaaggaatagaaagggttagaacatgctcctttagctcggaggagtttgttattacccaccttttgaagcctacttctgtcaattcatcaaattcattctccatccagttttgttcccttgctggcgaggagttgtgatcctttgaagaagaggtgttctggttttgggaattttcaggctttttgcactggtttttcctcatctttgtggatttatctacctttggtctttgatgttagtgaccttcagatggggtttct

SEQ ID NO: 176618 - DNA, 492 bp, Homo sapiens
attttttagcacgtgaacagatcctgagactaaaaagtttgaaaactagagccctaagcaaagcatataggacaaccaccaataaattgaccatcaaccgaaaagtataaatgaccactctcaggaaaaagataaagcaagcatgaatacactaagacaaaccaaattaagaagagggaaaaaattaatacaattaatgtgaagaaacacagagatggggcatataatcactcaaaaagggtttgagtgatcagtgctttatttcttaaagagacaaaggaaattccatgtatctttataaatctttaatatttctcaaatttatccaaaggaccctagatgtcaaagaacaatcttattctctacaagtctatttgactttgaaacccgtatttttaaaattcacacaaatttcaagttttcttccataatatatctattcatttagtatttcttaaatgtcttaaattacttaccatgaggttcaaattt

SEQ ID NO: 176619 - DNA, 677 bp, Homo sapiens
ccttgttgtaaaaaaaatggtatggtgtattatcaagcagagcgatggaatcattcaaaactatacttgaactctagtttttcctattacctgtgaaactttaaatattcaatctcctagtgcttcagtttcctcatctgaagatgctaataacacaaactacctcacaagattttcatattatatgtaattgtatgtaaagcatctagaaaatagtaagagttcaataaatggcagtaatcaaccttttttaaaaaaatttaacttcaagggatggaaaaagtaatcaaaagttggcctgcaaatcccagctctcaagtgctggggaagaatcctttaaagctaacagcaacagattgctgctctctttggaacatggtccttctgttcatctgtctcatggaggagtaccatgcgtggctatgctatacttaaccaagtgaaaacataaagtgatgttcaaaactggtcataactggcctatatatagcttttgccagaaggtccccaaagttcttaattgaacgtcttctcaaatactgcatacatccataatattgcgctgacactgagcatgtctctcaaagtgttttaacaaatagaatttcgatgaacatttcctaaatataccttcagtttcataaagtcaaggcatgaattggtgggggggcgggggg

SEQ ID NO: 176620 - DNA, 260 bp, Homo sapiens
caaagtaagataatgcagtgtgagtcatatgtccatggctgaggtgctttggagtaatggctttgggatacaaaagaccataaatcaaggatggctcttcaatggataaaaatatagagacagatgcctgacgaaataatggtggaaaactggaaacagggagaaaacataatgggcactcaaaaaataacaacttattttttaaaattttcttcctctttttggacctcagtttcctaatatataaagtggaatgttgt

SEQ ID NO: 176621 - DNA, 236 bp, Homo sapiens
agttgtgggatattaagcttttatcagatacacattttgattttatcagatacatattttctcacatattatgggttgtcttttcactcccttgatagtatcctttgatgcataaagggttttttattttgattcaatctaattttcctgtattttcttttgttatctgtgcttttctgtcacatttcaaaatacacttaaaactcaaaggtcataaaggtttaccgtgtgttttc

SEQ ID NO: 176622 - DNA, 144 bp, Homo sapiens
gtctcatcactgacatacacacacatgccttcaacgctcacagcagctcggtcacaccctgtagcacacacaccatccctgctgtctcacagtgacagacacacaccatcccggccagttgtcacatgctcacacacccacacc

SEQ ID NO: 176623 - DNA, 336 bp, Homo sapiens
ttgtttcctagaacacttgcttttggagccctgggctgccatgtaaaggttctaactaccacaagatcactggatgagctgcatacaagcactctgtagggcatttctgctgagcctagccttccagcaattctcaccaagtctccagacacatgaactacaccatcttggactctccaaatcagcccatccaccagctaattaacattgaatgacttctgtcaacaccatgcataatgcagaaaacccaccagctgagccctgcccaaatccttgacctaaaaaaaattataaaatacaataaaacagctgttgttttaagctattaagttttga

SEQ ID NO: 176624 - DNA, 766 bp, Homo sapiens
agcaacccctccctattaatccactaaaccttactgtttagttttctccatctgtgtcaatggcaactccatccttccagttgttcagagcagataccctgaagtcaccctcaatccttcgcttttttttttgtttgtttttttgtttgtttgtttgtttgtttttttgagacgtagtctctctccatcacccaggctggagtgcaatggtgcgatcttggctcactgcaacctctgcctcctgggttcaagtgattctcctgcctcagcctcccgagtagctgggattacaggcgcccgccacctcacctggctaatttttttgtatttttagtagagatggggtttcactgtgttggccaggctggttttgaactcctgacctcaagtgatcctccaccttggcctcccaaagtgataggattacaggtgtgagacaccttgcccagctgatgtttcactttcacaccccatatccagtcagacaaaaaatcttgttggctctacctttaaaattttattaagaacctgactactctcctcctctgttataataaaccttgtgcaagccaccactatctcttgtttggataactgcagtagcctctgtggtggacacttctaaaatggcccccagtgatttctgccttctggtattcacacctttgcataatcccttccctttcagaaacagctggacttagtgactttcttctaaggcatagactatgacaaaagttgtgggatgtacttctgagattagagt

SEQ ID NO: 176625 - DNA, 977 bp, Homo sapiens
tcaagcagttcacctgcctcagcttcctgaatagctgggatcacaggcgtgtgccaccacacccagctactttttgtatttttagtagagccggggtttcaccatgttggcaggctggtcttgaactcctgacttcaggtgatccgcctaccgtggcctcccaaagtgctgagattacaggcgtgagccaccgcgcccagctggggttttcctaccgtggttgtaaaaattcatttcttgtcgccacctagattaacaaatctcagattaagaactggccttttttcgcctcctctttgaattcactgtctaaagaaacggccattgccctttccgtaaaccaggacagaggtcatgtctgctttgcctttttgcaccttggcccctgcctgcccctcacctccccactcagctacagtgactggaagggcccacacaggaaagctgggccctgggtcttcatggacgttgctggaggatgtgtctccctgctggtggctctcagtcttcctgtgctcagtagggccttctggaggattctaatttccctgtcctggaaaccaccttgaaaatattcttaaatattcttaggtggatttaagatgtctctgtctagtggttttttgtttgtttgtttgttttttaatccatcttagatttgaatgcccaaggaatgaacagtctcttggatcttgtatctcttccttttgttttttagaaaatagcttttattgatttttttttcttgctacaaagaggttgatgattattgcagaaaatttagggactataagtaggcaaaaaagataaaaaccacctataattattaatattttagtatattgtatagcccccccagaatatttttcaatttcaaaagatgagatcatactgtttgtaccatcttattactttttctttcttttttttttttttttttttttgcttttactttacaacatgtgattaaaatttcc

SEQ ID NO: 176626 - DNA, 433 bp, Homo sapiens
gactctaacgatccctgtggcctgaagcctgtgaagattcagtgattgctccacactagagtagttggagaagctttcttaagagaacataaactttgaattgcacatgaacgtagggatcataggattgaaaatgagcaaggaaaccatgccaggtgagagaatagcaagaggcaaggctaaatatggaattaattgctcagtttattcagggtataattagtaaaaaatattaaggcaggatggaaggaagtgagtgatgtttagaggaataatgatggatatgccagatagagaccaaatttatggaaggctttgagtgctagaccagggattttggatttgattctgcaagtaatggtttgtcatttagtatttttatgtagatgaatggggaagcagtgtataaaatgatttggaggagtgcctgacc

SEQ ID NO: 176627 - DNA, 358 bp, Homo sapiens
agaaagggtcaagaaaaaaaaatcactggtgacatttaattactaagattaagaactatcaaaccttattagtggtattttgactaatattaacgaagatcaagttatttcagctaatttaaaaaatatttatgaaacacattccagcttctgtaccaggtatggaagatcaaaagataaataagacatttataagtttacaaagaataaactgctagaaatgtaaaaataatctttaaagtccttctttgctttaaaattctatgattttaagaaatccctgacttaagtgaaatgaaaccaagctgacaagtgccttcagtgacaggaagtgatattctaggaagtgattacgatg

SEQ ID NO: 176628 - DNA, 471 bp, Homo sapiens
tggtactgcatgaaaagttattaaatgaaaaatattctcataaattatagtgaaaaaattgatgtattttgttataatccaagatatccaatctgcacagatagaaaaatcaataatgagaatgtataagaaacaaatactgtaaaggtgaattgatttgagtgtaaaatgtgacgtgatgaaggtttgtcgtgtgccccggaggaaaacggggaggtggaggggctgctccgcgtgaggcacgttctgctttctctcctgttaccatcatcagtgtcttgatccttaaggaactgtatgggtatctaacacacacacaccgacgtagaaataaatcagctgcatggttatctaacacaccaacgcacaaatcaggtgcatcggtatctaacacaccaatgtagaaataaatcagctgcatgggtatctaacacactgatgtagaaataaatcagctgcatggttatctaa

SEQ ID NO: 176629 - DNA, 410 bp, Homo sapiens
attcccaacccatcctgctacctttgggactttatacctttcaaccctcaaatatattcagatcccccatcctaatgcacattaccacaatcttaccatctcttttagcttttgtcttcctatttccttcattaaaccttctgaggcctggtacagtggttcacacctgtaatcccagcactttggaatgccaaggtgggaggatcgcttgtgcccagaaattcgaggctagtctgggcaacaaagcaagacctcatctctacaaaaaaataaagttacccagtcatcttgtgcacctgtggtcccagctacttgggagtctgaggctaaaggatttcttgagcccaagaggttgaggctgcagttacccagcttgggtaacatagtgagaccttgtctcaaaacaaaac

SEQ ID NO: 176630 - DNA, 997 bp, Homo sapiens
gctttctctgtgcccttcctgtctaagcatagaaatgtagggacggggctgcaaagacactgagcactgaagtggcagtgagacggcaggaagcatgacttggggaattctgtagggtcagcacagccagccatcttaaaaaccttacctggggccaggcacagtggctcatgcctgtcatcccagcactttgagaggccgaggtgggaggatcgcttgaagatcacttcaaaaccaacctgggcaacatagacaccatctctatgaaaaaaaattacttttttttttttttttttgacagagtcactctatcacccaggctggagttcagtggcgtgatctcggctcactgcaacctccacctcccaggttcaagcgattctcctgcctcagcatccctgatagctgggattacaggtgcgcaccaccacacttggctaatttttatatttttagtagagacagggtttcactatcttggccaggctggtcttgaatttctgacctcaagtaatctgcccgtcttggcctcccaaagtgctggaattataggcatgagccactgcacccagccctgcaaaaaaatttttaaaagttatccaggcatggtggcacatgcctgtagtcccagccacctgggaaactgaggcaggaggatcacttgagctgaggagttggaggccgcggcgagctatgatcacactgccgcgctccagcctgggtgacagagcgagaccccatctggaaccatttttaaggaccccataagggggacttttgcatggtctgtctctgttattgattttttattagcacaatggtgtccttaaggtcttagggaccaaactgataaaatcagtcacgagtcccacggtgtttagtggtgtcttttgattttataattttttactttttatcttaagtatgtagaaccagaagagacagtgcctttttatgtttttggttttgtagcacttttgtttgttcatgttgggtc

SEQ ID NO: 176631 - DNA, 704 bp, Homo sapiens
ggaatgacgggaaccgtcttgaaatcccagttgccaaacaccaacggagggccgccttgcaagctggcctttctaaggatagcagtcaggcctcctgtgttaattctttcttgtgcaatagggaatgggaatttatgttaagcttaccacaaaccatagtgaccagtcaaaatattttgttaaatttgatgattgtgggcctaggcataagggggtatgggtgagttgaatggtactttctggggcctagagatcaaaggaatgtaatttgggcaataatcctaacatttagatcccagcttggtgttacaatatatacttgtgaatttagaaaaaaatgaagtttcagtgggccattggtgtatatcttttgtacctgattttgtcctgaccactgtgctgggtataggctgtaaaatggtgaacatgtatgtctgtgttcctgaagattatagtctagtggaggagagagatactaaatgaatgaacacagaaataaaactataattacaaaaataaaactcttttacaggaaaagaaaacattcattttctactcaatacagtttctttatatacctggtttatggtagtaaaacccctaagatgagacagagcttgggtagtgagctttgacgcagccaggagatttgtgtggcaggagccagtgaatgggggagagggatgagggtgttaggttagagt

SEQ ID NO: 176632 - DNA, 1044 bp, Homo sapiens
ccagttccttttcaacacactgtattaggaaaatgttattttaactgcaactctgttttaaatttttttttaatttgaaaatgactaagtcataatcattccacattggctcataattttgacctcagtcaccttttggagtaactcaccaaaaggccagttatggtcgtgtgtgaagaatctgtctgcttggcccgtgttgccaaaatgtcgttttgtaatttcctttggcaatagtgtcttcgtcagtgattctcaactaatatacttcctctttctacagccccagtacactagagggactgtttttcctctttttcaaagctgtgtcattgacctctgaagtgaagaaattggcccttttagactttgatctgtgagtcccatgtaacagagactctttaaaaaagaagctaagtgtgtgttttgatatgtttatctccttcttagaaaatgaaatgaaactacagcagacttatttttaggagattttaggagtgttctattttaagaaaatgacaccatacaagaacatcttttagttaaacttcttagtactctgcttgtgattcttacttaaaacctgcaagatacttttatttggaaaattaatgaagaggccttgtctcactaataagtcatttaatttggtctggcaaaagtttaccatccattcaaagatcttcatgaaaatgcaaagataaggctgtttaggcttgagcccaggagttcaagaccagcttgggcacatagcaaaaccccatcttattttttttttaaagactgtttaggcctgtgcattctggcaggttgccccacttacccagagcaggtgcatcagattccagattcccagggctggagagaatatggaatttattttgtttgtatacccacttattttgcctatagggacagacttgaccctattctcaactcctcatttctctccttttcctgcatcacaaattgaggggtcctgaagagccactttacctttttggtgctataaaaggagctggggatcataaatgcaaagacgag

SEQ ID NO: 176633 - DNA, 757 bp, Homo sapiens
cactggcccccttgacaattcctcagccccagctcctcctttcagactggtgcctccacctgccagacccctagctttgaaggccaatctcatcttcgtctccttcctctctggctccttcattcaggtgacaagtatacatcaaatgcccaccccaactccccctcccaggactccaatctggtgtctttctagcggggagtctaggttgctccctctgctctggagaggcttggcaaaatgcctgcagagctccttgagctccacctctgaactccctttcagcagccggcacaggcataacagcccagcccacaggtaccactgccactgaggcagggacccctaaggtagggctacccccagccacaggggctggctggactgcaagaggctccctgcagccagacaagtatgaaaatgccttgttgttttgtgctgaggccccccaaaacacaccaaagcagctgggccctcttggcatggtaggttctgcaaagcacccactgtgaggagcctgcgtgaacatcaacctgatagggccaccagtgcaaaagcatcttcaacaagttacagtcaataaggaaacacatgtgtagacacatttttattgcccattcaagctgtttttatttgctgaattcagaatcctttaacatagtaactcacaaataagatagattttcatagattttcaagacctcttttgaggaaacatcttgtgtttggtgatccccatctgtagctgcagcaagcc

SEQ ID NO: 176634 - DNA, 324 bp, Homo sapiens
aatttaaactcaactatctcaaactgttctccttgttaccacccctccctgaccaaacctgcctctactatgctgcccacgtcttagagagtagcgtccccattcttctggctgctccagccaaaacctcctctctttcctcacaccctgtatccaatccatcagcaagtcctgtcaactcaaccttggaaatatatcctgtacccaactacacctcgacatccccgtggctgattccatggtctgaaccaccagcgaccagcgcctcgatctggatcattgcaccagcttcccccggtctcctggcttctgagttttgaaccc

SEQ ID NO: 176635 - DNA, 310 bp, Homo sapiens
cagtatcacacattcttctccctgatgtctgagttagccacagactcacagactctcactctctgttcccactaggaccttcgtactgccatcctgcctctggatatgcagtcagaacactaaaccacttgcaaaagtcactgtactcccttactgtaaagggttacactgcttaaaatacagatttgcaaaaattttccaaggatgccataatttttaggtggtcatcctttcactatcaggcccaataacaacagtagtgaatttttggcttgttgcttcccttttctgggaggtggaagtcagtggt

SEQ ID NO: 176636 - DNA, 341 bp, Homo sapiens
tgataagccaactgtatcacattgaaaaagtgtttcaaactgctagtgaggtggcatattttctctcataggattgatcattcttaagaattgccttttatgaattcttttatgaattactcttagctcatctactggattattcatctttctcctattgatttatgcatttttaaatatataaataatgtagcatatgcatacatgagttgcagatgatttgcccactttattatttccttttcattttggaaaatttagcttttaagtaaccaaatctatgcgttttttatttatttttttattccacttctggcttccacttttggcatcattaccat

SEQ ID NO: 176637 - DNA, 670 bp, Homo sapiens
cacagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacgggtaaatatcaaccctttgatgtcgccttccggataccggaaatgggatattcgcggcccgagcatctgctcgggattagacttggcgggcacggggagaactagacctcaaggagggggttccgcctgtgcttaggtacgaccctggaggtgccgcgcaacgcagtagtgacctcccaaaatccagacaccggattttgtttagaagagtgcttgt

SEQ ID NO: 176638 - DNA, 372 bp, Homo sapiens
ccggcctccggtaaagctccgtataacagcctcgctctactcctggctctgtccttcctaacttctcattaggcttggcaccccaggatgcggtgtgatccatgccgcgttaactaatctgccccttctctaccttttcttttttcctttcttttcgagaccaagtctagctctgccaccgaggctggagtgcagtggcacgatctcgcctccgcctcccgggttcaagcgattcacctgcctcagcttccggagtagctgggattacaggcctgcgccaccacgcctggctaatttttgtattttttttttttttggtagatacggggccaggagtttgagaccagcatggccaacatagtgagaccccat

SEQ ID NO: 176639 - DNA, 666 bp, Homo sapiens
cacagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacggccaagtctagctctgccaccgaggctggagtgcagtggcacgatctcgcctccgcctcccgggttcaagcgattcacctgcctcagcttccggagtagctgggattacaggcctgcgccaccacgcctggctaatttttgtattttttttttttttggtagatacggggccaggagtttgagaccagcatggccaacatagtgagaccccat

SEQ ID NO: 176640 - DNA, 609 bp, Homo sapiens
cacagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggccccaagtctagctctgccaccgaggctggagtgcagtggcacgatctcgcctccgcctcccgggttcaagcgattcacctgcctcagcttccggagtagctgggattacaggcctgcgccaccacgcctggctaatttttgtattttttttttttttggtagatacggggccaggagtttgagaccagcatggccaacatagtgagaccccat

SEQ ID NO: 176641 - DNA, 450 bp, Homo sapiens
ggttcatcagactgcccattagtctttcccctgctgtctcccaggaagccccactacagcccttctatcctgaccccacccctgggagctgtccctggacgctctccacccacctactttctgctccgcccatgtgcagccactttgaggtctgtcatgaatataaagtgtgtgacatatttttatttcctggctctcttgttcatacgtatctttatttaattcccagcatgtgtcatgttatgtgtgttctcagcttatgtttttacgtttagaagagtttcgcctgttttctgcagggatgagacacttcgggccaacttcaatgttctaattccgagtttggaaatcaacttttggactgaaagctgagcttgtctgagatttgtcagggcccctggtggttggaaaagtgttctgaatccaataaaaggaaagcggtgatttaca

SEQ ID NO: 176642 - DNA, 217 bp, Homo sapiens
ggttagtgattaggtgatataaggggctgccaaggattttgggctgaccaccgtaggagtaaggcggaagatatatcttgatgtacctaccatttttctccattggattacactgtgttatagttatttgcttcttgtatgtctttttactagataataagctcttaaggcataattgtgcttgatactgtttgtgaatagggcaatgtatatattt

SEQ ID NO: 176643 - DNA, 288 bp, Homo sapiens
atccatctgacaaaaatcctacctttcctccaaaattcaactttgaaccttatctttcacaagaaacccagagcttctccaagacaggaattttgttttccacacgtattaatgtgagttaatacacatgaggtacttaaaatagttattggcacataatgaatgctatctactttttttcctacagcttggagtaaagatacatgatctctctgattcttagtttcttcatctgtaaaacgagataataaaattatccacctatgaggactgcaagaacattaaatg

SEQ ID NO: 176644 - DNA, 759 bp, Homo sapiens
gctctcatgtgcttctctgcatctctgattcagccatgatctaattatctcagtctgtttccctatgcgtgcctctgtctgtctgtgggtgtctctaagtctctgtagatagacaggtaggtagggagagagaaagagacagagagagagaaagatccactctttctcttccctgccccttcttccttgcctctcctctcctaccaacttcccagtactctcagcatatccctcctttctagagctaaagaagtagagcaattccactggggaagcagcgtctaaagggtatttggtcaccttctccatgtgcagcctttgcagtacgctgcccctccagtctacagcaagtttttcagcttatgcacctgttgcaggggaagggggcaggagcactgtggtccagcagcatggccattggcggagctgtctccatggtgagcagcagagcccataggagccaggggagcacgtgagcagccctaagggtggatggagaggctgcctcaggtcagaaagccatgcagctcttgaggctgaggatccaatggcactcctgggaaatccctcccaggccctgtactcatctcttcctttcaccttccttcatgaaagcttttgccactgctcttctagagaagattgtgagacccttgagactgggggtttctgacatcgagagggagatcccagaatctgtggccaaaaacattcttcccaaccccagtgctgccttctacacccagctgcctccttctt

SEQ ID NO: 176645 - DNA, 466 bp, Homo sapiens
aggcaatgacccatcttgggaggtagggaagggtggtggcgaggggtgaagaaatagcatgtgtttcccaaaactgccgagaaatgtgtccatattgatggtatttgctgattgttgcccaattttcttttcactagatagagtcaatactttttagcatattttaaaaattaaatcatatctacatcataccactgcctataagccatgttattacatttttgcccataaatttggcatgtggcttcaagctctttaaacacagaggcaaatcatgcatcggcctgggagaaaaccacaagtgacattctaagccaacccttccacacaaagggttgagtcatttgtcctgcttgctgaagtggcagtcacccagagaacaacatcctggcctttcatatctgccaagtccttcctatggtcagaaagcctgctccttcctcaaccttccttccaagatgtatgg

SEQ ID NO: 176646 - DNA, 325 bp, Homo sapiens
agcattattggagggatgtcctggaatagacaagaggaggtggaatctagtacctaagtggagaaggagatgtcagctttaggagcatggcaagttcactagtggtaactggcaggaagtcaaagtgtgaggtgtatatgctagtaaacaggtagaagtgatagtgagatttatgaaatcgtcttctgattgcttcattgttctcagtgaaatagaaagcaagatgatcaaatgagtgtgaggatggggcaacaggcagtgggagtctgaggacagagaagaaggtatgaaatagttgtctagagagaagagtgactagactgtg

SEQ ID NO: 176647 - DNA, 482 bp, Homo sapiens
atgaagaaatccaattactgaattctacttgaagcacatgatgaaattatataaaactagcttcttgtcactgtttaattttttcattttgctaataaacatattaacagcttttcttgaaattaaagatgtgtaaaatccatttatatgaataatcacttgatctaaatgaaattttagagtctacagtgacgcataaatataccttctactgcaacatgtgttaaatcacaatcttcaggcacaatcatctctagatagctaactgttagaattgctactgatgctgtctgaacagatttgccttttttggtttctttgtgtccagtgatatcagcacaaccctcatggtgaatgggaaagttggaactacattttatgtcagtaacacaatttcaattcctattgtttttttattaatcatgaaatttttaagtccattgctgctaaaagagtttaaggaaagaaaaacagggttatca

SEQ ID NO: 176648 - DNA, 311 bp, Homo sapiens
ttttcatgcttttgaaccgtactgtatctgttcatttgtaatacattatgtttgtgatatttgtatgtgtttatataaatagatgtccattttcattgctatattaagcattagtattagatggactttggggttattaataaggctgctatgaacatatgtcttatactgtgtatattcaagagtttcttgaggtcgtacctaggtatgggatgtctggatcttagggtatgtacatcttcaactttactaattaattccaaactgagatattctagtctgttctgagaaagctgtttgtttcctgttca

SEQ ID NO: 176649 - DNA, 244 bp, Homo sapiens
gggaggagaaggtggtggcgattgtggcgggggctgccaggccttgcggggtggtcaaggaggcttggttttggaatcgccaggacatcacagaaagcacagagccccgtgtgttgcttgtggacacctcgtgtaacacgggtgtgggtgttgccctagagccggcatcagcatctccgtgtcctccatggtcccgtgtcctcctcggcccgggaccccgtccaggacctcacacctcagtggt

SEQ ID NO: 176650 - DNA, 294 bp, Homo sapiens
tgagggcgagccccacgggcgacagacgcagccgcagagctctcggtgggaaaacaagtcaagcagaaggatcaccttgtctcgctcctgacggtccagtcgaaagtgcttgttgagtacaatcgtaaatggacatagaggaggaaagtgttgaggatttgctgaaattgggtgacgggttcaagggatttgtttctgcgttgtttctcctttgtatgtttgacaacgtctgtgattaaaaatagccataaaatataaggcaggtacactttggctgtactagtgcgtatcctg

SEQ ID NO: 176651 - DNA, 129 bp, Homo sapiens
accaagctaactacagtaggcaagacagccaatagcaagtgtgggcaggatgcagagtgattggaaccctcattcattgccagtgagaatgtgaaatggtgtggctgctctggacccagttcaacagtt

SEQ ID NO: 176652 - DNA, 305 bp, Homo sapiens
atgaaaacttaatcgaatcaggcagtggcaactaatgacctagaatcattaacctttaaagcctctcaatagatgtagtctttagaaatccgtggtctgaattccagaatcgcaagtcaggtagctgagaaacagaagctactagaggagtttttaactttttagaaggagaataaagtattcatcctggcattagaaaagagcaaatgcaaaagaaaagagtgacgtatagggagtctcttgtctataccgtgaaacatctgggcctgtttggccgtggccatacattacgcaattcagctgcc

SEQ ID NO: 176653 - DNA, 386 bp, Homo sapiens
tgacatgtaaccaaaaagtttacattttaattcttagcaactgtattctagaattatgttcttgtcataatattatatcacagggtatattcaggctgggatatatgttaagggaagaaaaggggatgcagagaagtaggcaggaaggggagaaaaaaaataaggatgagaagaatgaggaaaaccaaaatttactatctgccaagtttttagattcaagaacagcccaaaagtagtggaatcaggactcaaagtcagaggccaaactttgcttaaacaccactataatttttttaattaatgtccaaacaattttcatcttgaattattctaaggtaagatattagaacccatccaggcaagatggctcatgcctataatcccag

SEQ ID NO: 176654 - DNA, 505 bp, Homo sapiens
gaggatccaggaaacacaccacagagctaacaactgactataaagtgctgaagacgcatcatgaggctgtgggcagcaaccaggcaggcatgaggaacactaagtggggtgaggtcagtctcctggcaaccaagaaagaccattagagaaaacagaccgaggggtcaatgcgcccagtgccacagattacaaggaagaccagggccacacacctcagaacctggcagtcccatagagaccctggtgagtcaatccatgattctgggacacaaaaagctacatgaagaagccacaaggagcaggggattagagaccaacagtgggacggaatggggaagcctgctaccacagaaggcgaagaagcagctagagtagacgttccaagcaaaggtgctaatggggccaagcggcggcactgaagaaatgcacagcaggaaagcctggtgccttacaagtgagtgagctccttaggaaagcaggaaacctgcccagcacaagaaccaca

SEQ ID NO: 176655 - DNA, 922 bp, Homo sapiens
ggaatttttgagtcccccttagatatagcataaagatggtcttctagcctttgccaagtagacatttaatctaattgtttaagagtgcttgtcatgtatagaaaagactaacatactttgcaattatttacattaaaaattatgtagaggtttgttttagtgtaattttaaaaataatttgtctcccaaaagctgtaaccagtggattaaagtaaataagctaaaataccaaatcttgttttataccattgttctatagcaaacagtgctgcagaggatgtaactactttttaaaatttatcctccgatgtaagtagggccaaagtcatttgtttgtataaaatattctattaattatatatgacctttataaataatatcttcgattttattattatgatcactttttgagctatcacagtgctcagttgttctcctattcctgagaactgaatttggcctttagtttggttttctgatggacacaataatgtagaacttgactttggttagaaagagatctttgagcttcaggaatctctgaaggtgcagtaggatctacaggtgaaaaccatttgaattgttaagcattagttaggtgaagaaactctactggtccctgcagcatatagcagctattatcgtagcggtctactttttgctatcccagttttttttttttattttttttttcccttttcccaagaagcacaaattccaaattagcaaaaatgtgaagggtgaaattatctctagtgatactcacaaactggggggccacatattggacaataactttgcggaatcactaaggataataccggacaactgaccatttattatctttagagaagccccaaaaaaagacttaagggaatacactggtacacctaaggtggtttcacataaaactattaccaga

SEQ ID NO: 176656 - DNA, 745 bp, Homo sapiens
gggaggtggaggttgcagtgagccgagatcatgccactgcacactccagcctggacgacagagcgagtccatctcaaaaaaaaaaaaaaaaaaaaaaaagttgtgataaaggggaaggaaggcagggaagtgctcctggagctgagaggtctggcaggttcaaggaagatgaaggagcactgtgcagaagtccagagatggaattgttcagtatcgctggagattagggtgttttggggatagaaaagttggaaaggtatagatgcctctggggcaactcagagagatgagaagaaggtgcagtttgggttccagatcctccccaacccagtgccaaagtaattcttctatttaatatactgtgatttcacataagacttaatttgaaaaaaaaggggggggggcggaggggggactgtgttgcttaagaaaaaaatctcagtatcagtagactagtgggacaaaagccaggctgccctgggttgaacagtgactggaaggtgaagaaatggaggcagtgactgcagactccctactcaagaaacctgggtaataggggaagaagaaacatagtgtctaggtcagtaggggctctttgaactattgtgtgtggctggagttaagtggaggagctacacataaaagccgtcagggtacagatgtcctgaaaccaagcaagatgactgagaattaatgtaaatagagaggtccatagcctgagccctcggggcactcctgtgtttag

SEQ ID NO: 176657 - DNA, 458 bp, Homo sapiens
caaataatctgcccaccttggcctcccaaagtgctgggtgcacagttttgcccttaggggattcacagtccaattgagtggcaaaaggatgtggaaaagtaaaccctagtgcaagatagtcagtataagccaagaactcaatgagtcaccagaatgccagtgctggaggaataaagaagaaatcaaacgtgtggacgtcctatttgggggcaggggagggggcttcacagagatgctggtgctgcctctcctcctctagattagggaccacatgacagcgaggaccatgcctatctgtccttttagggtctcacacagcacttgggacatggtggcactggacaaatatttttgaatggatgaataacattttccctgaggattggcaggattctgatagatagaaagaagggacagagaatggcagggtatgggcctaacgcggaggcaccaccagg

SEQ ID NO: 176658 - DNA, 141 bp, Homo sapiens
tgattaatggcaaggagatgaactactagattattttaacagttcaggagacagataatgaaggtgtggactatggaaatagcacaaagaatagaaaagacaacttctggaagagcaccatcctcaaataacacccctcgg

SEQ ID NO: 176659 - DNA, 111 bp, Homo sapiens
gccagtttctgaccactggatctcttaaggacagaagttttcttgtactgcatgggccccactctaagatacatgagacatgtttctcttatgccaccttaaggccattga

SEQ ID NO: 176660 - DNA, 350 bp, Homo sapiens
taattttcagttaggtacatattttgaggctattgcaaataaaatattttttaattataattttcataacttatgtcctaaaaacaattgtagttaccatgtacttttaactgaatagaaatttcaaaaatattaagccctgtatctaagtaaatcgtgtcattttagagatgggaaaatggagtcagtcaaaaatcaacaggagaccttagaacgtactattgttttatgactcctggaggtttgagtctagatccagtcttgcctcttatgttttaagtgagagctgctaagagcagaaaggatttgcagcaccttctctgtattattagaatatcgcaggtggtagt

SEQ ID NO: 176661 - DNA, 378 bp, Homo sapiens
gtttaaatcacagacaactacagactttcagctatcaaaaataaaaccactgagggagaggcctttctaagtacaaccttctgacaatgctaatgttattcaaaaatccttacttttaaagttgtttaagcctatcatttcttttaaaattctagtgaaggaataattgaaaacggaaattactatggaagtttatacgaaagggcttatagctgtagtaaaactatattcatctttttcctacatgaaagtatgtcaaccagcctggccaacatggtgaaaccccatctctactaaaaatagaaaaattagccgggcatcgtggcgtgcacctgtaatcccagctactcgggagactgaggcaggagaattgcttga

SEQ ID NO: 176662 - DNA, 700 bp, Homo sapiens
aggctgacttagaggatccccgtactcttaggaatatatccaaaagaaaatgagtgcctttgtctaccaaaagaaacaagaatgttcacagcagctttattcatattagcccaaagtgaaaacaacccaaatacccatcaacgggtgaatggataaacaaattgtgacaaattcatagaatagaatactaataacacatgcacaaacactgaagcctgcaacaacaaggatgactctcaaaatcggtaaataaaaaagctcaatggtatataatgtatgattatacaacgaaagagtacacaatgtatgattacatttatatacaaaagagtaagcaaagcatgccatttaaaaggttcaaaaactgacaaagctaacctatggtgacaaaagttaagagaaagagttgctggaggggaatcctgggcttcactatccaatacatctggctatttaatttaaataaattaaaattaaaaatttaattccttagaaacattagccacatttcaagcactcagtagttacatttggataatggctattgtattgaatgggaaagacagagaatgtagagaatttccatcttcacagaaagttttatttatcagcactgttctaggatgatgggaattttctgtatcttgatctgggaagtagttatatgcatgtatcaatatgaaaaaattcaccaagcagt

SEQ ID NO: 176663 - DNA, 721 bp, Homo sapiens
acccagtcacgagcgtcagtataagcgccggacactcgactctgtcaactagatcctagcgaaattgagtgccttagtcgtaactaccagagacaccagaatagctgcagtgctgctttattcatattagcccaaagtgaaaacaacccaaatacccatcaacgggtgaatggataaacaaattgtgacaaattcatagaatagaatactaataacacatgcacaaacactgaagcctgcaacaacaaggatgactctcaaaatcggtaaataaaaaagctcaatggtatataatgtatgattatacaacgaaagagtacacaatgtatgattacatttatatacaaaagagtaagcaaagcatgccatttaaaaggttcaaaaactgacaaagctaacctatggtgacaaaagttaagagaaagagttgctggaggggaatcctgggcttcactatccaatacatctggctatttaatttaaataaattaaaattaaaaatttaattccttagaaacattagccacatttcaagcactcagtagttacatttggataatggctattgtattgaatgggaaagacagagaatgtagagaatttccatcttcacagaaagttttatttatcagcactgttctaggatgatgggaattttctgtatcttgatctgggaagtagttatatgcatgtatcaatatgaaaaaattcaccaagcagt

SEQ ID NO: 176664 - DNA, 535 bp, Homo sapiens
ttatttttcctatggaatttaccagccagtgccactcagattgcagaattataaaaaaggaagacctagaacttcaattctatacttttgtagttttgcaagcatgaataaatcacttattttcctcctctataaaatggaaataacccctgccttgcagagttgttgtgagaacagaatagaatgatgctgtaagggaaacaagtgagatgaccaagacttacaatatcgttccccacaccaggccttgttctgtgttgtccatatgctgactcatgatcctaggttaggtgctgttatcttcccattctacattttaaaaagctttatagtaagtaaaaatgcttaatggctctgatgattatttttcttataaactttatcccctaagataggtagacctttagttttgctgccattctattgtatcaccacactctcccacccctctgaatatagtgtaacatggggcaagagaatgtcttacaattgctttagtacaagactttaataactaaaacaaaacaaaatataa

SEQ ID NO: 176665 - DNA, 735 bp, Homo sapiens
tctgtgcctcccaaaggtgcttggggcaggaatgaagagcggaacagcccccatcaatccaataggattgtcgttttacgctggcgtggagcctcagacatcaaaagggctggagagtgaagccacgtgtgagccgtgaagttggtgaccctgaggcacagaaagctgagggaatttgttcgaagtcacacagctgggtccttgcagatgtaatcgggtgaagatgggttcatattggattggagtgagtcataatccactgtgactggtgtctttaaaagaaaaggacacacggaaattcagagacagaaagacccacagggagaatgccatgtgatgacagaggcagagactggagtgatgggtctatagccaacggacaccaaagactctcatccaccagaagctggaagaggcaagaagtggaaaagcatttgggaggaagtggaaccaaagcagatcctatccaaggtgaatggcaagcagctatatgaggatggccttgctcccagccggatctcccatcctcaagaaggccagcccaggcttcatcacacagcagtggaagagttctgatttaagagaagaagagtggaagctgcaggtcctgttgagacctggactaggaagacacacaatgccacttctgccacattctagttgtcatttctggttgtgaaagcaagtcccagggccagtcaagattcaaggaaagggtaaataaactccattact

SEQ ID NO: 176666 - DNA, 424 bp, Homo sapiens
cttaccaacagactatctcccgagccataaaacaacgacaaacataaaagaattaggattatagagaatataatctctgactgcaatggattcaaatttgaaatcaatacagaaagataacaggaaatgtttcaatacttgggaattaagctcactattacatctatagtagtaatagccagaataaccactttaaaaatatataaagatatacactaaaaaagagtctaagaggaacctcggagagcattgaactcaatgaaaatgaaagtgaagcatgtttaaatttgtgggacacatccaaagcagtattaagaagaaaatgtgtagcactaaaaagcttatattagaaaagacagaaagtctgaaatcggtcatccaagctctcaccttaaaaaagggagcaaaataaattcaagccagg

SEQ ID NO: 176667 - DNA, 441 bp, Homo sapiens
agtgctgtctcttttccctccagcgccccctctgtgcccccctccaatccctgctccccccagtctctatagctgaaggctaggacgaactgtggggttgtgaatatttacgcaggcaggcataggactcagtgacgcagctgagagccacgcaagtgtttggtgactcatcagaccttctccaaagacttgtgatatttttctcctctgaagggccgaaagcaatttgcagttaatgatagtatatgacgccagaagagtacgcagaccttccggctcatcttttctgtgccttgggtgttttgtttttgaaaaaacctatgtgaattattttccctttagtaatgtttattttattctgattattaaaataatgtatgctcattgtagaaaatacataaatgcattaaataggaaataaaatgcatgaattatttttcc

SEQ ID NO: 176668 - DNA, 240 bp, Homo sapiens
aataccgtgggaccttatttccttcttattgtgattgaggtggagtagataggcgtaggtagaaatagtggaaaaaggagcaggtttgggagagagcctgggagataatgagtttaagacatgttgagcatgagattcttataagaaatctaagaataaattgatgggagaaagttattttttatggataagatattcatgaaaagattaacagattggagatacagattttggagttgc

SEQ ID NO: 176669 - DNA, 436 bp, Homo sapiens
cgagacaggcgatcacttgaggtcaggagttcaaaaccagcctggccaacatggtgaaaccttgtctctaataaaaatacaaaaattggttgggcatggtggcgcatgcctgtaatcccagctactcaggaggctgaggcaggagaatcgcttgaacctggaaaatggagcttgcagtgagctgagatcgtgccactgcactccaccctgggcaacagagcgagactctgactcaaagggaaaaaaaaaatgagtcccttctcagtgccttgaagctcatggctcctttgtgggaagctgctggtgaaaaagcatagctccagaaggatcatgtcaaaaaaagaaagaaaaatagaaagttaaagcagaggttgcagtgagccaagatcatcccactgcactccaggctgggcaacagagcaagactctgtctcaa

SEQ ID NO: 176670 - DNA, 932 bp, Homo sapiens
tgacgcgtacaggagtggtgagggcactcctagtcttctttcagttctcaaggggaatgcttccagcttttgcttgtatcagtatgatgtcagcatgtgaggtgaaaaccttgctatagagggtcaaaatcacccttgaaggtaccttaggaaggcatatgttgaaattgacatcgtgtctgctcaagaaacccatgagggtccactttttcctccaagcttgtaacatagcactgcacctgaatctgagcacctgatgaagtatctgatattgtaccaaaaagacatttcttcaaactctagaatcatacccaaataagcaagataagatgcctacactacaaaaggcaaacgaggactacaattaattttgagaatgaagtttcccatctttcattacatattcttccgtagtcatatgttcataaagggtagagtgcatgcacaaaacacctgcacttttaaaattctttctctcctcttttgttaagtatatttatttgaacttgcttaagttaaatacatgcatgagacaatatcaacatatgctaaaattatttatcacagctaaagacatctcaccgaattccactcatctgatttaactgtttatgctatcttaaagtttcctgtatttctcgttctgttactttgctaatttcgtatactcaaccctgatttggaacatagacatctacttttaaaattcaattaagatttttggtaacttcttaagtttttttaactgtggtaaaatatacataaaatgtaaccatgaccacgtgcggtggctcacgcctatagtcccagcactttgggaggctgaggcaggaagatcacttgaggtcaggagtttgagaccagcctggccaacatggtgaaaccccatctctgctaaaaatacaaaaattagctgggcgtggtggtgggtg

SEQ ID NO: 176671 - DNA, 1064 bp, Homo sapiens
ctgacagcttcccatcattaaaaacaaacaaacaaacaaaacaacctgatcattgtagaaaattcaggaaagtatgaaggaaacaataaaagaaaacccaactaaaccttggttatatatcctactaagtgaacatttacagggatcataccatatacagtctcattactattttttcactaaagtagagatacattttaaatggaattcagggtttaaagtcagcatgtgaggtgaaaaccttgctatagagggtcaaaatcacccttgaaggtaccttaggaaggcatatgttgaaattgacatcgtgtctgctcaagaaacccatgagggtccactttttcctccaagcttgtaacatagcactgcacctgaatctgagcacctgatgaagtatctgatattgtaccaaaaagacatttcttcaaactctagaatcatacccaaataagcaagataagatgcctacactacaaaaggcaaacgaggactacaattaattttgagaatgaagtttcccatctttcattacatattcttccgtagtcatatgttcataaagggtagagtgcatgcacaaaacacctgcacttttaaaattctttctctcctcttttgttaagtatatttatttgaacttgcttaagttaaatacatgcatgagacaatatcaacatatgctaaaattatttatcacagctaaagacatctcaccgaattccactcatctgatttaactgtttatgctatcttaaagtttcctgtatttctcgttctgttactttgctaatttcgtatactcaaccctgatttggaacatagacatctacttttaaaattcaattaagatttttggtaacttcttaagtttttttaactgtggtaaaatatacataaaatgtaaccatgaccacgtgcggtggctcacgcctatagtcccagcactttgggaggctgaggcaggaagatcacttgaggtcaggagtttgagaccagcctggccaacatggtgaaaccccatctctgctaaaaatacaaaaattagctgggcgtggtggtgggtg

SEQ ID NO: 176672 - DNA, 503 bp, Homo sapiens
cacaccactgcactccagcctgggcgacagcaccactttaaaaaaaaaaaaaaaagaataccaacgttttattgccacagaagagctgaggcactgtgagggagcaactttgcactgatgagagcaaaagaagtagaaggtttctgaaaaaatctaacataaattctggacttgtacgatttgagtcgatttgctgatcacagtgttccttattctttggggattttgtttctttttggtgtagtttgctgctgattcataatagaatttaaatatcatagggtctcaattttttatattgcctagtttcattatctctgaacctcgtagttcttcctcttttggcatggcagaactttagtgttaaattgtaacattgaaatattttgccttctttataaagttcttttttcgaacaaacgaaacgaaatttggctttgcctaaatcccatcagcagattgcctttattcagaagcagtcatagacagcatttgattttatg

SEQ ID NO: 176673 - DNA, 591 bp, Homo sapiens
gggctttgggaagcactgtacctgtggctttgcagggtgcagcccacatggctgctctcacagtttggagtttaatgcccatggcttttccaggctgaagttgcaagcggctgatagatttataattctggaattttgaggggtaaggcctttctcccacagctttgctacacagtgcacccatggagaccccctgcagagctccaaccacatattagtgctcaacattgcctaaataaaagctttatgttggggctccagaccctgagcaggtttctttctgggcatccaggattcctgacacattgtctgaaatctaggtggcaagtgccaagcctcaaccactcttgtgccccagaggactcaggcccaaagctcccctcctctgcttgtcactctctactcatcatttcctccagtgaccaagtgtgtgtcatgcaccttgccaaggctcaaggggtaccttgtacatgggggcttctgcctgactagtgtgggtcgtggagtcgctaagaactaaaactttccacagcttgtttacaatctggtggaaagaaactgatctcaggagaccacaggaattctcagtcc

SEQ ID NO: 176674 - DNA, 443 bp, Homo sapiens
ctcagaggttggaaagcacgtattaggaacgccactgaatcttcatcttgacctcaggtagcctagtgtccaatttcctccccagcctattcttcatcctctgggaagtctagtttctcaatgtttccaacactgtagatgttctttggcttctagtaaaaataattcctataccatggtgctctcctgagatttcaagactcctacacactgaaacagccctcattttcccaagatttgacaaggaacatcatctcatcatcaccctgaagagcccctgaaggacatggggcaaggtagccaaaagtccaatatgccatgtgaattaatgctctggagcccagcttactgccatcctaatgcaaatgttataataaaatattaaactgtatgtgtaattgatgcttactttatagtaagtcagggtcttgcttgtttgaata

SEQ ID NO: 176675 - DNA, 289 bp, Homo sapiens
ggatagagataatagagaacaaaagctctggcaggggaaccataaactcactgataaggaactgcaatagagagaaactttaacaagaaagacataacaaatagctgcataaactgccttcacattttgaatagctcaacaaactaatgtgtttccacacaactactctgaaaaacttctcttcagaatatccctgcaagcagaagagtacataatacttccacttggttccaattaaacaaattgaggcttcagtttgatctactaaaaacagcttgctagctgggta

SEQ ID NO: 176676 - DNA, 291 bp, Homo sapiens
atatatttttcttaaagttccaatgaagaggagattgagtgccctctagtgaaaagatagggtccgatacatctttatttatgaaaccttttgcttcatgtgttctccttttctgagaatttataaaacgggggacaactgacactctcttctgagtgtcagttggtgattttatagtttcacagttcatttgtgttagacccaaagaaaagacatctgactctgaatcactgtggtttagaaaggagttataagccggtctccttgattctatattaattagaaaaggag

SEQ ID NO: 176677 - DNA, 433 bp, Homo sapiens
actgcgaacattagtcttggaaaagcaatgaaagaagccataaatacaagaagaggattattttcacagcctttgagacttaactttaaagcttttattgactgactccctgcatgattctttacaaaatatttattttaatttttattttgagacagagtatcactctgtcacccaggctggagtgcggtggcacgatctcagctcactgcaacctccgcccacggatccaactgattctcatgcctcagcctcccaagtagctgggattacaggcgtgagccactacacctggctaatttttgtatttttagtagagacaggggtttttgccatgttggccaggttggtctggaactctgaacctcaggtgatctgctcgcctcagtgtcccaaagtgctgggattacagatgtgagccaccgctcccggc

SEQ ID NO: 176678 - DNA, 426 bp, Homo sapiens
gatcgtcttggaggcgtgcatgacttgggacaggactgtcgtaagacagattattttcacagcctttgagacttaactttaaagcttttattgactgactccctgcatgattctttacaaaatatttattttaatttttattttgagacagagtatcactctgtcacccaggctggagtgcggtggcacgatctcagctcactgcaacctccgcccacggatccaactgattctcatgcctcagcctcccaagtagctgggattacaggcgtgagccactacacctggctaatttttgtatttttagtagagacaggggtttttgccatgttggccaggttggtctggaactctgaacctcaggtgatctgctcgcctcagtgtcccaaagtgctgggattacagatgtgagccaccgctcccggc

SEQ ID NO: 176679 - DNA, 277 bp, Homo sapiens
tcccctggatccgtgctcgctcattcccaggccaacgactgggtgcttttggccccattcctcccttagtcccctcatcgcctccgagattagacacagtggcctggcacacagaagccgctgcagagggactgaggctgcggaactcacacccggagcctgcggcagccatggcagcaaatctggccttggggcctccaagggtcgggtgcccctgggctcttgctgctggcttcttcgagccatgttttctgtgcccggcccctccttcccctcc

SEQ ID NO: 176680 - DNA, 531 bp, Homo sapiens
tgttctcttatcttatgaatctttcagttatcaaattgaataaggaaggagatgatgtttttctttctggaaattgtggagttggatgctaagctgtatattgaatctcttactaagtatatgatacgtatgtttggactttagttttaaatttttgtcaataatttgtcattaaacaagggtttagtgatgaaaaatgtattattcaagtttaccaattgccattttagcaagtgttggtggtattttactgtaaatttgtattacttttgaagttttataaaatggcaggaaaataattggacatcaatttaattgattttgtgatttgtgcagtaaccttaagttttccttttgttatctgtctatagatatccaggcttgtggttctggtagatagggctttagtttccctgaacttgttttaggaaattgtatttttgtgaaaatcccaattgagtaccttacatgtaattggttcacaataaatgttaattaaataaaaatgtgcagaatattccagttctttga

SEQ ID NO: 176681 - DNA, 336 bp, Homo sapiens
gtcatatgtaagtaatttgggattgtagcttggacattgtgaaggttatattataaatactttggattatgttaaatttatctgaaagttattgatttgtttgttgtagcaaaaattgatctgggaaggaaggaaggaaggaaggaagggagagaaagagagagtgagaaagaaagaaagaaagagccaaactgaacttctagaatttaaaaattcactgcaggaatatcaaaatacagttggaagccttaagaacagactaaaccaagctgaggaaagaattttagaggtcaaagactggtcctttgaattaatccagtcatataaaaataaaga

SEQ ID NO: 176682 - DNA, 392 bp, Homo sapiens
ttttattttttctaatgtagctagtagaaaactttaaatgacgtatgtggctggcattctacttccactggacagaggtacaagggggttcaggaaggcctgatatttcaggacaacagaaatgcttttcttggtgaagatgcagaggtagagtttggcatttggggtatggagggaagatggatacctgtggaaggaggggaagaagcagaactggccagagagaggctgaactgccaggcaaacctgaggccatctcgccaacccaacagggagcaatggagaggccattagaattgtcccatgatgggtccagatggccccacctttctgcccttcacaccctggaagaacagtcacgggaagagggtctgacaggatgtacccttacg

SEQ ID NO: 176683 - DNA, 168 bp, Homo sapiens
aagtctttgatatgtgtcaccataagttgctgatgcctccaaagtaacaggattttcagttaagagatatgaatttctttctggcttggtctatcagtttctctgtttgtaaaatgcagagaataataagtgccactgacctacatggacgttaggagatttaatgag

SEQ ID NO: 176684 - DNA, 461 bp, Homo sapiens
ggtttcttccttttgtgtgtgaatggaaaatgaatttaagttcattagtagaagcaagacacctttagcttggcctccaggtattatttgttttccttctcatgagaattttgaatgttctatatctagattctcgaggctaaagaataatgaagcagaaaatgttttctccattactatatccccttcctatggggattctgaaggtgcggttttccctctaggtgagagaactacattcctttcctaggcagattccattttagttcacactcaggctgtcagatgcacagaacaatgtcacatgggcttcttaagacctcttaaaaatcacttccagtttgacttctgcccatactttactctgttagttttcctcagaaaggcttggcaatagcagaataatctttgattaccaacaatatatttaattttcctatttgataggctgatgccgcaga

SEQ ID NO: 176685 - DNA, 688 bp, Homo sapiens
acacatcattcaaggcctgttatgggggcccagaacatcaggacacagtagctagcctcacattcagctccattgcactagagctttgcatgatctcaatttgaaaaacacacatgtatatcctacatttgtatctctattctaatattatatactgtatatgactttttaaaatattggtttgctgtttctattttgtgctaatgcaacaaatctaatttgttttagaaacagttattactgtttcttgcttcttatcaccccctaccgtttggactctgttgtccatctttctctgcctaattggaccacagcctggtgcctcaatccccacaaaatctgttcccttctagctcaagatgactgcattctctctcagttcgcagtgtactcatgggctgctcattcatctgcccttgtgctctgtgcctttttggcatctgcgggtaaactcagtgccacatatctctattctgttcactcctaatgtttgtattgtcttcccaagggacctctcttatggccctgctgggctcctccccttacccacatgtgccaagcatagaaatcaaggcaacattctcagtccctttaagggaagttccaggtacctagctagtcctacagccagcaattagggaagttaacgaataacctgctaaacaagaagataataatttaaaagcca

SEQ ID NO: 176686 - DNA, 170 bp, Homo sapiens
tggaccggctgtatcggggtcgggacacaatgcatctccctctgttcaccgcccttgtagctccttctccttcctgggagactggcggtgactgcagtcattcctgtgtaatggccgtctccccctctcaaccagggactcctccaggaggttgctcgcattgtgtcccg

SEQ ID NO: 176687 - DNA, 1628 bp, Homo sapiens
  misc_feature (1)..(1): n is a, c, g, or t
  misc_feature (4)..(4): n is a, c, g, or t
  misc_feature (12)..(12): n is a, c, g, or t
  misc_feature (1626)..(1627): n is a, c, g, or t
nccnggtttcanattccagaagccaagatctgccagccctgcctgttctctcaccccgcttcctggatccaagcaagacacgggctgagcacgtcctaatctgtgtcctggaaaacaacactctaccccacagcaacaaggcatggaggccaatggagaagacagggagatggtgctggaagcagggtctgctcttcccctggggaagcactgcatcaccagtgtctgacacaaagcctgggacatgtgggcttccaagtggacctctcctggataaatgaccattaatgaaacagagaaggagttgaagagccccagaggagtgtgagtcccaggggtcccgccagctccactcccaccttccaaacctgtgaaagtcaggtgcctgagtcgcacagtctctcccacccgaatgccatgagctgcagcgacccagcctgtctctgcaggagggccagacatgccgtgacatcaccagctcctctaggaatatgggatacaaggagtggctgagatcggctgatcaccagctcactccgctgcagccgccccagagcaatggctccccgaagccgtgttctggctgtcttggccgctttctgtttgtgactctccctgcctccactccccccaccaccccatgaaatgatctcatttggtcatttaaacggaaaactaaaaagttttaagtgactctaggagagcaggagagaggcaggtctcccagctcagaccccgccccgggacggccccacggaagatgcacatctggatgtaggcgctcaaggcaccgcgcgtgcgccgagtggccttgctcagctccgtccttctgaaacccggaatcctcatgtgtctgggtcccgccccatcctggcctcctacaccactggtccagatcctccaccttcccccaacgcgaggtattgacatcaaagcatcacctcatctggcacaagaatctgaaacacagaccgcaccttacaccaacgtagtgaatccctccttggacctgagttcaacaagcccagagtcggggctctgggttcccgcccaaatgccacgcatgcacacagatggcacctggcgtctcctcaaagggacaggaatcccgggcttcccagaatcaccaggtcgatttaaatggcatcagatgaactggaaaagaatgaaagtgctattgcctaaagtgatgaaattttcagaggatgtatcggtcctgtctggtggacagacggccaccagagggaatgaaccagtcttctctgaacatccatgaggatgaagaacagtcactgaggtgacggtaccaagtcaccggccacctcccagggatcctctcatccggtcctcacagcagcgctgcatggtcggacctcatcacccacattccaccaagaggaagctgaagcccagggccttcatccactcatgtcctccagacccctggcacccatcctgggccccaccccatcatccaggccttgggccttcgacctggggagagtccctgtctcctccatgagccgtccagggcctgaagaggtatccaataaacaagaaagcagaacacaaagagctgtgatggagtggatcttatgtagtaagaataaaattattttgagaaanna

SEQ ID NO: 176688 - DNA, 466 bp, Homo sapiens
caacatatgctgggcatttgattactcatctcatttaactctcagctttccttgattgtaaacagtggtggcatgctggtatgtgatcatgggcgaacacgcacttggcagatgtgggtctgtatgtgtaaatccactcttttccttctcgctttttttccactgatatttgcaggtaataaacttgatagtgtgagactgaacaacatgttggcacacattcgtgttttgtttagtctcatcaaattgcccgttcaaactacttcttgcaaaaaattttggagagtgagaaaactgctgagttacctttgatgattagaaaggcattctttcaatttagctatcaaaactgttgcagttattaaagtggtaaaaaaaaatttcagtgctaatatactcctgtgtttcgctatagtgtttcatgttcctcctgaattaagggaagcttttatcttaattgagatgc

SEQ ID NO: 176689 - DNA, 98 bp, Homo sapiens
cctcccctctccctcccaccccaagccgctttcacaaactcctttcttaccgtaggtttctcccctcccgccgcccgggcgagcgacacggctgcggc

SEQ ID NO: 176690 - DNA, 324 bp, Homo sapiens
caacctcccccatcccaccctccctccgcgggaaagtcggttagacgcggctcgcggaagacactactctccacttctcagaatgggttcaaagttggggagggatgcggctgttggagaacaacagtccgctttccactctctgggccagggactgggagggcgagagcgagaagttggggagaggacgcgcttccagcgcctgtccgcccggccgcgccacaaggggccgaggggcatgggggctgctgggcggcaaggcttgcgcggggtgaccgtggctccgcccccaactccgggctcgtagtgattgacgcgcggccg

SEQ ID NO: 176691 - DNA, 207 bp, Homo sapiens
tagagctatttacagatgtttgctagggatatactcatgtgttgccagcagagtttccataaatgtttatttcttttttaatacttgctacaagatgtaattttttgtttatgcatttacttgtttaatgtttcatgagggatgaacctaatttatcttgttgattacaatcttatgcatagggctagggacataggacatgcttga

SEQ ID NO: 176692 - DNA, 368 bp, Homo sapiens
gccattctcacttctggtccatctatgtcttttgcacattcacattttgttgtatgtatcacgttgcaatgtaattactgattagacagttgtttcccctacttcactgagtattccctgaaaacaggaattctgatctacctttgtatttctagtccctccatggtccccggcacattgaagacgcatttaataacttaaccttgaaatgagccaatagaactctgtgggaaaattgagatgacaagtatggaatagcaaattggaatgagtttgagaaagactttaaaaacacaaatataaaaattttgaacttcgtactacagacaatcgattttattttgttaaattgaaaagtggcctcaaaa

SEQ ID NO: 176693 - DNA, 268 bp, Homo sapiens
gggtttactctgaggaaaggggctgcactaggccaccatccgagggtccacggccactctgctgcctggtttgagaactccaagtacagagattcagagtcaaacgttgctcacatctgtcggagtagcgtttgggtcctcaagagttctaaagccagaaatctagaagctgaggatcacacatgttatgatatgatttctggctgatgtcgtaggcccaatgaataaatgaagaaatcagagcaatgtcaggctgaattccccactc

SEQ ID NO: 176694 - DNA, 699 bp, Homo sapiens
gctccccatgagttcagggttggctctatcctgaacccaccataggggcccagctttcaaaatgtgtgggtggtttgttttcaaagagagagaaggcggtgggcaggaagcaccatcccagatctgctgtcaccaccagataatctgttgtcataaaccccagaactttccatgaggctgctcaaatgtgctcggccttcccaggccggtgttacggccaggccgcctcctgcttgcagctggtgaggacggacagggcatgctgtggcctctgtgaggtcgcaggcccaggcgtgtgaaggaagagaagacacagggtccccatgacctccagagaggcctcctcgccctgtcctggccaggcctgccccggaagcaccccttgcgggcagttagagcagcgacgtccccgagcggcacctggtttcctctccaagctcagctgcagctggggtggcggcaggacctcggctgggtcctcaccagccctgggcctccctggcaaagtgggctgtggacgctgggcaggccagaccccagactcctggctccctcacccaggcctgggagtggttctcagtttgctcagtgccccccagcccactgagatcaggtccttatggcctggagccagggatctgcagctcccctcccctctccctggccctctcgaagcccacggcagaagcaccccctggg

SEQ ID NO: 176695 - DNA, 314 bp, Homo sapiens
gagggcatttcacatgctccaccactaaaacagaaagttttatgcaaagcaactaacacaaaatagaaatataattatctcttaggattaacaaaattatcagtgtcacaacccacataaaagtctaccaagcaggctgggcgcagtgactcacgtctgtaatcccagcactttgggaggccgaggcaggcaaatcgcctgaggtcaggagtttgagaccagcctggccttaatgatgaaaccctgtctctacaaaaaaaaaacacacacacacacacacaaaatttaaacaggcgtgggggagcatgtgcagg

SEQ ID NO: 176696 - DNA, 560 bp, Homo sapiens
aacccctcacatagatggcttgcatagggtgttttatgattgtcttgtgtatacttttaacccccaaagcactcgacgtacatgctagctctgccagagtgctgaggagtaaaaatgagtacaaaggaagcagggaaggaaggatggaagcgaggagggcaaaggaagacaactgtaccaagttaagaagaagcgagaaaagaagaggtagctggatacaaccgcttattccatccatccagtaagcatgcacacaggcctaccatgagccacacactgtgccaggcagtggggaatgtcgaataacaatcctgagcaccctggaaaccagagctgatcagacagcctgtgaagctggcagtggggtaagataggcaggcacgacagtgatgcagtcattctctctgtaggcaggtgttatggcagcagcacaactgcaggtgccaatgactccaaaaagaaaagttattctctccaattcccaaacttgtctctagtttcacttttggcgagccagtctctggatgggattctgatcaacagaagttctcatacacgga

SEQ ID NO: 176697 - DNA, 401 bp, Homo sapiens
tgggagggcaggagctcttatctgttttgtcaccattgttattccctagtgtctacctagtacagagccctacacagagtaggtgctcaaaacattgttgttgatcatctagattatatcagttacgtgatgttgtcgaagtgggtgttattgttgtccctcttgtacagatagaaagcctgaggttcagagaggtaaagccacttgacgagagtcacacagcttctcactggtgttagcgcatccttactttggggtgtgcagggtgtgctggtgtcagctcgggagagtggattgtgcccatctcttcccagtgcagcattcagtgatatcaatagcttgaaattggcatggccaatttcagtaagggtatttaacaccatcaaaattagtaaccacca

SEQ ID NO: 176698 - DNA, 437 bp, Homo sapiens
ggaatcatgagcaatacccttgctgctctgggtagaaatcttttagacccaagcagatatccaagctgctcatttggcccgatgagaagagaaaaacagaaaacaaaagctctgagtgggtagagcgtggggggagcttgaagctgttattaaaggaaggtatgattaactcctaactcacagccgcttcagctcatctccatggctcagccaccaggccagcctttgctgtcacctaacagataattattgtcttttctacaatatgattaagtggaaggagaatcagaacactgtagaactggatctgatatttcttgttagcatatatatatatatttaatctatgtgcttgtccttgaaaacagcacttcctgtacccagcaatcacagagctgctcttggaatttaacaccctggtggttctcaaatgccat

SEQ ID NO: 176699 - DNA, 799 bp, Homo sapiens
ctccaggcatcctccgcggcgggccggaccgggccggcggaggggagcggaagcccaccggggctggcccgccgctgacccgccgcctccgtctgcctcctcccgggctctgggcccagcgcgcccagatgccgggcaggacccctccgcccgctgctggaacaccaatagcagcgttggagcctctgggccggaggaactggggcctccaccgacacctgcttcttccctcacctcgcagccttccacacctgttgatctgacctctgccccgctgccgcccaggagtaacctaaggcttttggcctgattcgagctcactccgtctaaacctctaaatgcggtgcgaaaaaatcctggggaatgtgccatgcaaagcctgggcatttcaagtgcttttctggattcgcatcaactcctatttacaggcatctttatccggaattcagctcgtcccaaaccccacgtggtgtagctctgcttgtgtttttgaatcccggggcctctttgaatcagaagccctttgtatagagataagtatcctttaggccagaatcagcctccatttttttcgcagtcccatttcctacccgtaatactttcttctgattttaaagccatttgatagagaagggacagggaacagaaccttcgccccccgcctgagcagctggtagactagatatcttccaaacattatctcatttacttccctggagttacaaataggtagatttcatgtccgttgaggggggagaaagctgaaactttgggactaagaatcctggccgaggtcagc

SEQ ID NO: 176700 - DNA, 138 bp, Homo sapiens
tcacatttgcatttacatttttaatgcctatcttcctagggaatattctctcaagtacttggtgaagtatatgaactgttaattgtcttattaactgcagatccccagcgcgaagtcagtgccaaaaacaagtcatta

SEQ ID NO: 176701 - DNA, 498 bp, Homo sapiens
tcacccagccaagatcgcgccactgcactccagcctgggtgacagagtcttgctctgtcacccaggctggagtgcagtggcacgatcttggctcactgtagcctcagccttctaagtaggtgggattacagaccagtgccaccacacccagctaatctttatactcttagtaaagatggcttttcaccatgttggccaggatagtctcgaactcctggcctcaagtggtctgcccaccttggcctcccaaagtgctgggattacaggcatgagccacagtacccggccctgtttgatttttttagtgctattataaatggaattttataaaaatttcagtatttgatttttccttgctaatttatagaaatacatttcatgggctggatgcggtggctcatgcctgtaatcccagcactttgggaggctgaaggaggatcacctgaggtcgggagttcaagaccagcctggccaagatggtttagtagaaaccccatc

SEQ ID NO: 176702 - DNA, 346 bp, Homo sapiens
  misc_feature (15)..(15): n is a, c, g, or t
tcgagtcggcccggntcatagtagcgagcatcagtaagcaagagtagtttgtatagccaagtattttgcaactagaatatatagggtggctgctgttttcttgatgaaccctaaatgatcattggtagcttaaattcagccagccagcatgcagcaaagcctgggacacaatcccacaagttttgaatactcactctttcctccctgaaattctttccttctgtttatatagcatgtatagcattgtgcttccgcttatttatcttttgtcttccaaaagctcaggtgatggcccgctgctctttttaccctggctagtgtgcctgagaaacatctgtctgtctcc

SEQ ID NO: 176703 - DNA, 498 bp, Homo sapiens
tctttttctttttcctctgccatctagctacattttactgttatccaggtgtctgactcttctagttgccacacacctaaattccatgttcacttctcatacctccaaattactttctggatagataaccaatttttttatttagtcatttctttatacataatcccctgtagaatctgaaagcagtaagcaagagtagtttgtatagccaagtattttgcaactagaatatatagggtggctgctgttttcttgatgaaccctaaatgatcattggtagcttaaattcagccagccagcatgcagcaaagcctgggacacaatcccacaagttttgaatactcactctttcctccctgaaattctttccttctgtttatatagcatgtatagcattgtgcttccgcttatttatcttttgtcttccaaaagctcaggtgatggcccgctgctctttttaccctggctagtgtgcctgagaaacatctgtctgtctcc

SEQ ID NO: 176704 - DNA, 803 bp, Homo sapiens
ctctgccttaccctgcatgtttctattctagactgcaatagggagggcctgggccaaacatccctacctctggaccctcaccctatttcaaatcctttatgtcaaagaaagtcaatataccctaggtagctacaagtccaattattattgaggtatttagctgtaaaatttgtccttccatcactgtcttgactaaaggttctcctctgaaaattccaacttgttgacctgcaaacagactggagaaaagagcagtaagggtgaaggtgggactgatagtggccaagccccatgagaagacatgtttaaccttgctgtccttcccacaaacatgcattcctacaaatgtgttagaaataggctcagatgtgtaaaaatctacaggctgctttctgtagctctttcttttctcttccctacccactccttcagaatagcagtgagcaagagatagctcattagagtcctggcccggaattcctgtaataacaaaatacagatagcaactccctatctgcagagttaactgctttgagaggaagggagtggggccaggcgtgagaaataatagtgatccttgtaggaacaaatttttagtcgcatgtaagcattttatttcacttcttttcttagagaatctttgcccccaccttttatttattggaaattctgttccattagttagttctaagcctttcctttcggtcgttccatgactccagagttgttctttaatacatgtgttcctgttaatattatgtccaatcacaagtgcctgattggctggtctagaaaagttagag

SEQ ID NO: 176705 - DNA, 427 bp, Homo sapiens
tgttttgcagaagagaccacaaaggctcagagaggctgagccacttccccaagaccacacagcaatacagtaaccactggctctcaacgcccttgaaccccaactccctgtgccttccccacctaacgccctcaactggccgtgagtcttagagggcaaccctgatatttagggcctgctcccagctctggcctctgcagcaagcaacttaacaatgtgcctcagtttccccatctgaaatatggggaagatcggaacgaactttgtcctggggcagaagcttgtgaccaaaccgcaatgccccctaagctgtgagcttcctctggacgagaggctgcaaccactgcctggaattccgcccttccgtgcccacctcagctctgtgaacttgcagacctagttctatctcagtgagattccctgtgca

SEQ ID NO: 176706 - DNA, 495 bp, Homo sapiens
acacccggactcgaccccaggagggaggcggggcactactgtgttgaaagactttacagctcgcagagtgaaaattttccaccttaaaaaattgcgcattgcggagaaattttatttaaaaaaacatatagcgcttgcgggggtggaacaaaaaataagttagaaaaaggcacttctcagaaaaaataaaaattacttcgcaaaaaaaaaaaaccctacaacgaattagagaaaaagtagttcacaggaaaacagaaaaacgcgcattgcaggaaaaataaatcggagaaaagcacttggcagaaaaaaatgcattagattaaaaacgcactgcagaaaaaaattagacaagggagctaacggaaaaaaatggatcgggcaaaaacgctttaaagaaaaaaattagaggaaaaagcccctcgagagaaaaatagaaggggaaaaaaagcacttccaaaaaaggacaattgctttacaaaaaaaaaaataataata

SEQ ID NO: 176707 - DNA, 344 bp, Homo sapiens
gttattttgttatttcagctactaaaatgctgagagttaagataaaggacattttattacggctttacaaaagttaataaaagtatttttaccttattaacccagcatttgaaatattaaaataaggttatataatcaaccaatatatcatagatcgtactgttataaaattcagaagtggtgtggaatatattaattatgtaaatttttattccagtttttatttgtcgtgtgagtgtgagagacatgttcattgtgaaaagatactcctagtggaattaaactattctcacaattgtgaaaatatcgcctaaataatagaaaaggcttaaatcctggcttca

SEQ ID NO: 176708 - DNA, 153 bp, Homo sapiens
cacaccagtccaccaaccttttagatttatttcccccggccaaatcttaaagctggtctaaattctctgcttgtcaattcctctacttggggggtaggggaaaaactcaagacatcttctttaccaaaaccagcgttcaagattaccccttct

SEQ ID NO: 176709 - DNA, 798 bp, Homo sapiens
gcaggagaagataccgaggtccaaacaggcctcagtacctcggggttggggggtgccgcccttgcgccctgccctttcagggcttggccagcaacctatcctgtcagaagaggtgagagcccttctggtgcctgccccagagtgctctgcctgactcacattcagctcctgggcatggatggattcagggcccctggtggcaggcccctcctctcctccttcactgtccacctttgggagctgtagcctccagtgctctgagcctcttggcacccctgctgctggtgcctctgcccctcccaccaccctcctgtcccgcctcccgactcctatgtgctttcctgactgcccactggtaacattccggtccagcttgcaaggtgccactcagacaccccctcctgcttccagctgtagacagagctccctctgtctccttcatgcatatttatttattataaaatatacaaagggccctatagtaagcctccacatgttctccacccaaatgggtaaacagggaggttgggcagtttgcttctgatcactttcttaaaggctagtacacggtagaggcaataggcatcctccagcttcctcctctccctctcccctccacaggggcagccgcagtcatgacttggggatagacccagccctggctgtgtgcgtttatgggacaccagcaggccacacccgccccagtgctggctttgcctgagcggatggagtcaggctgtgcgcagacgcaggtgctcgtgttgttcaccccgaggggtgtcttccacactcttggtg

SEQ ID NO: 176710 - DNA, 261 bp, Homo sapiens
agagcatccctgactgctgtggctgacacacctgcaagtgtctgtggaatgtaattagtgcagcccagccttgcaaaaaagaaagtcttctcttgttgcaggagatgaactggactgacccattcatgattggtggatagaagatatccacctatatttttgtactttgcaaagagtgttcaacattcactaatatgatggtgaccttctgggaaggatgaaaaattctgagaaattctttaagtctgatagcaaattatg

SEQ ID NO: 176711 - DNA, 245 bp, Homo sapiens
tctctctccaaccttcagctaaccgctctgccaccgcaggggctttaaccagcatctctctccaaccttcagctaagtgctgtgccacctccctccagcattcaggggctttaaccagcatctctctccaaccttcagctaaccgctctgccacctccctccagcgttcaggtcagccccatttcagggcccttgtgcttgcctcacctaacctctgcatgattcactcattcacctgagttcct

SEQ ID NO: 176712 - DNA, 304 bp, Homo sapiens
tactccaagaaagtagtttttctgaacttctctgtaattttggttcactgccctcatccctaggcccccaacacatgcatacacacacatgcacttgtgcacacacacaataagtaactcctgaaggacaaattctgtgtgtcataggcccagcacctagcccaatgcctgacacccagttggtaaccctctaaatatttactgaatgaatggatacataaaaatgaacactttcagccaggcatggtggcccatgcctataatctcagcactttgggaagcaaggcgggcaaattgcttgggc

SEQ ID NO: 176713 - DNA, 247 bp, Homo sapiens
ctggagggtaaaaataaaaccttcataaaatttcatttgctgctttctagtgttggagaaagatccccattttctgatccatacatctcacagatacgtgataatatggtattgtggactctcctgtgtgactgcctctcctgtgaagaaccccctctgagcttgtattcactgatgtgagagcttgaaacaacattgcctatgccacaaaagcattatgatttgaaatcaagcatgggtatgtact

SEQ ID NO: 176714 - DNA, 494 bp, Homo sapiens
tttccatgtaagtatagaccttgctataaaggttcagaaaggaagaggaagtatcaaatagatcctacagtgtgctactgtatctatctgcttgcttgttgacttgtttttctgtttctctattgcctcttccccaaaaaggatttgaggcaagctctgtaaagatggatgcaatggaatcggcacatggcttaaaataaaaaggaaatagaaaataagccagaaatatactatttacaaattctgcctaaggtgaaccaactcccagaaatttaaggagtgcattcatacagttgcaaaatatgcatatgtgaatagtaaagcttctgcagatccctaaagaattcagagcaaataatacagcttaggtcaggctgatgaaagccacggctcaaagcaaatgaggatatttctattgggggagtcctctgggagtgaacttttcaaagcactgagcctagttataaaaatatctcacatgttgtattgtgctc

SEQ ID NO: 176715 - DNA, 343 bp, Homo sapiens
ttcactttatatccaaaacacttcatagacatttttctttaaaatgagtggaagaaaagtagtctaactgttgagtctttggacattccaacatttagttgctggggagatgaggaagaatcagcaaaggaaagtgaggttacgttttggagtaaaataaaaggaaagtttcagcatattttttgtagtagttccaggtacagctagtattaaaggaaggcattccttgacatttgggatgaactaactttgacagagtcacacaggtcttttgaatgcaggatgtctgaacctttctgtgctcatgtgcctgtctggctctaagaagggtagaacaaggtgg

SEQ ID NO: 176716 - DNA, 643 bp, Homo sapiens
agcaaactaacacaggaacagaaaatcaaacaccctatgttctcactcataagtgggagttgaacattgagaacacatggacacagaggggaacaacacacaccaggacctgttgtgggggggcaatgagggaaggggacttagaggacgggtgaataggtgcagcaaaccaccacggtgcacgtatacctatgtaacaaacctgtacgttctgcacatatatcctgttttttttgtaagaaataaaaaaaaatcggcacacaagaaagtctgcctttcttcaaaaacagttttttcacaaattttttccataaataaaaaaggtactaaaaaaacttgaatccaaaaaaagaaaaagaaaatgcaccgttagatggtaataaatatatcacatttttggtaatgtaactcgtttattctgaatcatttctggaacttgttaatataaatgttttacaagtaaatacaatatgtaaaaatgctacttaatggactaatatgtactttcactcattcactaaacacatattttttactgaatgcccatataactttttttttcttttttttgtttgagacggagtctcactctgtcgcctaggctggagtgcagtggtgcgatctcggttcactgcaacctccg

SEQ ID NO: 176717 - DNA, 667 bp, Homo sapiens
acggcagcaggtgatcagaggtcctggagggaggactgtggagaggtcttaggggagggtgagatctggaatgcagggaaagggcacagaaggacactcaccagcacctttaccagttattagcctgtgctttgtgtgtagcaacagaagctctcataaaactcagttttcttgtatttcatcttcttcaggagaacatactaacaaatgggtcttctttttctcattacaaattggcatttctgatgagcaaggacctaatccccagatttctaggctctgcaagtgcaggtttcaatatcagacacccacacaggtccagaagggcacatgcccttatccattcggagccaaattcattttgttgaacagtttgaaagtttggacttaacctctgaactggccagcacctgactgatctacaatcgtggcttaaattaattggctttgctcacatctgcatcctgaccaggcatttgaaggagtagctgctgtttaccagtaacagccccagctcatcattcatcaccttttataaaggtttgaggaggaagaggaatttggacttccttgtaatagctgccaccgtcttcccatggcaacttaaacaaagtagccttttcttagatgagactgtgccagactggtgagtcttgtgttataaaat

SEQ ID NO: 176718 - DNA, 477 bp, Homo sapiens
tggcacgggtcggcatctggagaaaggtcgtgagtaggagatacatgaaaacagcgggacatagttaagtctttctacttaagatttgagtagtttacataccacaataacagtgtgattatattctgtgttcttttgtgtatgttctaataccagtgagttttgtaccttcagataatttctcattaacattgttatctttcagattgaagaactctcattagcatttcttgtaggacagatctggtgttgatgaaattcctcagcttttgcttgtctaggaaagtcttcatttctccttcatgtttgaaggatattttcaccagatatactattctaggtaatgttttgtttttttttctctctctctcagcactttaaatatgtcatgccactttctcctggcctgtaaggtcttcactgaagagtctgctgccagatgtactggagctccattgtatgttacttgtttctttt

SEQ ID NO: 176719 - DNA, 752 bp, Homo sapiens
gggagctcgcgtaccttcctgaagttgcgaaatggagaagcatgagagcctgacagacgggcaaagtgaaagaaaaggctggggacaggagtcagggcagagaattaagtgtgattaagtaatggaagagactcactgtggacacaagagttaaatgagctgcagcaaatgctttatttgtaatgaggagatactgaagatagaagcagggagtgattatgtcctaaggtcctgagggggtcagaagcagaagggcccaggaggacggttagctgaggaaaggatatgcaagcagtagaccgaggtggagggtggggagtgtaagaactcttttgctttggctgtgattttcttggtggagtagggagaggccatcctatccattgggtagtggagaggagaggaggaatggtattaggagcttaaaacagaaaaggtttgggatagatgccatgggaaataaaataggcacacggcaatgaaattgtggattgctgagtagagttgaagccccctggagttaggcagagtaaattgtagtggactttactcgggattcgtgttagcaaaagcgttgttgaaacaatggaccaggctgggaagcaaaacaagcaaggctgaaagatggctgatagaagtgtccagaggtgttggtggatgggagatcaagctggtaatgtatagcccagtgagtagcaatggagacataaaagggaactgggtgactatgccacaggaacattctgaatcgt

SEQ ID NO: 176720 - DNA, 267 bp, Homo sapiens
tgtgaatcagtggatagatggatggactgaaggactaagtgatagtgtttactaggtacttaatgagtgagaataaataaaatgataaactcattaaattatatcatgtctgtatttgcttaaagacttagcagcagccaggcgcggtggctcacacctgtaatcccagactttgggaggcccaggtgggcagatcatctgaggtcaggagttcaagaccagcctggccaacatggcaaaaccccatttccactaaaaatacaaaaa

SEQ ID NO: 176721 - DNA, 338 bp, Homo sapiens
aaaagaaaacatcgaataaaatcaataaaacttaggccaggctaaacaagaggaaaagacaaagagacacaaattcccaaaatcagaaataaaaaagaaaacatcagaggtgataccacagaaatacaaaagatcaaaagaaactctttcactaacaaactgaaaaatctagagtaaacgaatacatttctggacacatacaacctaccaaggttgaatcaggaaaaatagaaaaactgagcaaactaataatgagtaatgagattgaagcagtaaaaaaaagtctcccaacaaagaaaagtccaggacaggatggcttcactgctgaattctattag

SEQ ID NO: 176722 - DNA, 287 bp, Homo sapiens
aagactgattttggcccactgtgaagggagatacgtgttttctttccctgaggaatggttatcctctgtgttccttgagtccaaaacatcctattagcccttataactatctctggaaaaaatttcaggtatggtgctaggtcaggtagctgtagtttccaactggctctcttaactggccatcctaccaagaaggcaggctcaaggaaattcctttctttttgaaaggcctgggctgagtgaatgaccaccactctgtggttcaccaaaaaaccacatcaggtttt

SEQ ID NO: 176723 - DNA, 678 bp, Homo sapiens
ctcttggaagcttagagcaaagagccccaggccaagaaaatgcacagtctttatagccaggagttaggaactgtgtgagattcattttcctaaggctacaaacttaagcagaattaggagtgtatgtgaattctaggccacagagttctaaggggatcattaagagaaatagggctacagacagggcatttctgagtttgtatgcaaggccaggtgtccatccttcagtgtgggcagaggagaccagaagtccatggaactttttttttaagtcaatcctgaagcatgctagatgtccttggaatcgtaaaggcctaaggaacttgggttgaaagaccctcagatgtctaggtttccaagactttccttataggtgcttattcctagcctcttggtttcctgggcccagagatttggcttgtgcctttagaatctctgtgtgtatctgaaaggagggagacacagtgagatataataaccacaatactagtaaaagcagctagtgtttactgaggacttactctatgctgtggcctcacataattcatagcagccatgccaggtaggaatgattctgggctccactttacagatagagaaaatagagctcagtgaagtgatcacacttgcccagagtcacatggccagtaagtggtggtaaagggacatatgccacat

SEQ ID NO: 176724 - DNA, 612 bp, Homo sapiens
cccatacctatagtcttcatactgcacattagatctctatacttgttcatactactttgtatcctctgacctacatctctccatttcctgcccacaacccatatccctggtaaccactgttgtattctctctgcatatttgaaatttttttggttccacatataagtaagatcatataatatgtctttctttggcgtatttcgcttagcacaatgggctttcccatgttgtggcaaatgacaagctctcattattttctagggctgaataatattcattttgtataaaccaaatgtggtatacttacagccacttctttctctatttgtccatcatcagacacttaggttgtttccatatcttagttattgtgaatcatgctgcagtgaacatgggagtgcagacatctttatgaggtggtgatttcatttcctttgggtatatgcccagaaaaggaatggctgggtcatatatggtagttctgtttttaatttctttagaaacctctataacgttttccataacggctatacccaatctacattcccaccaacagtggacaagagtcctccacatcctcaccaacatttgttatcttttgactttttgata

SEQ ID NO: 176725 - DNA, 459 bp, Homo sapiens
ggtttttatttgatcaataaaaatcagtaagtctctagccaggctaaccaaggaaaagagagacggcacaaattgctaatgttggaagtaaaagagaggatatcattgcatatcccagggaaattaaaaggaaaataaaatagtactatgaacaaatctatgtctacaagttttttaactgaaacaaaatggaccaatttttaaaaatgcacaaatctgccaaaattcacaaagaagaaatagataacatggacaggcctatacttattaaagaaatttaatcaaaacattaacaaccttcaaaaacataaagcaccaacttcagatgggtttggtgaattctatcaaatatttaaggaaaaattatactaattcaatataattttgtccagaagatagaagcagagggaatactttctaatgtattctaagaggccagcattacccaccccccaatca

SEQ ID NO: 176726 - DNA, 138 bp, Homo sapiens
ttggaaataatagtagacactgaggactacagaagatgggaaagtgggaggcagtgaaacatgaaatactacccattggttacaatgtgtactattcaggtgttgggtacactaacagcccagaattatgcaatccat

SEQ ID NO: 176727 - DNA, 552 bp, Homo sapiens
atgaaacattacatttaaggatgtagtagctttgaatacactgatatggaatcatgaccaagatttatcattaggttaaaaaaaaagtatggtacacaatattatgtattatatgatcccactatttaaatataaacatataagtacaaatgaattatatttgtgtgaatgcataggaaaatgtctaatatactcagttttgtaaacagctacctctgaagagtggaacaatttaaggaagatatttgtattgcttcatttttaaagaaaaatgttacttttataacttcagaagaaacagtaaagaaaaaatgcaaaaagactatcaatactatgtaccagagagatagcttcaaagatgtttattaactatttaaatgttcctttggagaaatttttctccagtcttcttgaaaatacatatcctgggaggctgaggtgggcaaatcacctgaggtcaggagttccagaccagcctggccaacatgataaaatctcatctctactaaaaatacaaaaattagctgggtgtggtggcacgcacctgtagtc

SEQ ID NO: 176728 - DNA, 252 bp, Homo sapiens
aaaaggaaaaaataaaagaaaaaaaaaagaaaaaggataaaaagaaaggaaaagaaaataaaaggaaaaaagaaaataaaaggaaaaatgtaaaagaaaaaagtctggtgcatgtgctgccgcagcccgagctcaccccttccaccggcccttttacccaaatgtacgcattttccatgatgttcttcaaggaagtatttgacaacattgcagcccaggaatctccagccctcttcccggtgagattttcag

SEQ ID NO: 176729 - DNA, 872 bp, Homo sapiens
acaggatcgtcgtggcaaaggctccgacagcttgctggaatagagggtctccgctgcctcgcttctcctgtggccttcgtgtgggacgcacgggacggcgggacccagataaccgttctctcaaagcgagccacagaaaaacattgcctgttcacaaaacttacgttttatcaactttctacgtacaaccactctattttcaagtgtcaccgtgttttataattagggtggaaatccagaatacaaagtgagttacaccccttttctaggaagagtagtaggctgtatcttggaaaaggggctaggaagtttccctcaacttgccactggaacatgttttcagggaaaagaaggagtgtgtttcgttccaagtaacaaaagtacctgcaattggctgggcgcggtagctcacacctcccagcactttgagaggaggcctaggcgggtggatctcctgaggtcccgagttcgagactagctggccaacgtggtgaaaccccgtctgtactaaaaatacaaaaattagctgggcgtgatggcgcatgcctgtaatcataatcctagctatgtgggaggctgaggtaggagaatcgcttgaacccgaaaggcagaggtctcagtgagccgagatcgtgccattgcactccagcctgggcgacagagcgagactccgtctcaaaaaacaaaaaaaaaaaaacaaatacctgaaattaacataacagtaattgttcatgaacagcctccaggagacttgtagtggaaggtggagctcccactcagtactcaagactgcagaccttgctcctcttctccctgtttttccgataaagtatttcaaagcttatctgatgtgtaaggaaggttgttgatga

SEQ ID NO: 176730 - DNA, 397 bp, Homo sapiens
ccttgatatctgaatgaacagaggagatgagagaaaggacagtcctcagattttctgccaagaaagaaagggtagatggtgatgccatgaacaaacaggaaataccttccaggaaactaagagaagtctgctggtcagaatcttatttctcttactcctttcattcagcacaaaattacaacagtccataaaggaactctgcttcctcctcctaagcagaaactgtcaccaaaaattttattttatgaaagactgcctagatacgatcttggatcttcagagtttttcaggttaaattatagcatgttcttggcactgaggacacaaaggtgagtgacagactgtttttagatagctttcattctaacagatgtgatgaacagtacgataagatgaa

SEQ ID NO: 176731 - DNA, 436 bp, Homo sapiens
tggtaaaggaaatgggatcaaaatatcaagatgagcatgccattggcttgaggtatgtgtcagatttattgtggccaagaagattaaaatcagccaccattacgcagggtggtatgtcccgcactcagatgtcaggaagtctgaaaatcatgtgatcaaaccagagaggttcctgggtagatgataaataaaagacatgtttaaaacagaggcctgtagataaagtgatcacttgagtggtggcattacctgtgcctgtggttaagagagcaaagctaaagatagcaagttgaatcaaggtcatatgaaaggatataataagagtgagtagaaaggctgctgacacaggctcaaaaatatggtgtcagggtggggcatcagaatgtcctccaggctacagacctttgcagagaatggaactggagtcgcgcctgcg

SEQ ID NO: 176732 - DNA, 233 bp, Homo sapiens
ccaaccctcagagcgcctgcgcctggccgatggcccccatgggtgcgctggccgcctggaggtctggcatggcgggcgctggggcaccatcactcactccaccatgattcctgaccccaccacaacccctcaacccttcaccaccatgcagcccaccacgatgcctcatcccaccacgacccctcaccccaccacgactcctcaccccaccacaacccctcaccccaccacaa

SEQ ID NO: 176733 - DNA, 271 bp, Homo sapiens
attgtggcagtgggagatggaattgtacccgattaggattatgtcgagagcagaggaaatcatttacactctctagggaggagatggacctgaggcaattagaatttttccacctctaactttagtgattcttgtattacagaggcatacatgatagagaaaagcacctgatttttttgatgctatcaggagaatcataagacttcttttgtcagggggcccctctgaggccccttgcaagtgctgatcttctgagttgcgggggagggga

SEQ ID NO: 176734 - DNA, 364 bp, Homo sapiens
atgagaaaactgaaatagaggttaagtgacttgtgcagtatcatacaactactaatggatgaagttgtgtcttgactgtaggacttatgacttgaaaccatttttctctctctttctctctctttctatatatatatggaaatttcacatatatatgaaatggagagaaagcattttaatttttattaagaacttttccattttattccccattgcctaaatgccggtctgctatatgtcagccattcttccaggtgctaggaaaactgagtaaaaatatgtactacctacttctaaagacttttgaatgtgatcaatagagaaatcagtattcataatattatataagtgccgtgggtgcctt

SEQ ID NO: 176735 - DNA, 512 bp, Homo sapiens
tgtgtgagccaatggttgcaatgcagtgctccaggagtgcctgagcacaggggaagtgggtcctattattttacagacccagaaactgaagtttaggaagcctcagttctttgttaagagcggtccttgtgttagaagcagttccagctgaccccggagtccaagctctcaaccgctgtgcagtccctgaccctcagtgggaaaaccctgtgaacaccaagagttgccaaacaacttttagctgtggtttttctaagcggcggacaggatttgatgtaagggatacctggtaggcaaaccactgcgcaacagtgagcaaataccaattcagatatgagcagagtgggaagtttccaaaataaaacatagaacatcaaggactcatttactgcatttgagaatgggccactctgataagatagaggcattaattaggaggaaaaagtagccgagcaaatgtcggcaggaaggccaggagggtctttaacagcctgacgtaagcccaggaaagc

SEQ ID NO: 176736 - DNA, 145 bp, Homo sapiens
agatttcgcaaataagaatacaggaaggatacccgtataatatttaggatatacttatattaagaaattatttgtgatttttctgaaattcaaacttaactgggtatattctagccactctatctccattttacagatgaggaca

SEQ ID NO: 176737 - DNA, 196 bp, Homo sapiens
tcattacttccaaggaaaaaaaaatagatgtggaatgacagcttaatgtatccagaatatgttttagtgggagaagaagtttaggagggagggatgtaaacctcttattggaaaggggtaagaggggaaatagagcagacttcattcaggaaagggggaatcaataactcatagagaaggaacagtaaaccttatt

SEQ ID NO: 176738 - DNA, 450 bp, Homo sapiens
ggggacttttagaatcaggaaagacagaaacttgttcccccttagttgtagttttatttaccctgggagaaaaacataagaatgctttcaagtgtaaggaagggctgtgtattcagatatcagcatactgctccaagaaagacatcagagagttttgaactgattgaaagcccaaatctattggatcagttgaggagcagagcaaaatatgaccaagcaataaacgagtaccttcaaagcttttaagaaattcttatagtttgtataggtggttgggaggtgaaattccagggctaggaatataatgtaaagccctacaatgaaaaagaagactgcaaattgtggccttaggggactttccctgccccgttcagagacacatgatttttttttaacagaaatccctggaaaaattactttagagccatgttttcttgcattctgcatttt

SEQ ID NO: 176739 - DNA, 658 bp, Homo sapiens
cagctcacatgattttggaggctgagaggtcctatgatctgctctctgtgctggaggcccaaaagccagtggtgtggtcccagtccaagcctgtaggactgagaaccagagaagcccccagtctgagtctgaaaaccttgagaaccaggaatgttcgtgtccaagcacaggaaaatatggtgtcccagctcaaagagagggagagcaaatttgcatcagatgaggaccatccacattggagatggtggtcatcttcactcggtctgctgattcaaacgctcaactctccaagaagcatccacagacacacccagaaagaaggttccaccagctacgtggacatcccttagctcaggcaaggtgacacataaaattaaccatcacaaagaaaatgctggagctcaagagaacaagatgatccaagcttctgcttctgctgtgtctgctactgcctcactggtctgctttgggttgaccccagagtcaggggagaggaagtttgcttggcccactgagagctgggacaaggatgtggatggatggttccattacaggagagtgaggggctgagataaataatttggtctccccagcacatctgtgccagcaactcccaaatatgtttctaggccaggctgtgaccttcagactcactcca

SEQ ID NO: 176740 - DNA, 524 bp, Homo sapiens
ctatttcccaccagacattaaagattcctgaggaaatctatggtcatggtcctttaaaacataatagttactcttttaacagtgcagtgggctctccttggaaactctttagctactagaaatactgttgagagtagaccactcaaccccagatcttcatagttccacccagctgtaattaggctgtggcctgtatttttaatgtacctctcctacctgacccttcttatgcttagcctcatcctctaatggatgccattgttgacctatgactcaaggctgcttgattctgttttctgacttactacatgcatcttgactcttctgcctgacatacttgctcctctgtgtgtccttcacaaatccctcccagtgctcactgccttatgaatgacaaactgaggtgctggacttattccagtgttcacatgaataaatggctggagatgtaaaccaattcgctgtaaaggaaactgtacatctttacacctttgctacattttgagaaataaaatgattatttt

SEQ ID NO: 176741 - DNA, 550 bp, Homo sapiens
atgtttagcaaatgtggagaaatcaaaaattctcacacgttgctgatgggaccatgaaatgtttggcaatttctcaaaatgttaaacacagaattttaccatatgacccatcaattacactcctatgtattcacccaggggaaataaaaataaatatccaaataaagacttatatacaaatgttcatagcagcattattcacaatagtcaaaaaggaaagcaacccagatgttcattaactggtgaatggacagacataatgcagcatatccatatgatggaatactatttggcaataagaaagaaccaagttaagtactgatacatgctacaacatgaatacatggatgaccctcaaaacactgcaagcttcatgcggggatcataattcttggctacacaattaaaaaaaaaaaatctaaacacccctcaaaagacactgagcatgaaagtggtcagatctaggttttacataccaggttataacatttcttctaaggatgtagtattctcattttaatgaaacattctcactagtgatggagcatgt

SEQ ID NO: 176742 - DNA, 586 bp, Homo sapiens
aaagagtgccttttgctcactgcatacaggccctatacaagacagtatatcaaggaattcatctggggccccaatctagtagttgaggaacaagaattaggataatgctaatggaaatgaaaaggagatgtgccaagggaaatcacagatgagtctatcataaaaggtgggaaactaatttgacagaggtggaagagagacaggagcgtttaagactaaagtagaggttctcttatccaaatgcataaggattgacaatttggcttatttttttttaagtcagttaaatttggaagtcataaaaaatgatacatacctaaacaagtcattttaaatgaagctctacaaatatacatttattgtcaatcttttgttatagtgctggagccttttctttgagtatatgtccactgttgtactcaatggtctttcttctataaaccatcccaaggcatcatcctccaagtccaatttatttaaagaacagtgaggttctaaagagccctggaaagtgaagtgcggtagacctcattaccctttacaaatgccccatacccctctctacgtcccgccttgctgaattcag

SEQ ID NO: 176743 - DNA, 698 bp, Homo sapiens
aaaactgatatgtgcccatgcttggcaaggccttgtggtaggccaggttggctctgtctttggtcaggacagtgttttgactggggctgattcaacaacacttttgggttttgggttagaagtagtttgtaggctgggcgcggtggctcacacctataatcccagcactttgggaggctgcggtgggtggatcacctgaggtcaggaattcaagaccagcctggccaacatggtgaaaccccgtctctactaaaaatacaaaaattagccaggtgtggtggtgcatgtctgttatcccagctactcaggaggctgaggcagaagaatcacttgaacccaggagggagaggttgcggtgagctgagattgcaccattgcactccagcctgcgtgacagagttagattccatctcaaaaaaaaaaaaaaaaaaggaaaaaaaaaaaaaagaagtagcttgcagagtttgtcctgtgcttccttccttcaaaacatatttatcaggtgcctgctatcctaggcattagaaatgcagtggtaagaccaggcgcagtggctcatgcttgtaatcccagcagtttgggaggccgaggcaggtggatcgtttgaggccagaagtttgagaccagtctggacaacatagtgagaccctgtaacaaaaaaataataaaaagttagctgtgcttgatagtgtgcatct

SEQ ID NO: 176744 - DNA, 461 bp, Homo sapiens
ttaggaaaattcgtgaaagctgtgctgagccaaatctctatccatcatctctcctccttaccctcgactccaaggctcacaaggcagcagacatcgttctggccagcaaatctggcttaactaaatgtggcagagtcaagttaaggggtgtgtgtgtgtgtgtgaaagatccagtctcgctcagccaggctggatctttaacacaactttgaggttttcgtttttgaaatatactattgactaacacagtaacttccccagaaaagttttgaaagaggaatgatttgatttttagaggttcaagaactcctcatgcttgagagaaggaaaaaaatagagaagacaaataactaaaatatttattatctaccacttggactgatttaaaattgagtttaaaaaacaaattactccacagaaagatccaagatggttatatctaatttatgcaagaaatctgg

SEQ ID NO: 176745 - DNA, 261 bp, Homo sapiens
acaaatcaatgcccctttaacctaccacatttgagaaaaaggcacctcagttctcatattgctctcaagaaatgcacaagacttttgggaacttcattgattttgtagcacttggccaaaaacacattctgtgcaatcatccactaaaggaaaacaaaaagcaggcaactgagagaagagacccaggagggcaatgcaaagtcagttgagtgatggcctctcccttctcatgtaccagtattctactgtacggatgacgag

SEQ ID NO: 176746 - DNA, 320 bp, Homo sapiens
gggggaaacagccctccattcatttgctacaaggtccacagaaccatctcagggcttacggggacagtgtgtcaccagggcaactgaaataaacacgaaagacagatgtgaaggctggaattcttcaaaggcaagagggtttgacacttcataaatcactgtgtcactctgctataacaaaaactggtctcatgtactgtacccgaggctttctctcgctgtacttgcttgtggagtctgtttgcataccacatctggtttgtcactaaaagctttataaaggcagtgaatcaataagagtgagaaaagggtggggccct

SEQ ID NO: 176747 - DNA, 126 bp, Homo sapiens
ttagacttgccttttattgtaggtatgctaattataaaaggtatgctaacctataactaatctatggtgatagaattcagtatagtggctaccttgatagagcatgaaggagccttctggaatgct

SEQ ID NO: 176748 - DNA, 895 bp, Homo sapiens
aaatgggaatcttgtttttgttttttagaaaatgagaaatgccaaatgttaacaaagattttgtcaatattctttattgttggagatttgtgcaacttcatttataaatgaaaatcagatgaaggttgacagagctggagttgttagagggcttggaaggaagtgtctgaataaggcactctgtatctcctatctgagaagctcactgaggtttgctactgtcagcctacagtgcttctgcagagatctgtagccatttagtgccctcgggctgatttcttttggagatctatttacaaatgggaaattggaggagtcacagttttgtagccagaggtagaaacaaaggtcttagctctgtgtactgtctcttagagaaacgagtaagctgttctttctgtaattcacaattagtagaatatgattgtgtgtgggggcctaaggattgtgatgctactgaaagacagaagaaagtccagctgataggctaggcgtgatggctcatgcctgtaatcccagcactttgggaggctgaggtgggcggatcacaaggccaggagttcaagaccagcctgaccaacatagtgaaaccccgtctctgctaaaaaatatataaaaattagccgggtatggtagcatgcctgtagtcccagctacttgagaggctgaggcaggagaatcgcgtgaactcaggaggcagaggttgcagtgagctgagatcagaccactgcactccagcctgggcaacagagagagactctgtcttaaaaaaaaaaaaagaaagtccagctgatgtagaattcagaaaggagcatgatttagattagaatttaccttcttgcattttaatttgctttgatttctttaaatattttatttggcaacttcatggatg

SEQ ID NO: 176749 - DNA, 373 bp, Homo sapiens
gctccagccaggctctcacccccttccttaaaagtgaaccggatccaggaccaacagcttgagacagcactctgggaagctgatccccaagttgacgtctgaggctcaaattctctctgattcaaccccacgaggagccagctggggtctgagccggggcagcagggacagagctgccgccgggggtctgctgccagcgggcatcgccgaggagggcgcagcctgcgggctggatagaaaccagacaaagggcactccaggcccaccgggccggccatccggagggtctacagctaattaagactgaagggagcactgaataacccttttgtggatcaaaagcactctgttggaaacccagctgacaactcca

SEQ ID NO: 176750 - DNA, 520 bp, Homo sapiens
tgctacagagatttatttatactttgagctaagacaagattaattggatctaagatactaagcattttttagaaatagaagctgacaaaaatttaaatttagctttataattggtaaattaagaaaaaatctggtgggtttttaagcagctgaaaaagagcaagtagaggattttgactcttctttaattggtatacactcttctgtcaggaaaacaaacaaaaagattaggatgtcacaatatcaagagtactgacgttaaactcttaaagtctattcacataattcactgaaatctctgtcattctttcttagtctccatgtaacagagaacccacctaaggggaagcatcaggggctgagagagtcataaacgctcctaccatgggccgtatttgtctcatacattcactagttctggttaaggggactgagtgagctagctgcttgcttggatcatgtggtcagaggtgacagcctatcttcagttgatactttgtagggtatttgacaaagtcag

SEQ ID NO: 176751 - DNA, 707 bp, Homo sapiens
  misc_feature (335)..(335): n is a, c, g, or t
  misc_feature (396)..(396): n is a, c, g, or t
  misc_feature (529)..(529): n is a, c, g, or t
ggaaaagccactggggacgagacaggtgctaaagttgaacgagctgatggatatgaaccaccagtccaagaatctgtttaaagttcagacttcaaatagtggcaaataaagagtgctatttgtgaaaaaaaaaacaacaaaaaaaagaaaccaaaaaaaaaaaaaaaaaaaaaaaaaaaaattgtgtgggggcgcgccccggcggcaccggaggaaaagagttttttaaaaacccactcgtgtgtgtgggggcgcgcgggccccccagaatgtgtggttatgatgcacaacgtggggccaagggggcgtgttagccaagaagaaaacctcgtggncaccggaacagagtgggcggtgggtttttctcccccaaataaaaaaaaaggcgccgggggngaacacgggggcgcttcggagacaaccatcaacagcgaggcggtccgggagggacagtacggggggtcaacacacgagggaggcccacagggagaggcccgataaataaaattcgtcccgcgcggtgtagtanaagaccaataacgtacacaaagcagaggcgaacacagaacaacacagagacagcatagaacacgagaacagcacagagagcacacagcagacgagataagacaaagcaaccagaagcacacaaacaacaagacgagacgcaaacagcactaaagcagcaacagagaagaacacgcagt

SEQ ID NO: 176752 - DNA, 316 bp, Homo sapiens
gataaaacaaaagtaataatagcaccataggactgttaagaggattacattagagaaaattcatgtaaggcacatagcctaatgcatggcactcagtaagtacctaaaaattagtagcaactattcatcttcgtcatcattatcatgatcatcaaagctggagcctaggacccaagcctcctagctcagcattcctcttacaacagccctttgaatcaccttcatatgtcgttaatacttcattgggtaccccaatctatattagtttaagtacagactgtggtgacatcattagttagagtctgtgagatgggag

SEQ ID NO: 176753 - DNA, 169 bp, Homo sapiens
tcattcaagttcttcattcgttatgtgagagctcctgagtgtgtgtctctcgctgggcctgtgctggtgtagggtgtcagtgcaaaaaatatgtccaggcctccccctcagatcttaacccccatcactgaacgtgaaatcctgtgtttcccaaagtgtccatgtcact

SEQ ID NO: 176754 - DNA, 162 bp, Homo sapiens
ggctctgagtttttttcgcctttaacctaagtcctcaggactaaaccagcaatacaagctacgctatagccccattttacaggaagaacattgaggcccacgatgggctcagaaagaggctttcttcattaaccccactgaatatcttgttctttggcctta

SEQ ID NO: 176755 - DNA, 174 bp, Homo sapiens
tctccttcttgggtcttagacatttgatatgggagtaaaaacaatccctgtgtataatatattttcagatcatgcattcttgcaaccggggaagaatggcctacaaagcctgattgggaccacatatatcccggatttccttggactgactcaactatttgtcccagctccaag

SEQ ID NO: 176756 - DNA, 356 bp, Homo sapiens
gttactgatgtataatgtccttctatgctcttgtaacagtttttgtcttaaagtctattttttctgatactaggatagctactcccactgtcttattaattactatttatatggaatgtacttttctatccttttacgttcaacatattgtgtctttggtactgtagtgattgtcttatagactgtgtatagttggatgctgtttttctcttttatccattctactaatctctgtcttaataggagatttcaaattattttcttagtcattaccctgcagattacaattaacatatttataatagtcatgttttaattgaaagcaccttagtttcaaaagtgtacaaaaaccgctc

SEQ ID NO: 176757 - DNA, 341 bp, Homo sapiens
aagaatcatctctagacctgtggatggagcagttggatagttggtgcctttcctggagaggtggcctgtaagagagaggtagagaattggaagatgattttgcaatgttatctttgagatttctgaaatacccaagtggagatattaagtaggaagctgatttgtaaatgtggagctcatcagtgtcttagggggatgccaaggaaacaccagatgggtttttaaagcatgagaatgtgataattgtgctacataatcttagacttttgaacttataaactatttctttgctatactgaaatagaggtatgatctattgtattaaattgacatctgaatgg

SEQ ID NO: 176758 - DNA, 556 bp, Homo sapiens
gtcctctgccaccttcaagattgggcaacaggagaggtggacctggccccaccctggccctgcttggtgtatcttatgataattcactttgatgttgtttctttcatttgtccggccattttccattgtatgagtgtatcataccttgtgtatctccttgatgacgtttccaatttcttcctcctgggatgctcatagagcttctgtagagtctctgcctggaagaggaatgctcacagatgttctcaccttcaccctgatcttgacctgaccttcaagctgccattttgtgtcacttccaagtggctttaccaatcttctccagagctggtgggtttttatttgtttgtctgtttgtttgagacgaagtcttgctcttttgcccagcctggagtgcaatgatgtgattttggctcactgcaacctctgcctctgcggtttaagtgattctcctgcctcagcctcccgagtagctgggactacaggtgcgtgccaccatgctgggctaattttttgtagttttaggagagatgtggtttcacggtgttagccagga

SEQ ID NO: 176759 - DNA, 235 bp, Homo sapiens
tatcaggataataatgttagttcactgatatattacaaaacttatagcacaaaacttccagtgtttttctgtaaaaattatatgtgagttaattgacatttcaaaacagcttttaaacatcagcctttaccaagtacattatataggcgttctcttagatgttgggattcaaagaggtgcgagatggtgggctttgtgcccggagagaagctgattgtccacctattagaactgg

SEQ ID NO: 176760 - DNA, 896 bp, Homo sapiens
gttcctaatttggttcctgatttcagaagcataccacataagatttaagcaagctcatctctaggagatgcataatttgtggataacggttttcttagttgggattgtgtgtacttcaggtattatgtaatgctgaacagcttacttgctttttctttttttccccccagagataaactgaggatcacaaatattattcttttatgttaataatggtttccattttctagtatttgttacattttacggctttattcacaaagctgtttatgtatttttgtggcagctctaagttaaaaggcacacttgtaacattacagtcccaattttccctttatcaactttatattataaaattttccaacacatagtcaataagcatgtccatattctagaagtagatattcttaacattttgccatacttcccatttctaattattttttaaaaagaacttacaaacgggccgggagtggtagctcacgcctgtatacccagcactttgggaggccaaggcaggcggatcacttgaggtgaggagttcgagaccagcctggccaacatggtgaaaccccgtctctactaaaaatacaaaaattagctgggcgtagtggcgggcgcctgtagtcccagctacttgggaggctgaggcaggagaatcgcttgaacccgggaggcggaggttgcagttagccgagatcgcgccactgcactccagcctgggcgacagagtaagactccgtctcaaaaaaaaaaaaaaaaaccaaaaaacccaaaaacttacaaacataatacaatcctaaatacttacatagacatctctttatgaataagcaagattacctacataatcccaatgctgccacaattaattaataattctaatttccagtccg

SEQ ID NO: 176761 - DNA, 460 bp, Homo sapiens
atctgcccacctcggcctcccaaagtgctgggattacaggcatgagccactgcgcccagcccctgcaggctgtttttcgaagggattgggtctcactctattgcccagtcagtggcgccagcatagctcatggcggtctcctcagtagcctgaacttacaggtgtgcgccaccatgcccagcttgtaggcttaggttttttgttaaagaaataaatgagacctgctaggactgaaaacttacacatcttcacaaagggtgctttgcatacacatctcaatcttcacagcaactctacagggaagtactggagaattattcccatttttaaaaaagtaaatacggctgggcatggtggttcactcttgtaatccaagcattttgggaggccgagtagggtggatcacttaaggtcaggagtttgagaccagcctggccaacatggtgacatctcgtctcta

SEQ ID NO: 176762 - DNA, 292 bp, Homo sapiens
agaaagagggaaattggggcaggaacatacacctgggagcagggggaggcagaggttggagtgacaacctgggcaccaggagctaggagagaggcatggccctgagtctccagaagggcctccgagggccaggggctgaggaaaggcaggtgcactgaacaactcaacaaccctgccgcttacaagtcagtccctttgcggggccttgcagacccggggagggaacagccgtgctggctgcactcgccagggataactatggcttgcttctcattggacgaagtgcccgtca

SEQ ID NO: 176763 - DNA, 472 bp, Homo sapiens
ttccagaggaaacaggagcccaaacctttggaagtcagctatccttttccaccagttcaagatgtattacccagaactgcattctggtaatggagcaactacaattggtcaagtgattatgtaaatcagtggttcttaacttttaaaggatcatgaatccaataaaactgtacagatctccttcctagaaaaatacataaacataagcactcacaatcttcatggaatttcaaaggcttcgtggattctctgaagcccatctgttacgatcattagagagtcatagacctatacttttggtgtaggtgaaattatttatttcagaaatttgttttgaacagtcttataaatcataaaccatgggccaatttaaatctgatttcttaaaatctgctgctagattggggtctaatttttttttaattaattgctagaatgaatgagatccagaatattagttgtgtgccatcca

SEQ ID NO: 176764 - DNA, 451 bp, Homo sapiens
gaaaatggcagataagaagtactctcgaaagatatcaagtttttagattctaataggaaatagaggacatgttattctctataaagtctttctacccttattagactagaaattacataaagataaggatcatgtcacttttgtcaatactgtgcaaccagtgaaacacagtgaatactcagtagataattgttaaatgagtgaatgaagtcccccagacacagaagctaaggagacttgaaactttctaacaggatagcaggtcttaaagttcctggatagcttcttgtctacttcagccataatgtcaccctgtatttaagaagacttaaaaacaagaaaacaacttcatttccttaggacccatggcagaagaaaggcaattagcaaatagcagtatccttggcttccctttttcgaaatcttctaggcaatgctcatgggtgccact

SEQ ID NO: 176765 - DNA, 236 bp, Homo sapiens
tcctgctcgacaaagtctctgcagtgtagtagcttgaaaattatggcaaagccatcaactgctgccacttaaatagcattttttgaaagcatattcaatcttagggaaaaatggtcatagtaaaagtcatactaaaattctgtaggtagggaagtggggtcatttttttcttcaataatcatatctgtgttttccacctctctagaatgaacattggtcactatgtaatgtaaaaa

SEQ ID NO: 176766 - DNA, 284 bp, Homo sapiens
gaggatcacttgatcccaggagttgactggcctgctcaacatagtgagaccccatctctaaaccataaaaggaggataattgtagtactattcttcttactaaacttttttttgataatagttatttttcattaaaaatgaatgatctgtgttaacatctacttgttattattttagtagttaaatgaattactagtttaatttctccattaaattttaatggtaaacatccacagatataatctacctaaacaaaagttctttatcatcctcaataattttta

SEQ ID NO: 176767 - DNA, 534 bp, Homo sapiens
gtaccaagggtacaataattaacacttctttcccttggggaacttttattttagtagagaatgacagacagtacattgccctttgtacttccttaagtcctagaactatagaacataatattgcaagagaactcagagatgttatttctgttcaatcctctcattttacagatacttaacctgcacagagatagaatttgaactgcccatctcaccattagagtagtgagactttcatctacattgcctagattgaaaaatgtgatttgattcacactgaagggcatagtcactcattgttttaatgtgccttttacatatggggagtagtttgtcatctttggtcagtgttgattctgaaggtagcattttttctttttgttattaatacacccctaccagacttgcctttgaatgcaaacgctccaccttaatggggtcaaatttagggaggaatgcttcacccttagagcaagttcttatctcatataacatgctgctgtctctattcttgcaaactgactatctatcatc

SEQ ID NO: 176768 - DNA, 302 bp, Homo sapiens
gtaagtacataaagaatcatcagtttttaaagttggaaggaatcttagaggtcacacggtgtctacttctctactgagaatgattcaaggtcttcccaccaaagtttgctatccaagctagatgtgaacatttgcaaccaattcttctggaggacaagataatttctcaaaagtatctaaagatacatacatacctatctccttccttttacaaaataaacttctacaatcgcttgccttcaatttcctcctgacatcaggtattcacacttctactatatgatgattcacctctgactcag

SEQ ID NO: 176769 - DNA, 521 bp, Homo sapiens
atgaaaaagcacagtggaaacttagatgcacactgctaagtgagagaagccaatctgaaaaggatctgtgatatatgattccaaccatatgcaagctggaaaagcaaaactatggagacagtcaaaggatcagtagtttgggggttgggggaagggagggataaacaggtggaacacaggattttttagggcagtgaaacagctctgtgtgatgctacaatgatggatacatgtcatttatacatttgttcaaacccagagaatgtacaataccaagagtgaatcctaaggtaaacaacggtctttgcggatgattaatgatgtgttagcgtaggctgattgtaacaaacgtaccaccgtgatgcttgatgtcaatagtcagggaagttatgcatgggggaagggggctatatgggaactctctgtacttcctgctcaattttgctaggaacctaaaactgttctaaaaatagtttattaattttttaaaaagattaaaatgcttacaataatttaaaacc

SEQ ID NO: 176770 - DNA, 361 bp, Homo sapiens
aggatactcaccttggccctggtgggctggacagtgaagtggtggagcagccttctctcctgcttggcagcctcagacagttctttgcacagagtagtaattctagtttcatcttcttattcattaaccaattgtgaaattagcaacttattttcttcctagttatttccctttgaagttccataaaaatctgaactctccctcactcctgctccacataaaacagagcaaggctgcgacccccatctgatcagaccagccatctgtgttggaattgtccgaggagagtgagccgggtgggcagggccaggctctgcaggactcctggacccctgatggccgggcccagcctcagcggccg

SEQ ID NO: 176771 - DNA, 370 bp, Homo sapiens
acaaagctgccattgcggttcagtggggaaaaggatgatctttatgataaatggtgctgaatcaacttggtatctgcttagataaaaaccttgacctttacatcaaaccatacacaaaattaatttgagatgggttatagaatgaagtgggctaaaacaataaaatatctggaaggaaacataaggaaatatgtttagagaaggcaagaatttcttgaataagatgcaaaaggccttaaccaaaaaaagattgagtaagattttttaagattaaagtgcatttcaaaactgtgttcatcccaagggggcgtcaaagatggaaaaagtccagttttaaagaatgaacaaaagacttaaaacgaacttgtcc

SEQ ID NO: 176772 - DNA, 694 bp, Homo sapiens
tcagcccagctccacactgactagctctgacttggacaagttattaaatgcatctgagcctcaagttgcccatccgtaaaatgggaataatgttacctacctcacagagtttgtgaaagtggtatgatgtaggcacatctaaatggttaagcccccagaggccagccatagtagatgctgataaaaataccagttgttattaccgtatgtaaaatcttgtgtaattttctttcaagtgactgaactggcctttgcttaaacacttgacttctcaggaaacaaaaagctaactccgggtgtggggtaaattgagaattgcctgtggctggcccctgtcccacgcacccttccctgttagggatctggctgagagtttccattccgttcttattccagggcaggaaatggaaacacaggaagcagatggttggcatgggaaaggctcccaaagacacagccactgtcacccagccccttgtttccctctcagtctctaagggctcccatttttccaaccatcactagcttttctgccaccttcagagccctgtaaatgctgtgactgccagagtctaaccagcggttcattttagttttgcctcaaggtggatggtctctggttcccccttgactagaaatctggggtgtgggtagcctcccaaaaggatggctctgtaagcgggtctcaccagca

SEQ ID NO: 176773 - DNA, 134 bp, Homo sapiens
attgtttatctgattttatgctgttctgctgcttgcccctcgagatcaggtttcatgggtagacaaatgttaagagccatgtgaatctcgatggagcctgtttttgctttgttagttgtgtgtgtgtgtgtgtg

SEQ ID NO: 176774 - DNA, 469 bp, Homo sapiens
tgggcaatgtgtatcccagtacttgggagacgagggggcggatcaattgaggtcaagagttcaagaccagcctggagcaagataagatctgtgaaatgccctctagaatcagagaagatatcagcactaagatatttgagtattaaatacagtgtttcatgatcctagaaaagtggaatgggtacttccaaagtaaactgggcaaatccaatatgcaaggtcactgaaatagagaaacgtcattactgctttctcagactccggcggtggacactggacacagcgtagtaattaacaggacagcctctggaaccaggctgccagggtttcaaagcagctccaccacattcctagcatgtcaccttgagcaagttttcttcacttttgggcctcggtttccccaactataaaatagagaccataactatacctactctcatagaatcatgaaatatagggctgggcacag

SEQ ID NO: 176775 - DNA, 397 bp, Homo sapiens
ctgatccgcttaagcctcccgagtagctgggtgccatcatacccggcgaatttttagtagagatggggttttgccatattggtcaggctggtcttgaactcctgacctcaggtgatctgcccgcctcggcctcccaaagcgttaggattacaggcgtgaggcaccacgcccggcccctcagagtttcttataagtaaagaaactaacaaaggatagtacgttcctcctcctgctttctgacaccctacttggtaatggagtagctccaagactcatcttgaagtcgttcctgggtgagatccaagaaccctttcttgggatctggatcaggcccttcttttttccagcgacattttcattctgtcatccttaagcggatcagagtgtctctttcatg

SEQ ID NO: 176776 - DNA, 661 bp, Homo sapiens
tattaaaaaatacaggatttctttccagaatgatggttgcacacctctgtgcatgtaccaactgaattattcaatttgaatgaagtgtatggtatgtgaattatatcttaataaagtcattactaagaaagaaaaaggctattcaagcctacaacttgcaaagaattagagtggagtaatatataagaggaaagaagaacaggggctactgcttaagcacatccagttggagataataacaacttgaactccttcaatggacacagggaagaagggactaataaagtgaaacactgttgaaagaacagtagtacctgcgactgaatgtgagaaactaaggggagaaagatgactatgacaacccccagctttctacatgggtacctttacactaggcactgtaatcactcaagtaaagcctggctttcccatgggcaggagactttcacatatggtggctgcagtgggtgtgtgacaagtctccttcttgaaagaaaactattctctaagtccaccactggggaaaaactaccaatgctagccagatcttagggatctcagctatgttccatgacacagctatcagccttgatgccagagaagaaccatctgtcaacaagaggatagttgtttttggaagggtacgagctcgattgtcata

SEQ ID NO: 176777 - DNA, 444 bp, Homo sapiens
cagagtgctcactggcatgttctgtaggccagcgtgaggctgtggcaagttcctaggagcataagagcacaaacagctaggagctggctggcagcaatctgttctctctttagaacatacatctgcccatccctctcataacataataaccaggttattatcctcctaggtttaaaacctgaaactccagaaggtgggaccttttcttccttctttttttaaaactcttatctgcgacaccaaaaaagcaagtttaaattcatgtcacctgttctcaaggtaacagaacttgagaaataatacgttcacaatatccaaacagagctacagttctgcaactcaaggctgtaacatggttaggatgaagactctaaaatcagggtgtgggcagtcacttcctctatgaaagcagaaaccgctggcctacagcacatgcctcttctg

SEQ ID NO: 176778 - DNA, 246 bp, Homo sapiens
ctaatttatataaacacatgagggttctgccaaaggaaagcgtcaccgtgatgggtgctgactgctcacggagctattttgcacaagttagagtcaggtggttggaggaaatgaagcttactgcaaaaaataatggtttcaggtaagcaaaagcatcgtgtccttttgaggcctgccaggaggcgtggtgtgtggcctgtcgcattgctcagaacctgatggggcttgaagggcagcgtttctcct

SEQ ID NO: 176779 - DNA, 404 bp, Homo sapiens
tactagatcaaattaacccaatgacagtaaatgaaattatctgctctctttggttccctgatgtgaaatgcttataaatccaaacgttaaatctttaaagcgatcagaagctcttcttcttaagtttctcaaacgggtcctttcttcctcttgctctaccctccccacctcctgtaaagtagttagcagtataactataaataactgtttgtgtttataaggaggctgctagttagaaacagatctgtcagaaatccttatttaaatcatagagctctttcgcactatgtataatcaattctaattatgttgtttagtgtagatactaatttattacattttatgaaagccttgtagagggccacaccacagacttaaaagtacactaaagagttaatttcagg

SEQ ID NO: 176780 - DNA, 778 bp, Homo sapiens
aaatgtgacatgtggttataaaggtttgcaatggaaggaacctaaaactgagggttctggaagattgtctcatttgactagtggtggaaaaagaaatgcatgagtggattgcccaacatgcatttggaaaattaaactccttatccaatctccctcacccctcccacttcccccttctaaaagaagactttttcctaaaagctctcctgatcctagcttttagaatagaaattgacgtcatttttagcagattatatgaccattcacatcctttaaactttgaggctgatttaaaatatcccacttcctgtttaggagggggaggggctcatattgcaaaaaaattaaaaaattctgctttttaaagagtgatctacagtaaagcctgattaactggaatctagctaactggaaacctcagctgcatgctcttgctcccttccatttttagcaaaaaagaaacaaagaaaaaaaatcacatcagaaatgtaaaatggtttttcttccagggtagtttgcattgtctcacttagtctccatcctcctgcaacttccacatctatgaggaccaaacaataagagttgatcttcacagaaaaggccatcaagcaatcagtataaatgataaccaaggaaagattcaatcaggtcttctaccttaagactttcaggcaggaaagtggctcaggagtctagcaaagatattcactcatcatccatgaaacaaaactttcctccatggccccactgttcattaagaaagtcatataattcatca

SEQ ID NO: 176781 - DNA, 308 bp, Homo sapiens
aaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaatgagaggataatagagagtcagggagaggaagcagagaggagacagaaggagagacttag

SEQ ID NO: 176782 - DNA, 212 bp, Homo sapiens
cagttagaatagagggtctccaaggaccttttcatctagaagaaacccaccagtctcctgaaatgtgatgcccatcttgatctaactagatagacacttatattctgaggtcaaaacttgaccaaatgttcattctccagccataggtgttagacaatacaagtgcctttttaaaaaaagaaatattaaggctaggcatactggctcatgta

SEQ ID NO: 176783 - DNA, 472 bp, Homo sapiens
caggcttcagttccctcctaagtctatttggtatatatagtagcatccagaatattaaagcaaaatcattacagatgcagtcctctatggtcctcttggctgcaccacagatggcaagatgcgatcagagaggaaagataaatgcattaaacttctccttgcttatatcccctggtaggaagagaagtaaatggaaagcaatagtttagtaaatgacttcaaaatgtttcttaggtttttaaatagccaagaatacaagcaagaacttatggtcctaataacttaaagaagtccttggcagatctagaaagaaagctctctgtggagggtgagaagagagtgacacagaatgtacacaatgaacataaagcagaggatctaaaaattaatactgtctacatctctgctcttcctattgagtttgtttttcaatgcatgctagatgtgaaggcatccttagggcctgtgcagt

SEQ ID NO: 176784 - DNA, 354 bp, Homo sapiens
ttcaggatttcttgggggcaggattttgctacatactttgggatgcctggtgatgtgtgaggtgcttccacactttctaatttcaaatttcaaggatcttcagtctggctgcagtgaaaagaaactaaaaaactgacttcgcaattctagcattgtaaaagacatgtacatacaactgtctctcaccttcatgacatccttggtgaactcttatgtatcttttaaactgctgttcaaatgtcgccttctcaatggagccctccttgaccactcccttgtgaagttagaggattcttcctttgagtaagaagttaaatgtttcactttcttctcacaataccctgtattgtactt

SEQ ID NO: 176785 - DNA, 205 bp, Homo sapiens
tttctttccttaacacacacacaaaggatttccaaatttccatttttaaaaagttggcttctctagttctctccagaaggctacaaacatatcctcatctgcgtaaatgtaaggcactgcacacatactttaattcctgaggtacttaaaaaatatacatcaacaaccaaaattcttcacgaacaggttcttctaacatatcaga

SEQ ID NO: 176786 - DNA, 428 bp, Homo sapiens
gtaaggattcggcacgagggggacgggctaggtcacactctgtctatgtgccagacacttgcacaaccagggtgaagaaaaccaggcatctaccgatggtctttcacacttggctgtcctctctgtccccatgcatctgccttggttcaggacttcacatcctgaatgttggccccggctttctcagtggtctccctccttcctgtctctctccctcacatccagtctctgcatctatcacagagtgaccaggtgacccctgcttaaatcccttgatccttaggatgaaaggggagctccttagcttgatgcaacaattgacagtcccctgaggggcctcacccccacccaccagtaggttgtgattcaactgaaccatttcaggagcacctactgtatttagatacagtgctaggctctctggggga

SEQ ID NO: 176787 - DNA, 778 bp, Homo sapiens
gccttgaaggagaaaaacagtttccaacatcatggcctctgattttgtcatcttctctgggactggttacatattctggcccatttttgtgcacattttaaactgatgggcaaattacaacaagaaaaattcagagttcaaatggttaacctacactgtggagttaagtagaatcttctttagctctctaccttcctctcttttctgcctgctttaaatctgctgttattaaactgctggcgcgagacaagactcattatttatggtctaaattgaatataaacattgaaaactcatttgaaactgaacagcaaaaaggggaaaagatttaaaaagaaaaaaacccaaactgccatagagactgctttaccccaaattttggctgccagctttccttggattacctatcagggcaaacaaagttagccacgtggacagcttccagttttgtcagaaaaacaacttgaagccagcttttataggtcagtgagtttgtgatgctatctcatgattagagttctcagataaaagctcttagacctttgtttgtgtatggatgtatacatgtttagatatgtttatgtaatgtacatgttatagttatgttctgtcgtgtctagcatgctaccaaattggctttataagtaagtgagtacacataaattaagttcaaatgctttccaagttcgcatgaatctttgataaataaaactggcttcaaaaattattagtaaaataaaaacaaaaatgccttcagaatcatcagcatacatttgtg

SEQ ID NO: 176788 - DNA, 595 bp, Homo sapiens
gctgttttcaggaagctcaatgaacttcaagaaaacagagactgaatttacaaatttatcagagaaagttaacagattgaagtaatagaaaaaatcaaatggaaatcttagagcagaaaaatacagtgaatgaaatgcaaaaatgaaagagagagcattagtagcagaactgatcaaatagaaggaggaatcagtgagctcaaagacaagagtatttgaaaatacacagagaagaaaaaagaaaaaaaatgaaaagaaatgaagaaagcttacaagatctatgggacaacatcaaaagaacaaatattcaagctatcagagttaaaaagggaattgagaaaaacaaggcagaagaagacctattcaaataagtaacagcaaactttccaacctggagaaagatagaaatattcaggtacaggaaggtcaaaggtcaccaatcagattcaacccaaataagaataagacatactataatcaaaaaactctcaaagatcaaagagatgatgtcaaaagcagcaagagaaaagaagcaaacaacattttggggagatccaatatacctagcagcaacttctcagcagaaaccttatag

SEQ ID NO: 176789 - DNA, 769 bp, Homo sapiens
ctgaaaacaaagcatgctgacaggtgctgagggcaagactggagccaaagctccaggtcacttttcatcataagcctgaaattatttaagaaggattaagtctcaaaaggccttggcatatatcataatttatgccagaggaaattcataaattcaaggccaaacataaaatggctcaactttacacagtaactcacataatatagcaattggaagggtccccagagtccagtctctaatttatcaccaccaccctcctcctacctctcaaatctctcatctacagtttgagaaactgtggcccagagaaataagacttgtccaaggccacacagaaggtcagaaatgaaccctggaataagaattcagaacttactccaagagcccttaccctgcacggcatgtgctgtaggccagcgttgtatgcaaaaggccaacacccagagtgtttggttcttttttccctgatttattttaaaacattttattgtaaattggtaatttatagttgtatatatttatggggtacaaaatgatgttatgattcatgaatataaagtggagcaattaaatcaagctagttaacatatctatcaccttatacttattttttgtggtgagaccacttgaaatttactcacagcgatttttttctgttttgcttttgagacagtctagctctgtcacccaggctggagtgcagtggcacaatctcggctcactgcaacctccacctcccgagttcaagcagttctctggcctcagcctc

SEQ ID NO: 176790 - DNA, 875 bp, Homo sapiens
attttagaaatatcactttgatcacaaaaagacaggtcatggggtagtgtgtggtatctttgggggaagggaggagagtcaggggctgttgtcagtaatccagatgagggctgacagtaagaagatgttctggagttaccgtgtgccttagttggcactactccttctgacaatgccattcgtttgggattaatttttattagggttgtatttattagatctccattttaatatacatgtcttctaaaataaattacaggctgggtgtggtggctcatgcctgtaatcccagcactttgggaggccgaggccagtggataacttgagatcaggagttcgagaccagcctggccaacatggtgaaccccgtctctattaaaaacacaaaaattagccaggcatggtggcgcacgcctgtaatcccagctactcgggaggctgaggcaggagaatcacttgaacctggaggcagaggttgcagtgagccagaatggtgccactgcactccagtctggacaacagagcaagacttcatctcaaaaaaataaagtaaaataaaataaaatgaaataacatacaaactccttgaagactaaaataaaaggttaaaagagtaaattttttaacatgtatttcgtcacagtttaaaaaatgcaaaactggcccaggcaagcatgcaccttgccgccttcatgaacaactccgtaactggctgagccgccccagggctagtcaaaacacagcagagaagaggtcagccggaaatgtcccaaggtgcacttacttcccccatgcagtgccaagaatgcaggtcctaatgctggctctgccacagcttgtaatctgacctcaggcaagtctctcctcccctccat

SEQ ID NO: 176791 - DNA, 303 bp, Homo sapiens
gaattcagctataaatgctgagctaagaagctgctatttcagggctctttttggttagtaatttttaaattactgattcaatttcagcatttgttactggtctgttcaggttttcacttcctgcctggttcaatcttgggaggttgtgtgctcccagtaatttatccatttcctccagattttctatgtagcatatacagaggttttcaaaataatctctgaggatctttttttatatttctttgagatattctgtaaatccatctttgtcatttctggttacacttgtacgtatccttcttt

SEQ ID NO: 176792 - DNA, 192 bp, Homo sapiens
caatattggaaacgactgttgttcacggacaggctggaaacagttggtcaaattgtgcttggtgcggccaggccagcccagcccctaaggccagacaacacgaccctcccgaagggacaacagggttgatgagatcataggtgatgtgctgccctcccactgatggagtgtgttctgtggtgttaaagagga

SEQ ID NO: 176793 - DNA, 110 bp, Homo sapiens
caccaaaatctcactcaggatttgaatgtcacactggcagatgcacataggaattaagacctattaaggaacagtaaattcaggactcctggctcatactcactccaggt

SEQ ID NO: 176794 - DNA, 398 bp, Homo sapiens
tctaacaactctcgaagtctctaataacagagcaccttccttctgtggaagtaaagcagataaatacttggcaaaagaaaggaaactaccagggtgaaagtaggaagagaaaagacagagagggaactaggtttgacaaactgctgtgtgccaccattcttgattctcagagtgctgttaagggcttgctatccctttggggaaactgaggtgggaatttatgccacctaaattcatacagctaagaccgtgggctatcttgatcccaagccagtgctttttccatgacaacatgcctcttgaccaaaaaaactgggccctgtaaattttctgtaagcttactataaggccatgccagccttttccatgtcatttggatttatatctgtatactgtca

SEQ ID NO: 176795 - DNA, 561 bp, Homo sapiens
aggatagccaaagcacaacaaacatcaaaatccagataaagaaaaggacatctggaatcattagtcaacatttttggcagcaaggcgatgcaaacaaaagcaaaagtagtaatagataaatgtgttttttaaaaaacaaattacaattcagaacacagaattgatttaaaaaccaattgagaaaaccttttacaaagagtcaacaacaagttcaatatcccaagtgcaagcagacaaccggaggaaggcaaattttaatataatgtgtgatgacgtgaaaaatggtaagaaacgtcctatccccaatcctagttgcacatttgacgatgcctttcaatgttgttctgaagttatggaaaatattaaaaagacaggttttcaaaaaccaacacctattcggtcacaggcatggccaattgctctgcaaggaaaagatcttacaggggtagcccaaactggtacaggaaaaacattatgctatttaatgcctggatatattcatctggacttccaacacacagagaaaaaaggaatagacccgcatgttagtccttatgccca

SEQ ID NO: 176796 - DNA, 585 bp, Homo sapiens
tcaaacttgtttcaggcatagtttttgtctatgtggtactacatatcttctcttgtaatcagaagactcttaatgaacaataatagcctctgaatttacagacaagtagactttgagctatttcaattatgttactctatttgaattcttgcatttttaaatagtgctcaatatttgagtgaactactgtaagctgcaagattttaataattttgataaaaatgcaaattttattaaatcaaaataatttatataattttaaatttatgatttattaaaaagttgttcactctttctaaactaaagaataaatcaaacacatcacacctactagggtggctataatcaaacaagcaaaaactacaagtgttggcaaccatgcgggcaaattggaacttgcatacgtcgctgctgctgatgcacctactgtgaaaagctgtttagtggttccttgtaaaattaaacataaaattactatgtgacccagcaattctattcctaggtgtatatgcaggataactgaaaacatatgttcatacaaaaacttgtacacaaatgtttataacagaactattcataagagca

SEQ ID NO: 176797 - DNA, 550 bp, Homo sapiens
acaaaacttacctaggaaaaggaatatttttaagtgctcgaaaccagtgtgtccaatggcagtagtgaccttgtcacttaagtggatgtggcagtgaccctcccgtaggttcaagactctacaagtacttgaggtaactacttttaaaaatattttaggccgggcatggtggctcacgcctgtaatcccagcactttgggaggccgaggcaggaggatcatgaggtcaggagtttgagaccagcctgaccaatatggtgaaaccgcatctcaactaaaaatacaaaaagtagctggatgtggtagcatgtacctgtaatcccagctactccggaggctgaggcaggagaattgcttgaacccaggaggtggaggttgcaatgacctgagatcgcgccactgcactccagcctgggcgacagagtgagactacgtctcaaaaaaagtatatatatatattttataactcagacttgtaaatagtttagatttgtcatctttgaattactctgaatccaagagcgcttaaacctgtgtaagaaagtcacctc

SEQ ID NO: 176798 - DNA, 416 bp, Homo sapiens
cattcgcgaataacacagggcaacggcaaaagtaagtttattaaggtaaagtggtgaaagaacagctactccatagacagtgtagtacttcccgaaagtaaaaggaggaacacgtccaccctaggtataatgctatagtgtgtgtgtgtgtgtgtgtgtgtatatgtataaaccagctgtgctccattgacgtgtgtgcacaagtgcaggtgttgtattcactgtggatatttttgttaccaaatcttccaggggtcagaagggatagaacctacatttctctactgtctctactgtttaccatggagagaatgtgcagagtgatccctgataggagaggttgctgggtcatttttagcttagcgtttactgtttgtatgaatggctgaaatacagatagccctcctgccttatgt

SEQ ID NO: 176799 - DNA, 432 bp, Homo sapiens
tattttttagtagagacagggtttcactacattacccaggctggtctcgaactcctgaccttgtgatccgcctgcttcggcctcccaaagtgctgggattacaggcgtgagccaccgcacccagcctatttattattcttcacagttctcggggataacgggctcagctgcgaagttcttccttgagcatctgaatttggttgtggtcagatggtggataaagctggacttatctgaatcttctttcgtcacatgtctgaagtgtctggagtggctggaaaacagcttcctcacaagttggccaagtggctggaagtccacctacaatgggcatgccgtcctggaacatctctcttctctatcttggattcggttctatgacggagtcttactgtagcacccaggctggagtgcaggagcacgacctcggct

SEQ ID NO: 176800 - DNA, 138 bp, Homo sapiens
cttcaatatgttttcatataattgaataactctatttttggcatagttattatagatattagagttattagtgtactactggaattcttattcaaagtttggagaggtaattttataaactgtgattcaaggaatcca

SEQ ID NO: 176801 - DNA, 785 bp, Homo sapiens
accaccatagaatgggagaaaatttttgccaccatgcatgtgaccaagatctaatgtcccacactgataaggaacttaaaccaatttaccagaaaaaaaaaaatctcattagaaagtgggcacaggacataaacaggcacttcaaaagaagacacacatgcggccaacaagcatatgagaaaaagctcaatatcactgatcattagagaaatgcaaatcaaaacccggaagtatgtagacaagtaatacttaatgatttatatatgctcataaatttattcctgatacagtatttaaatttgtcgaggagagttttgcttgtagtaccttaaattttccttcatgcttcccctctggttgcagttctggttattaatcacatgaaactcacacctgctgtctcccaggcctgagtgctgcattctaggttggcaccttgtggtggctgttgctttccagtctggaagcacagcattttattcatttcaggaaaacatcggtcctaaacctgctggtgcattcctgctgttagtaggtagaaaggctggcatttggtatttggagggcagataagattttacaggagtacatgagttaaagaagggactctcatgaaagagagtatagagtgtatctggaagtgtaagtatcaggatagttcatgtggaaggggttagttagataatatttgcaatcaagatgagcaagcttcttctcagaaatacacttgtaatgataatatagttggagcagcattgtagtttctgcaaactgttcatgattga

SEQ ID NO: 176802 - DNA, 111 bp, Homo sapiens
cacacttagcttggcattggtccccgcaacatgctcctccttcctgtctcagctgcagatctaggcacccacctcgctgcctcctccctcaccacctccactggcgagagg

SEQ ID NO: 176803 - DNA, 525 bp, Homo sapiens
gtttttcctctgtgtgtgtgtctgtgtctaaattttttctttttatttattttttttttgagacagagtctcactcattgtcgcccatgctggagtgcagtggcactatgtcagctcaccacaacttctgcctcccaggttcaagtggttctcctgcctcagcctcctgagtagctggaactacaggcacacgccaccacgcccagctgatttttatatttttagtagagatggggtttcgccatgttggctaggctcctctcgagctcctgacctcaggtgatctacctgctttggcctcccaaagtgctgggattatgagcatgagccaccatgcccagcccaaattttttcttttgataaggatacccaatcatattctatcaggggctcactctactccagtattacctcatcttaactaactattatatctgcaacaactgtatttccaaatagagtcacattttgaggcactggggttaggatttcaaaacataaatttgggtcatgagaacataattc

SEQ ID NO: 176804 - DNA, 663 bp, Homo sapiens
ctacctgcctgtccccaaactcttccccaaaacagcccagggcatgccatccccactcccaccctgtgcttcatttgtggttgttctggattagaaattccactctctgccctggctggattgaataactggggtttgcaaaactcccagcctagctccttcacagcctggaatgtgctgtgtgcctgtgggagtcttaaatcaagtatctgcaactattgccaacaggaggggtagcaaaacagactggtgtgcccactttgcttcctagagaggtttgttttccaaaggctatgtttgtcacctttgaactgatgaacccaagacgttagatgtctttctccagctcagacaccatggaaaacttgagggaggcaatgagaactgttgttaaagaagccataattctttaaagaaaccataaattaagaagggattatttatttaataacattaataaagggataatttacaaataataaatatttatttattatttcttcacttaggagcaggaagacctgctagagtagaaatgtcatttctccccaaacggatctatagattcattctggttccaatcaacgtccagttcagttgatttcctcccgagacttgagaagatgattctaaaatgtgtatggaagattcgagatctaagaa

SEQ ID NO: 176805 - DNA, 495 bp, Homo sapiens
catctgcatctctagaggttccagtggggggatgcaagcctgttgctgaggttgccttttatggtgtttgaatggaatcatggcaggaaataatactggaaacagcctaatctaactgtattctgtctcaaaaggatacagggtattccctttgcttacttatgttggtttcaaggggaaagaatgggtaggcaaaagctgggtgctttaaaactttggacaatatgggtgggcgtggtggctgacgcctgtaatcccagcactttagggggccgaggcaggcagatcgcctgaggtcagcagttcaagaccagcctggcatggtcttggtgaaaacccgtctctactaaaaatacaaaaaattagccgggcatggtggcacatggctgtagttccagctactcgggaggcagaggcaggagaagcacttgaaccccgggagcggaagttgtggtgggctgaaatcgcgccattgcactccagcctgggcaataa

SEQ ID NO: 176806 - DNA, 709 bp, Homo sapiens
ccagatatcgtgggaagaaaaaagatatatttagcatccacaaaggggaataaatggttaaaacagtgtttttgagtgtctaaagattaaagggtgaaaaagaacaatgttaatagagctaggaagacaaggctgcaggaggtttacactgcatgcagggctttttcagcagtgagccaccactttgtcctctagattgtttggagatcaaactgtaaaaaagctaaaaatatttggagaacactaggtttaaattaaaaggaggggagatcaaactggagaaatgcccattatggagaccaaagtagaagtatctgcatcagagaccttttacatatacccatgtatcccaaatagtagtgaagtatttgcatagctatatgcatatatagctatacttcaaggaaaatcaaggcataggttacatggagagcaggtaaattcccaagctaaaggggtgcgtcagggaattatacagtattttctttccattccagagaaaagagtaggattgaactagcaagagagggtaaagatcctctggctttgagaatattataagagccaaaaacaagaacaaatccatgcctttttaattttttttgttttttgacttctagctttagggttcatggcaagtttgctctctagataaattacatgttggcggtgagttgatcgaggcaagatgatctcctcgggatcctca

SEQ ID NO: 176807 - DNA, 447 bp, Homo sapiens
gcatacttttctactataaagttgtctcgcatagattacgtagaattgtccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtaggcagaggcctcgtggagggtggccccacactcacccccagaatccagaagccattcccacaggaacttcagagggagagcatttacat

SEQ ID NO: 176808 - DNA, 403 bp, Homo sapiens
tcttgattatcccaagcctggtggtgtcgcagcctggtggtgtcttcctgctatttttcattgtgcttttttcaattccacgaatgccacgggcaagatgaaatgtaacaattgctgtaactattgctttcacttgtaatgtgagctgcagccaaaatcttggagagcagagatgggatgtggatgaaactccgcacttgagtaaactttctgtggtcatcaactacactgccgttcctgcccctcagaactggatagccacagggggctgccctcacagtggtggctctgcacacttccacctcaccccactgtgaaggcctgcttttgcagtgatataacctacactggtccccccagagcatagtttccttttctctagaaaggtcttgagccatatgcg

SEQ ID NO: 176809 - DNA, 174 bp, Homo sapiens
tagggaacaagcacagtgtgggtagagatgcccggcgggggaggggggttggggagagaaaacgagctatatgctgctttatgaaggtagggagggtaagagagaacgggaactaagcaccaggtatcacatactcatgtgctctgagttgcaagacttaacacctcagggcag

SEQ ID NO: 176810 - DNA, 298 bp, Homo sapiens
tgctgggattaaatgcgtgagccactgtgcctggccttgcctggttttatcaacaattttagtgagttctactagggtcagattcatccactctttcttttctttcgtaatctttctagcccctagctcagctccgagctaaaatgtctagaggtgcatcctagattatataactgcccccacattcaacaattgagtgtcagagccgagactgactgttgccccaaattctctctgcaaatagctctaagacaccttcctacagggaagctaatgtagaggaatgttgcttgtctgg

SEQ ID NO: 176811 - DNA, 196 bp, Homo sapiens
ttgtgtcagacttcattataggataaatatgggataaatactgggtcaaaggaaaatttcaatttagagaaaagattttgatgagagagatgctattacgttttccaggtcaggagtagaaattatgggggctggtgtgagatgagattgctgttttggatctgctgtgaaaggagtattgtgtataggggtgaca

SEQ ID NO: 176812 - DNA, 297 bp, Homo sapiens
agggaagggggaccagaagcccgcaaccccttgaagccccccagttctgcccggggcagactgctcccgagctagggctcacacgttctgggttctctgttagtgcctttgctgagagaatccacacatggtcccgagagccaaggtgaagcatttttttttttgcttaatcagttttacttagtataatttgtatacaatagaaggtgcccattgtaagtgtgcagttccatgagattccaccagggtgtatagtgctgtctgtggacacagcagaccaagataaggaaacggccc

SEQ ID NO: 176813 - DNA, 204 bp, Homo sapiens
gccatgtgtccttaagatgaataaactgaaactcagaaagtttaaatggcttgattgaaaaggtacaactagaaaataataaagcttcaatctctacacatgaaggctccttttttttttttttttttttttttttttttttttttttttttttttttttttttttttttttttttaccccccccttaggggggtccggggggc

SEQ ID NO: 176814 - DNA, 295 bp, Homo sapiens
tgtaagtaatcccagcacttggggagactgaggtgagcacatcatttgaggccagcagttccaagaccagcctggccaacatggtgaaaccccatctctactaaaaatagaaaaattagccaagtgtggtgttgcatgcctatagtcccagctactcaagaggctgaggcatgggaattgctggtgccctggagacaaaggttgcagtgagacaagatcgtgtcactgcactccaacctgggcagcagggcaagactgtctccaaacaaacagttactgtcttggtgttatcaag

SEQ ID NO: 176815 - DNA, 442 bp, Homo sapiens
ccctagcacttcctgtactagtccattctcacattgctataaagaaatacctgagactgggtaatttataaagaaaagaggtctaactggctcacagttctgcaggctgtgaggcacggctggggaggcctcaggaaacttccaatcatggcaaaggtatatggcatgttttcctggaaaagttttatttaatctatgtacaatgcctatagtgggtagaaagcattataaaattagtttatctttgctctgtctggaagtaaatagatacgtatgtcttgttcttttgtgattggcatattggcatatatgttgaatgcctacttatatttctgaaattagatttttcagttttccaacttggaaaatctatttgcagttataggaatccttttttgcaaagtcatcatcccgtgctatgaaaccatattagtacttttta

SEQ ID NO: 176816 - DNA, 253 bp, Homo sapiens
cctcatcctgcagcgtctactagaatgaagaacacttttttctttacccatgaaaatgttttgtgcttcatacccacaagtgcaatttgtgttaattctgcaaaatttgccgcataactctgcctgtattcttagcatttttcctttgagagatttctcagcacatcatctttggactatgtggaattggaaatttacttagagtcaacaacaagtacaggaaagtcagttcttagtcaagagttaggttttc

SEQ ID NO: 176817 - DNA, 405 bp, Homo sapiens
aaaataaggataattacctcctccatttctctgtcccctgaatgtgtactgggaaattgacgggagtaaattttctttacatagtcaatgcaattcagcccagcaagagttaaagctggcttcctgtctctgctggggagccaggctggatggggctcctcctgaactgggcgcagatgccgccatgctttgttgattacaatctcccacaccaaggaggctttgactaggtttgacataatcagctcacagcctctgcctgcactctttcacaaacaggccattttcacatctttttcatagaatccgacaagcggaaaaataattaatgttacctcagcccaacaatgaccctggctctgattcaaaaagaaggcatgttgcataaactgccctttaattgag

SEQ ID NO: 176818 - DNA, 523 bp, Homo sapiens
cacttgcacagcttatttgctctttaaagttaatcgattttgttttataaaagtaaggacggtgaggtgtttttcttgccagaggtatcatatgttagactggtttcacaagaagatcaaatatccaaggtactcaaaaatgagtagagcccaagggttttatttgtattttagatcccaattctagttttcacaggtatgataagatagccactaaaaaaatttttagagtaaaaattttactgttaaaggggtttaaattttataaaaatttatttcccaacttaattcctattaattggaacctaaaaatggcctttgttcatctaaattttaaactttttaacaacttcagaaaatgcctcacaatgacaaaactaaagaaataaaacaaaagtaaagaacaataatttactgacaacacaatggtaaataatttacaaacaacaagcatcttaagactgcttgacagaagttaataaacactagcaaaatgttatattgggatatgatggtaacagac

SEQ ID NO: 176819 - DNA, 675 bp, Homo sapiens
tagtttcaaagcaacacaggcccagactgttcgctctcaactctcccgagaccgcagccccagcctgagctggcttctccataaactcctggtcccttcctttaaccagccccataaaaagggagtggggcaggagggagtctggctgcagactttgtaatttggcttggaggtggctcctgttcgttctaaccaggctgtaattacggctggcacccgacaccccctcattaccggagcctggaaggaggactctaattatagcatactgggtccgggctggagtgggttgggggagggagaccacagtggaggcctgtgtaggcagagagagactctgagctggctggggggatggggcagggccaggattgtgggggggctgtcctgggctcctcatttgtcttgctttcagagtcatcgttgggagggatggggcatagatcgaatccaggccacttccttggggagaacaggacccagaggagcccgcccgggagactcattcattcatgcacgaaggatttattaagcatctactgtgtgccaggctggcactgggttacagcagtgggtaaacaggtgccatccagccagaaatgatgttcaaggagaaagcacattaaagccatcttgctgctggaaatatctgaagaagtccacattgatggcaaa

SEQ ID NO: 176820 - DNA, 474 bp, Homo sapiens
ctggccatgtgcatccaggccctgcagcgggaagtggcagaggaggacctggtgcaggtggacagagccgtggacgccctcgaccgctgggagatgttcacgggccagctcccggccaccaggcaggacccacccagcagcagggacagcgtggggctgcgcaaggtgctgggggacaagttctcctccctgaggaggaagctgagtgcccgaaaactcgccagagcagagtcggccccccgtccctgggatggggaagagagttagtacagcaggggctgccctacgtctccttccctaaggatgctggccagcactgtccagtagctgaggccactactgacctgccagggataaagaggaagggtctgcctgggtggtggctcaggcctgtcatcccatcactttgagaggccaggagtttgagaccagactgggcaacatggtgagactctgcctctacaaaagaaaaat

SEQ ID NO: 176821 - DNA, 151 bp, Homo sapiens
taagtcagaaagtcagttttctggtacagagagcagtcttggccaggaatgagagctacatgcatagtttttcatcaagcttcactgtccctcaggaaagccaaccatggagattccagactgagacattctgatcaccgaatcaagattg

SEQ ID NO: 176822 - DNA, 194 bp, Homo sapiens
gactgctgatgctgaactttgcatgtaacttgctctgttctttgggatactttagaagtgaagtataaatatttaaaaaggaaagggttattactgtgttcactttgattgatataagtgaggaaggaaacctgaaaatttaaagatattctatatgttctctctttgaatcaactgaaatagcgtcaactcta

SEQ ID NO: 176823 - DNA, 671 bp, Homo sapiens
catggcgaaaccccgtctctatgaaaaatgagctgggcacggtggtgtgcacctatagtcccagctacctgggaggctgaggtaagaggatcacctgagcccaggaggtcgaggctgcagtgagccgtgattgtgtcactgcgctccagcctgggtgacagaatgataccctgtctcaaaaataaaaaaaaaacacccccagggcgtgctccctgcacataactaggctgctctcccttttcaagcttgcacactgacccctgggctcacttggtgagcacaggcccagaaagagttggcctgaaagagcactggcttggtgacaggccacccagatctcagacctatctctgtactcaatagcgtggacaagttagtaaccctcagccttgatgttctcatctggagcagtttaaaacattttatttattggctgagcgcgatggctcacacctgtaatcccagcactttgggaggccgaggcaggcagatcacaaggtcaggagttcaagaccagcctggtcaacatggtgaaaccccatctctactaaaaatacaaaaattagccaggcgatgtggcaggcgcctgttatcccagctacttgggaggctgagataggagaatcggttgaacctgggcggcagagcctgcagtgagctgagattgcgcc

SEQ ID NO: 176824 - DNA, 112 bp, Homo sapiens
catcttgggtatgtctttattagcagtgcaagaacagtctaatacaccagaactgttctataataaatgctaaagggagtactttaatcagaaagaaaatgacatcaatgaa

SEQ ID NO: 176825 - DNA, 710 bp, Homo sapiens
gataataccaagcgatttgagcccaggcattactagatagtaaattcacattggccataatcagctatgctcatagtgaatttctgtgatcgatagcactagttgcttggatatctcaccaatatataaaccactgagtgataaacatgaagtatgtgtagtaggattcactgtgtcggagattgttgaaggactcttttataggaagtacataatctatcaagagacgtttctatggcagaagcatctgaaggatcacagacataatagcagtataatactcacattttaggggattcagtattttaaagatattctttcccaattgatgtgtaggttcaagaaaattctaataaaaatttctacagtaaattttacaagctgatcttaatttatatgaatatgcaaaagacaggataagccaaaggacccatgaagaagaggaaggattgctttacttgatactaagactttttgtaacacactaataaattaagtcagtgctgtattaccacagaaacagacaaatagaccaatggatcagaatagggaacccagatacagatacatgattaatatggacaggttatttataacaaaggggcatcacaaattagtgaggaaggaagtctctttcaacaattgtgctagaacaattagacatactttaaaaaaaaaaaaagaaagacctaatttattcatgtctactc

SEQ ID NO: 176826 - DNA, 1050 bp, Homo sapiens
gactctagaggaccccgcgcgatgttgtactttttttatttctgtagagacagggtctcactatgttgcccagggtggtctccaactcccagtctcaagcaatcctcccacctctacctcccaaagtgctgggaataagggcttgagccatctcctagggcctcaaaaaaatccattaaaataacctacttgaactgtctccttgccaaaagtctattttctccgaaactcagaaactcatcttacttcctacaaaagccctagaacagcaatttaggtttcaacatcagtgaccaaggaatcaaatgaaggaacactttcagttcttcgatcaagtcccatttttgtagttttctcccctgcctgaacactttggaccgccacctctgtctattccttagttctcgggtgaaagttatcctttccaataaaccttccgagtttttcaaatcttaatgagaatcctttattttgtgctccaacaagccccttcatttccccaacctcagcactcatcaacgaaggggaacccaactgtcttgtctttgttaccccagcacctggcgtgtaacagcagcgcaacaaatgttcttcaatcagttgaaagtagatattaagtcatgtacaccatctccatttcataggagtcataaagcatgataagctctactaatgattaatcttataaatgaagaaaccagggtacagagagaaaaattaagttgtcctgggttctaaaacagtaaacgacaacagaatatagaacctgagactccagagtcagaagctatttgtactctaccacgctgcttccacttaaattctaggtcctattgacacagctgaccctgttggctctactgacacaactcagattgggccgactaaaatgttcagagtatatctgggtgcggtggctcatgcctgtaatcccagcactttgggaggtcgaggcgggcggatcacttgagatcaggagctggagactagcctggccaacatggtgaaacactgactctactaaaaatttttaaaaattagccgggtgtg

SEQ ID NO: 176827 - DNA, 971 bp, Homo sapiens
tggcggtccaaagtgttcaggcaggggagaaaactacaaaaatgggacttgatcgaagaactgaaagtgttccttcatttgattccttggtcactgatgttgaaacctacttgaactgtctccttgccaaaagtctattttctccgaaactcagaaactcatcttacttcctacaaaagccctagaacagcaatttaggtttcaacatcagtgaccaaggaatcaaatgaaggaacactttcagttcttcgatcaagtcccatttttgtagttttctcccctgcctgaacactttggaccgccacctctgtctattccttagttctcgggtgaaagttatcctttccaataaaccttccgagtttttcaaatcttaatgagaatcctttattttgtgctccaacaagccccttcatttccccaacctcagcactcatcaacgaaggggaacccaactgtcttgtctttgttaccccagcacctggcgtgtaacagcagcgcaacaaatgttcttcaatcagttgaaagtagatattaagtcatgtacaccatctccatttcataggagtcataaagcatgataagctctactaatgattaatcttataaatgaagaaaccagggtacagagagaaaaattaagttgtcctgggttctaaaacagtaaacgacaacagaatatagaacctgagactccagagtcagaagctatttgtactctaccacgctgcttccacttaaattctaggtcctattgacacagctgaccctgttggctctactgacacaactcagattgggccgactaaaatgttcagagtatatctgggtgcggtggctcatgcctgtaatcccagcactttgggaggtcgaggcgggcggatcacttgagatcaggagctggagactagcctggccaacatggtgaaacactgactctactaaaaatttttaaaaattagccgggtgtg

SEQ ID NO: 176828 - DNA, 140 bp, Homo sapiens
agcaggaaaggggatcctcatgggtcaggaatggggatggaggaagaaatctcgtgtgttgtttgctttgtcttttctccttttctcttgctctggccctccacgtaattgtgtagtggtggagacagcagtgacattgg

SEQ ID NO: 176829 - DNA, 425 bp, Homo sapiens
gctaaataggttgtcctagaaataatcagaaaaagagtgagaactgtgcatacataagtgtgcgtgtgtgtgtgtgcatgcacatgtgtaatgtgttttggagtagtactcttccaaaactgaagcagaaactcttagtctcctcctgtgctaaaccacgtgacctttgcctttcaggatccagaactctcaattcatgatgtctctagtgggctagctctggaaccttatcattggcattactttctactactaaagaaatgactctaacttaaactgaaaaaaagtgtacacaatgatggccagggtatttcatggagtggaagaaataattgtacaaccaaatcttgatttgggatgtgactaaggcatgtttagaaaccttaacagtctttgactacacaaaagaaaacaaaatatattac

SEQ ID NO: 176830 - DNA, 256 bp, Homo sapiens
attagccctagtttaaacattgctggaacctacctaacaaatctcaaaagcaagacctgaattcaggaatcaagctgtttctaagtaactgaagtgtatcccagaacaaaacccaagaacattaacagaaatccaaaattaacgagcacccaaaaatgtaaaattcacaatggctggttttccaataaaaaattaccagtcatgcaaactataacccatcataaggagaaaaatcagttgaaaccactacagctga

SEQ ID NO: 176831 - DNA, 389 bp, Homo sapiens
cctttctttcccctgaagagtgattcaattacttcaccttttataaaatacagtttaattgttccctttctgtattatctcagaaacctgatttttttcagtgcctaattgaaaattttaaaacactgcccttctagtatcaataaagttgtttgttacttttctgccagcagcaaaagtcctttttgctatttttgtatctgggtgaggtccgattgctccagaattgtgccatactgtggttagccatgatctacaagaggaaaataaatttatccttctttaaaatcattggttttctaagaaatgcgccatttactataccaaatatgagtaaatcttaggcaaaataagtgttcatattgatatcaaatatgtccagttctctc

SEQ ID NO: 176832 - DNA, 224 bp, Homo sapiens
ctgctttgtaaagcatattttaggctaaaaacgaaattcttatcacctggctttacctatgtgtgtgtgtgagagagacagagagagagagacaaggtggggggcgcatggggagggcagggtctcactctgtcaccaaggcaaggctagaatgcagtggcgccatcatagctcattgcagctttgaatttctgggctcaaacaatgctctagcttcagtctcc

SEQ ID NO: 176833 - DNA, 2668 bp, Homo sapiens
  misc_feature (358)..(358): n is a, c, g, or t
  misc_feature (611)..(611): n is a, c, g, or t
ttttttatgtccaagtgtgtttatcttttttaaaaaaatgtcttttaaaatcattttagtgcagttttaggagaaagtggaactaaatgactgtattcaacctgccactttaaagaggtcttttctcatttgtgtaactgcagattgtcttctcaataggcggtttggtcagaaagtgtaggtgcagtgtgaacaattctgtagagcaggaataagactaaatagaagcatgctctgtctgtgtttagatgcttgtaactgtcatgtttttaagaagaggtaacattgggggtgaagtaaaatatctcttctggaggagttttaagtgcagtttggcctctttttaaaattctcttantctccctgtgcagacagatacccacatacatttgtatattgaaaggggccatgggagttagtatcgtgccacatcttgtgcacctactgtccagtggcttctgtgtcccttttgtataggatattgtcatcatgtggtgtagaagaacccttcaggaaaagcaagactcctctctgctagaggaacgtgggtgctttgagaaaggagattcagagaggatgacagcatctcacgcatgggcgtggggttcccnttctcatttgaaagatgtagggttcattggactagacgagcctttccagttacaaatcttggtcacttgagaattttgaaaatgcattgtattttaattgcttacttttttacatctgggctttgtatattcattatgattttgtatcagagacattattagaagtcatttgaagacttctggtttaggtgtgttgataaggttggctgcccttacattttcttgtgtttctattctcctctttccctgacggctacttcttgaccatgctagctttttcaatttctatgacaaatcaagttctttttcccctctgggcttacacaaatatagttccttctttatgaaacgttgttctcctcattttttttgtctggctaactcctaattatttcagctaagatattttttgttttcttatcccccacagagggttttcctaactcttcatctaaataagatcacttacctcttagatttctttccctctcagctttttgaagtataacggtatacaatctggtaaacttttaagaggcaccctgttctttcccttcatagtgcttctcattgacagtatttaaacatgcatttctgactctgtttactattgactttccttctagactataacttcaatgagggctgtgggcatatcttccttgttcactataaatatctacctcttggcactggtgggcactcagtcaatatgggttgaatgaatgaagagtacaaactcagaggttgatcctactggcacccttttcaagcttcgagaagtcctaattatggtatttgaggtgctgggattagttttttacccccttgcaactctacataaactatgtaactactagcattaaacagacatagactttgggccagatcaatataatctatttattactgccactgtttggtttgttttgtttttcctgtccagttctcttaatctggtatcattaatctagattagccaaagaaaaaatacagattctgggggtggaggagaaagggccaaaccagaagaagaataagggggaaggaggacaatttagtctgttccactagatactttttaagtattaaacagtgttcatgtctttcttctccattcaccagaaaattatgaatttgaggaaaaggacaaggaagttagagagttggtcggtcatcaggtaactttagttactgtttctggagcagtctttgttcttactgtgcctttgaccaggagttcctagaggacaggaacatggctttcacatatttagtcctccacagcagaatttaagttacttaacagttaattatggtggtgctcaaataagatttgttgaatgattaatcatgaacacgatatcaggtttcagtttctggttgggattctagcataatagtttaactaacaaagccctcagcttctgtaaggttatactctaaaggcaaagaactgctcttcggtaagtgtcagatgggccagccagtaaggagaggcaatgattctgggacgttgttattttgccaagggtggtccctaaacttttgttctgtttggaacaaactagctggaatacctttttattccctgatgggttttccctaacaggcagtgcaatgcagtggtttatattgttttgaaagcagattagactcgtgttcaaatcccagatcttgttagcagtgtcatcttgggcaagcgatctctgagcagatgcctttaccgtcatgggggcctgatgtaaagtgtatacctcccaggggagttatgaggattaaaaacaataatcctcccaaagtgcttggaaagtacttcatccaaagtgagcgctcttcatgccattgcagttgttgggatttttgaggagtgtgcaaccaaggagttggaaaagttcaagggaggccaggcgtggtggctcacacccgtaaatcccagctacttgggaggctgaggcaggagaatcgcttgaacccaggaggtggaggttgcagtgagccaagattgtgccactgcacttcagcctggacaaaaagagtcagactccatctcaagg

SEQ ID NO: 176834 - DNA, 215 bp, Homo sapiens
cttctgctttgccccagctggatttgtgtttctccagctcttttagctttgcttcctgcttctgccccccaggtcttaggtgagctatatgctaatgtctaatgtactcagtagtgatctacgacccaggaaggtgatttccaagcatcacatgtcagtctattgtccttgtgtaactccaaagagccacacacaataggcagaagcaggcacag

SEQ ID NO: 176835 - DNA, 644 bp, Homo sapiens
gtggttttgcctcctcagaggggcagcggcgacccaggggctggcggtggatgtcaggagtgcgctttccttctaggccttctccctcatgactggttttgtttttagattacaaaaataacttatattatttaattaaaaatacataaaatatattgtgatagcgcagaataatggccctccaagaatgtccacggcctaatgtctagaaactgttatatggcaaaataaatacataaataaggtggaaggcctttgcagatgtgatcaagctaaggatttttttatttttatttgatattgattgattgattgattgagacagtcttcctctgtctcccaggctgaagtgcagtggcgcgatcccggctcactgtaacctccgcctcctgggttcaagcgattttcctgcctcagcctcccgagtagctgggattacaggctcctgccatcacgcctggctaattctcgtattttagtagagacaggggtttcaccatgttgaccaggctgatctcgaattcctgacctcaagtgatccgtctgccttggcttcccaaagtgctgggatgacagatgtgagccacagcgcctggcaaactaaggatttttagaccggggattaccctggattatccaggtgg

SEQ ID NO: 176836 - DNA, 282 bp, Homo sapiens
taatacctaacgctatatactatgttcttcctagctcaccactgactttaagatgcagtactgacctgagtcaatcaaagcaattctctgagcttcaatttccttagccataaaattgggaaaataatcttggctttggccacctaatagtgtaatggagaaaagaacatgtgtcaggagcagaaggctatacagtagtctttatcttcttgtcctgcccccagatcagtgagatgtttccaaacaaaataatgcgagtataagtgaagagtgttgatttgt

SEQ ID NO: 176837 - DNA, 430 bp, Homo sapiens
aaaaatggggggagggagcaggtggacacatatttgtatttgctcgtatgtgcatagtgtctttggcaggatacatgagagctcaatgacagaggacacccatctggaaggaaaccgggtggtagggggatggggcaggttgcaggcttctcactgtgtccccactcatgctgtttattttgcactgtgtgagggcattaggtgttcagaaaataaaatagtgagaaaaaattcaagacatttttgctatcatagcaaactgcagactaacattttaaatagaatttaggtataaagggaaaaaggctaaagcaatacaaattaaatggatgccgaactacaaagcccatcattgttaacatgagctggggtggggatgggaagaggggtcctcactctcttggtttctacctggaagcccatgctggcc

SEQ ID NO: 176838 - DNA, 351 bp, Homo sapiens
ggtgcctgtagtcccagctactcaggaggctgaaccaggagaattgcttgaacctgggaggtggaggctgcagtgagccaagatcatgccaccacactccagcctgggcaacaagagcaaaactctgtctcaaaaaacaaaaataacacgttatcttaatgttgcttaattttgcattcgtagtttggatgctgtttgagtaagacctacactgagaattctcttaaatacctagaatttgtgaacattctgcacacagctacgtaaagatatttcagcgatgaagtctgcagactgctcatgttcaatgttattatgtgaaattctgactcagcccatacactgacatga

SEQ ID NO: 176839 - DNA, 619 bp, Homo sapiens
tcgtgaggggtcaaacataggtacatagaataattacagtataagtctgaaagtgaaaacgccagaagatggattttttttttaatgcaatggcgattcagaggaaggaaagattctttcttgctgagggaaatcaaggaagtcttcctgtaggaggtagtttctaaaccttatattgaaagatgtagatcctggagagacggaaaaaggcattccaggcagatcactgtgagctggaaagccagtgatgctgtggcaaaatgtattttttacagaaaatagatgggtatctcccatgccccatgatcttttacgatataacctggctgttcctcccattggcggatctgtggaccctcccccttgaatctgtgggcatgtgactgctctgatagaaatgaagctacatgatatcaagaataagtgaaaagaagaagaagaagaagaaaagaagtccataccacttcctcctagttctcttgggatgcttgccgggagggaagctagtttccatgtacagaggctactaatctgagaccacttgtgtaagcgaggccaacagagatgctctggtccacagccaggctcaaccgcggatcacatgtgtgagccgtcttgc

SEQ ID NO: 176840 - DNA, 116 bp, Homo sapiens
gctcacgagtgaatggcttacattctgcctgagtctggcgtaaggttatgacaacagtactgagactgggctggatgtcagaataaacgagggcacgtcacaccagctcaagggaa

SEQ ID NO: 176841 - DNA, 613 bp, Homo sapiens
ttgacatttaagcgtctctgacttaccaggaatattgaaattttccatgaattcaattgagcactgtaaataaacaattgtttactaatagcctttgggaggcagagtaagatttacagaatttctttataatatgttcctagtaatccctctgaacacagcattctcaattcttagtattcaccctgagtcactcaggggaaattggtatctctgtaaacaggcaaatgaaggtgctgggtggaggtgcatgacattgtacagaaatgatgtccacacgcacctataagggccttaatttaatggactgttagttacatggctacatacttactgaatctagtcatactatcttttgtcagctaatgacatttgttacctattaattcaatataattatttgcttggctgaaaaataaatcctttaatttattctaaattgagagattagatttgcaatcttcaatcttttaatgttaaatcagagaaaagcaatgtatgtatatagtatgcattttcctacccatgaaaattatttgtattgccttgaaaaccctaggaagccacctaaagaatactctcttcaaatcctttagccaggattttagatttc

SEQ ID NO: 176842 - DNA, 718 bp, Homo sapiens
agaggggaaaagcaggaaagaaggatggatgcctataatgggccaaacactgagataggcacctcaggtacatctcattttatctttccaccatccctttaggatagatataattagaagcactttagagaggataatttaagtaatttatcaaagggtatataatgatttagtagtgaagctgaaattttagcccaggattatctgatttaaaaccagtgcctttatggaatgatgtttacattgggaatacggaggaagagaacattatatgcttgctcttaaagctctctgtttgattggatgactcattctacaaatactgacaatttgcttgtaggcactaataaggagttcagataaattcacatatttgatatataaaataagattagaaaggtaaataatttactgtaactttgatgtgttctaaagacaaattataaagaattttgagatgaattttgttctggatttctatgccagtgatttctcccattaaaaatgataacttagagctgcagaatttatgacaaattataggaaagattgatagtgtgtcactttagggaaataaacttctttccctatatgtgtaactagtattaatccaaaatactagttacaaatcgaaatgaagaaaacaatacaaaatgaaagaaaacgttggtattttgaaaagttaaacaaaattgacaaacttttagccagactaaga

SEQ ID NO: 176843 - DNA, 1062 bp, Homo sapiens
cacaccacctgagtcgtaactgtatttttatttgtgacatgtatataccacctacctcatagtaagccctgatgtttgaatgcatatatttacatctgctttttgcaaatctcaggtctgagtgttccactctgtagcatttgggtatcacctaggaatatgtgatttattgacatacctgctttgggtgggattgagaactgtattgactgcatgagcacatttttttcaaaccctgttcttggactcaggtggtgtgcacaccacctgagcctaaagaatttttaaaaagctgctattgatccctctcagttgggtagagatcagtctcttgaattatctgcctccctggctttatcatcacaagaaatgatttcaaaggtttctgttttgttttgttttaaatcttagaagtccagaaaggatctcataaatgtagtgaagttctgtaaaagtatgttgttatagagcacttataagaggaaatgtgttttatgaaatcaggtaggaaatggaatattctagcacacagaagttagtgaaaggagagaggttctgtggtcttcttctccccctttcatttatgtagttacattcctggaatcattctagaatttgcctcttgagaatgcggattttcatacccattaacaaaggaagaataaaggaggagaatttatgactaaacacagttgtagaaaagtctaggaaaggaaggagctaggaagggaatgtacatatgtgtacagtactgcttcttactgtctggcttggatcaggagtgagcatgcctgagtttggagatgtgctgactcagagcagtgatgatgctcagcacttttgggacagcttattacaaaataatacaatactgctccatggaagtagccgtttttgactgtcggtattatttcagtactggtagctaagaacacatccccctcaggaacagtaatagctgccttggtgctcatttcagttacatcatagatggtcaagagtcataccatttgccatggtgaaccttcctctacctttttttaaacaacaaacagccatggg

SEQ ID NO: 176844 - DNA, 898 bp, Homo sapiens
tcagtttctccagggtctagtgtcctcagtggtaaaggcaggaagttagactagatgatcgctgaggtacatcctagctctagcattcattggtttcataattctgagcctaaagaatttttaaaaagctgctattgatccctctcagttgggtagagatcagtctcttgaattatctgcctccctggctttatcatcacaagaaatgatttcaaaggtttctgttttgttttgttttaaatcttagaagtccagaaaggatctcataaatgtagtgaagttctgtaaaagtatgttgttatagagcacttataagaggaaatgtgttttatgaaatcaggtaggaaatggaatattctagcacacagaagttagtgaaaggagagaggttctgtggtcttcttctccccctttcatttatgtagttacattcctggaatcattctagaatttgcctcttgagaatgcggattttcatacccattaacaaaggaagaataaaggaggagaatttatgactaaacacagttgtagaaaagtctaggaaaggaaggagctaggaagggaatgtacatatgtgtacagtactgcttcttactgtctggcttggatcaggagtgagcatgcctgagtttggagatgtgctgactcagagcagtgatgatgctcagcacttttgggacagcttattacaaaataatacaatactgctccatggaagtagccgtttttgactgtcggtattatttcagtactggtagctaagaacacatccccctcaggaacagtaatagctgccttggtgctcatttcagttacatcatagatggtcaagagtcataccatttgccatggtgaaccttcctctacctttttttaaacaacaaacagccatggg

SEQ ID NO: 176845 - DNA, 208 bp, Homo sapiens
aagacaccgcagagatttgagggactcagaagtcaaatagagtaggttaaaaacctcttatttttcaaattaattgttttaagaaacaagcatacctgtgtaagtgaaatatcttaatttgtgttgaatcaagttaggagacagagattctcatgaatgtgtcctgtgttctcaaagcagctgctagcctgtgggtctctcctacctg

SEQ ID NO: 176846 - DNA, 337 bp, Homo sapiens
aaagggcagtgtatctaaccaaaggacagagcggaaagctgtaatttctcatcacttcaggaagggtttgggtcctgccgagagcagagaagagcatgaggaaggtcaatctaatactctgtggcttttccaagccttcagatccttcctcactccatgggaagaggaacggtgtgtctggtcaagagggcaagtcagcaagggcaatggtggctgcctggaggattgctcaagaatagtcattcactccttagaaaacataattgtgtttttatgtattttgcactatggtagatgcgtgggctacagaaattcaagtccctaccatcaaaaaaag

SEQ ID NO: 176847 - DNA, 360 bp, Homo sapiens
gatagatggtggcagagattggagtgatatgtgaacaagccaaataatgccaaaggttgtcaacagccgccagaagctggacgaagctagtaaggattctcccttagagcctttggagggaatgtggccctgctaactccttgatttaggacccatggtctttagaaccatgagatagtaggtttctatagttttaagccaccaagtttgtggtaattttttatggtagaactaggaaaccaatacactgggtgaagtgaatgttagaattctttgtactgttttgtgttacttttctataaggtgaaattatataaaaataaaaagtttaaatactatccaacaatatcttcagctttg

SEQ ID NO: 176848 - DNA, 222 bp, Homo sapiens
aatgttgtgactaatattctatacatgcgagacattttagatattttcatctctaaatctgttatctaagggggctttttagaaaatcattgaaagtttagctttgttatccagggaggcttttttggtaatctttggaagttcaagcttgcttaaaaagatgtcttaaatgacatagaaatatttgccccatccttaagcggaagttcaacagccactcta

SEQ ID NO: 176849 - DNA, 257 bp, Homo sapiens
ccatttcctcttgtatccttatcccattttgctttctcgaatctatgggccctggaagaataggggcaagagaagcattacttacccttctttctatgttcaggataatgatcacagatagagctaataggtgaaatgatctactcatctctcacaacccgaaggcactccaaattactgacgttcttatcattaccaggtcctgatcatttattaatggatatgcttcagtgaggcaaatcagttagtttacctcc

SEQ ID NO: 176850 - DNA, 203 bp, Homo sapiens
tatatgactgagaaaaaattctgatggaactaagaactcagtttttaaacttttaccaacattgctcagccagatggtatgtctattcaggggtagctaattaaccagatgggtggtaggaggataaagagcaagtgagacataagagcaaaactggagtcgctgaccattgagaagtaagcatttttagggaggcaagtgtt

SEQ ID NO: 176851 - DNA, 311 bp, Homo sapiens
ttctcatcttgggtcctttatcagatttactttatgaaattgaatataatttctgcagcaataaaatggaaataatagcatttgcctccctcctaaagaaatgtggtgaacaagagttggtcagcaacacctagaatctggagtatctctcatgggttccataaatagttggcataattaataattgctagtaaagagattgtgttattaatatattactgaggattaataatcatgtattataatctttccagaaatgacaaaatgtcatcactattaaaatcttcttcaaaaaaatacctaatgttcca

SEQ ID NO: 176852 - DNA, 768 bp, Homo sapiens
tcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaa

SEQ ID NO: 176853 - DNA, 356 bp, Homo sapiens
tcaaaatttatgaaatgtagctgaagctgtgcttagaggaagatttacagcttttataatgcctggatatttgaaaaggagaggcttaaagcactaacgtaagcgtccattgtaagaaactagataaaacacaaactaatccgaagtagctggatgtagaggtgtgtgtttcttgggaggctgaggtgggaggattgcttgagcccagcagtttgaggctgcggtgagctatgattgcatcactgtattccagcctgggcaacagagtgagaccctgtctctgaaaaaacaacagcaacaaacatctgaagcaagtataaggaagaaaacaataaagattagaatggaaaacaacg

SEQ ID NO: 176854 - DNA, 240 bp, Homo sapiens
attcagactctgcatgaatatgtccaatgacgaagcactcactttctcacaaatcatcctttcccactatgggacagctgtagttattagaatgctttccttatgctgagctgaaccagacctccctttaattcctagcaatcctttgacaaagaaggactatttatgtgacagcgagctccacaagggaaagtgccagtccatcttgcctactgctctggtcccagtgtctagcacaag

SEQ ID NO: 176855 - DNA, 739 bp, Homo sapiens
agtttttctagtttttagtagagatgaggtttcaccaacttggccaggctggtcttgaactcctgacctcatgatccacccacctcggcctcccaaagtgctgggattacaagcatgagccaccgcgcccggccccaaactacaattctatggtgactatgtatcttttcattttaaattctgctttcaattttgatcatgtggtcacacaaactaaaatatacatgaaattactgtctatcacaatttaagttggtctacattccaagtcaaaaaggaaagagactggtttttcttacaaatgatccataaaggacacaacgaaaatatctaagtttctgtttttaaaatgattctaatttcactcatctctgagctttgcttctaccacataaagaatgagtgttaagagcatcatgggagactttttagtttatcacaaagaactgtttacaatggaaatctggcatacaaacttctcttcaccggcacatagcagttcagtatagtctaagtaagaacaatattttcttaaagttgtctgtttcgttcctgattattccaagaattaattagcaagattaaaaatacttagctccatctaacaaaatacacatataatccctcaatctaaaataaggtaaaaaattaaaatattggcgaggtgcggtgatcatgtctgtaatcccagcactttgggaggctgaggcaggcggaccacctgaggtcaggagttgga

SEQ ID NO: 176856 - DNA, 326 bp, Homo sapiens
agctcttgtcaggcattaaaggtttgatatccaggtgtggccttgagctgagctgacaattagagctgaggacaagcttgaataagaggtgccatgggagcggcagagggacacagtgaccctgggcaagaaccagtcccccaatgctccacagccaagggcggggattgtgtcacctgtgtgtgccggcctacttcccagacaggacggcggacctgggtgcgcagacacgaagcgggcacttcccaggaaaagcttctgcaccccaaaatgcctgagaccctcaggacagcatcgctgctttggaagttccagggctgtgccca

SEQ ID NO: 176857 - DNA, 493 bp, Homo sapiens
aacgagtggtggatttcaggggcaccttactgctttgccagggctgtctgtgccagaatcttctggcaggggtgggctgggaggtctccccagctcgggctgatgcagggggattgtgagcaatcctcctctctgggcctcaactgtacagtaagggtttggacacatgacctcaggcctcctcatcattgacattctcagggtgcccagggacctccctgcaccaacaaaaaccttccctcattgctcattgccctcagagtgaagttcaagctcttcagcatggtattcaaggccctccatgaactggtccctgttgagtttgcaatctcatatcacttcccaccaccttccttaggctccaccaacgtggaaccagctcctgggtcacccttcccttgctgacctgctgccctcaactccttatgcagatatgacatcctcctggaagccctccctgtcctcatattccagcagttactttgtgctgcct

SEQ ID NO: 176858 - DNA, 585 bp, Homo sapiens
cactgtaacctcaaactcctgggctcaaaccatcctcctaccttagccttctaaagcactgggattacagattagagccgctgtactgggcctgatttgggttttaagacagtttccatgtgattaagtgaacaataatctatttctacttgttttatgaacaattttatcaaatattattctagaacctgtagagatactcatatgatttttttcatctattaatatcagaaattatgacttactaagccattctcgtatctggtttgaatcacacctggtcacttgggtttattcttttaatgtgctagattctatctgttaacatttttcacttagaattctttgccccatattcatgtgatagtccaatcattctattttgtctttattctatttttgtcagtactctgcatcactgttagcctagcttgctaaaaagaatttggaagctttccctgtgctctgagacattaaatagtacagattgagtatcctttatcctaagtgcttgggaccagaagtgtttcaagatttttttggattttggaatatttgcaaatgcatattgagatatcttggggg

SEQ ID NO: 176859 - DNA, 586 bp, Homo sapiens
tgcagcttggctagggtagggattcctgaccaacagtcccataagatcttatccagtcaggaggtactggaccaatctgaagtgcagccaagaccgggagccacagacctggaacctgggtactcaaagagttgtccacgtgccagcagcactggcccctccaggagcttgttagaaatgtagaacctcagagcctacattaaagatattgaatcggagtctgcacgtcacatctgagaagccatgagctaagctgatgccattcagctgggtagcatcgcagtcactgtgcaacttttaaacctacagctgcccaggcccactgcagacctgctaaattcgagctccttgtagtggggccagggccctgggacttcacacaaaactctgcaagtcatcactgatgagaaaaccaagactcgatgagagtctcctgagctcgggggaagaagctgcataaccggcacacttccagaaaggaccgaggaagagagcgtcgcttcagctagggatctgattagtcatgcctggtaggctctgctgagctgggggctcttgggttttgcttgttgagctgaattaatat

SEQ ID NO: 176860 - DNA, 230 bp, Homo sapiens
taatgtaaggtcgacctcacaacagtacatcagcgaaggcttttaaaaatttattctcccagtgaaaataatttcattccctgagataagtaaaaggtggcatggtttgcaattttatccctatagctacacactgctatctactgcttctgagttctaacaagccatctcttaccattttaaataacgccattaaaaattaaataagctactagagactggctaagagg

SEQ ID NO: 176861 - DNA, 486 bp, Homo sapiens
tagccaaaggtacccaatgtgcctggacagacatatctgctgtgtcaagtgctgagagaattgtcatagctagaactacacttaccttccacaggcagccgccgtcgcatggccaagcgttccattttcctctgtgtctctgccagactaaaaagaactccatatacatattgacgagctgaccggaataagagagcagctggaggcagctccatgttacactcatcctcaatacatacggggatcttaatttcaccctaacaagagaacattccagggaaaaggaaaaaatgagttacctcaaggtttagaactgagctgagaagagccaataataaactgtagcctctgtggcctactaaatttatttgtatttagacagtttcatactaaaaagaagctgtaacaagcttagctgattgcagcctacttataagctatatttcatttttaaagtctcaacggctgggcatggtggctcatgcc

SEQ ID NO: 176862 - DNA, 259 bp, Homo sapiens
gtgagtgggagacaatggcgtagtgttttttcatgaaggttgctttctttgggtttctaagaaattactgttaattaatttttgttgttttattataagttcagttgctggcaggtaaactaaagctacggggtcaagaaacataaatgtgagaatctccttcttttattaggttagtattttggttttatttatttttattttttgagacagagcctcgctctgttgcccaggctggtgtgcagtggcgcaatcttgg

SEQ ID NO: 176863 - DNA, 358 bp, Homo sapiens
aatactgagccccagtaggttcaaggttatactccttgacaagtgtggtctgttgtgctgtatgtagactgcaaatgtggccatcgactcctcctgtcccagtacccaagtgcccctgccctgtagatctgagtgccttctcattgacttgaagctccgctgtgtgacttgctttggtccatgggaagtgagcaaaggtgatacaagcaaaggcttgaaagatgctcgtgcattggggcttgcccccatcgctgctctttgaaaccctgccaccctgtgataaagtgcagcatagctgctgggggatgagaggtcatgtgaatagaggcccctgggccccagcccagcccatcatcaa

SEQ ID NO: 176864 - DNA, 288 bp, Homo sapiens
atgtaccgggtgtatgtgcatgtgtgcatgtgtgtgcctgtgtgtgggagtatgtgtgtgcgtgtgcatgtgagtgcctgtgtgcgcctgtgtgcacatttctgggagagatgccagcaggggataggataagaataatcagctcatccttttccttttttgctgtggcttcttggaacctcagacacttattttgtgacctaattatgccaatgactctatctttaaatcctgacaaaatggtcttctgtcttttctctatggttttaaactttcttctatatcttg

SEQ ID NO: 176865 - DNA, 391 bp, Homo sapiens
ttaatcctggttaagataattccatttttatgccctagaatagactgtctacattctccaacagaattttattttaaatgttaccctgagaagccctaccagtaaataacttggtgtgcattactttccctgttagctgaactgcacaaaataggggtttattctgccaccaccacctcttttccccttaaaaggctcttcaatgagaacctgagaacctgttgccccaacaggagatgcctggactgtggcccagccataccctcagtgggatttggaggaggagagaagactgtaatgcagtcaaaagagccactgtcgatcttgaaagaacatcaatcatacagatgccacaaagattctcctccccgcttcagttacaagacacacc

SEQ ID NO: 176866 - DNA, 546 bp, Homo sapiens
acctttcttctgttacagtgttaacttatcttccatcatctttttttaaaaaataagctactttctgtgctaattttctaaagaccctgagcaaaagttacaataatgcactttaatgtgggcagtgaactgtcaatatgtaaccacacatttatacagccagaaggacacctttaaaatctattaaatagccacttcgaccaccaaaggagatttaaggggtccaaaaagtggaaaatatgtgcaaagttattcttaacaatccactaaagcaagacatatatcttgacttcttttttatttttttaggaaatccacaatctaattggtatttaactacaacagaagcgtaatagatgaacattcaccactgcccagaccattaagattttagcttaaattaaaagaaaaaaatgctactgtaaactaggaaatatattcagatcagcatccacaaggcttctgagtttatctactttaagactaataacttcaaatctctaatatcagaaaaattattttcaatacataagtcaacctatgtca

SEQ ID NO: 176867 - DNA, 886 bp, Homo sapiens
cggcagtgggattactcagtgttgagagaaacaacacggaaagcccagagcagaggagggagaaggccccattctctcagctttaatctactgcacctcggagggcagagctctaaccagacacgctgcaagcatcagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccaccacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggtggtgacccacccgctatactgcctcattgtggggaatgagagtggggaggagagcgcccgcatcatgtagcctaaagctttccacacagtaggtcgtttgtacaa

SEQ ID NO: 176868 - DNA, 1046 bp, Homo sapiens
cggcagtgggattactcagtgttgagagaaacaacacggaaagcccagagcagaggagggagaaggccccattctctcagctttaatctactgcacctcggagggcagagctctaaccagacacgctgcaagcatcaggtaagacatatagatggctcttcttggaaatggaaatggcttcttttcacactctgcttggagaagggccgggcaaatgaatagttaaaaataggggagaatttagaaacggaaacagaggaagaaaaatcaataagggagacggacctggtcctaaaagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccaccacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggtggtgacccacccgctatactgcctcattgtggggaatgagagtggggaggagagcgcccgcatcatgtagcctaaagctttccacacagtaggtcgtttgtacaa

SEQ ID NO: 176869 - DNA, 457 bp, Homo sapiens
actgattctcaaccagttcttgccatcatgtcaatggatgctaagaccacagtgacccgaccaggaaccactgcatttcaagcgaactgtagaacaaaagacttgaatatgaaaggaaaacaatttttttttcaagctttatgtttacattattagttctcctactttggtgtaaatcagaaccacctggggaaattatccaaactgctgtttacaggctctacctctcgacctttctcctcagtaggaagagtccaggaatctgcatttacaatgaagcctgaaagtgaatgactaaaactagttgtatacattagttttcataaaaattagcttgaacgtagcagttttttcccaaattaagtcacatacatgattccttcttaaaaggatctccaatacaagggtgtttttatttttatttttttaaatagcttttcttacatttttttcccca

SEQ ID NO: 176870 - DNA, 453 bp, Homo sapiens
  misc_feature (326)..(326): n is a, c, g, or t
tatgggaagacatcagaatgcaagcaggagaccagcttcataaaggcttgcaattcattgtaaggattttagcatctacgctgcaagagatgggaagctgttaagagtattttgaggaatggctggacatgatacatgttttaaaaataattactgcatatgtaaagaggaaaatggtacctttacagttgagaaagctggccaacactaccataaccaagtgatcaaggttaacatcaccaatgatgccatgtggataccatgtattacccgatgcgggcgcgtaaaggcgtaaggttagcgaggcttgctagaaagtcatcaanaaagctattaggtgggtgtagagtttgaagtccttgagagaggattatgatgcgactgtgagtgcgttcgtagtttgagtttgctaggcagaatagtaatgaggatgtaagtccgtgggcgattata

SEQ ID NO: 176871 - DNA, 169 bp, Homo sapiens
gcttgcctgttctgtcaactttgtgctgtcgcctttctcagatccaggtccccactcagaaagataaaattgtcaaggtgcaaatgcaaatacaattgctcttggcatttccagacggctgctgggcaacaccaaagatttgctcccttgttttacaaaaggagggatg

SEQ ID NO: 176872 - DNA, 440 bp, Homo sapiens
atagacagttatatttaatgtccacgctgtcttctaaaggatagcttgatgcagaaatgcttgcttaactgcctgaaaacctgttctttgtgatttctgatttgtctaactggtctgaagttcccaatgactaaaagttgatagtaattgaaagttgggtgcaaatatttaccttagagggacacatatatgacaagagctgcctataagatagttagagaaaatagtaactactcaactaacatatgattttattgtagttaagtggtacagagtgttgtgtggatccagagggagaaaaaggccattggtgttaatggatttggcttttaaaggaacaatggaagtcaaataagcaaaggtaagaagagaaaatgcattttaggcagcagcgcatatgcaaatcatgcagttggatgaacttaggatatgcctaaaga

SEQ ID NO: 176873 - DNA, 581 bp, Homo sapiens
acttttccaaaaaaaaaaggtatacaaatggttattgtgcaacgtggaaagatgttcaccaatattagtcatttaggaaatgaaaatcaaaagcacaatgagttaccagttcacactcactcagaaggcaataatcaaagaaatggacaatagcaagggttgggaaggatatggagatattctcccacattgctggtggaatgtaaaaatggtgaaggtgaaggtggaaaaacggaaatgaagtattgagagggagatggaatataagaagctttctgacagataacccaatggaacaaactgactgactgggcatctgaaatgagtaagaaggagtcaaaaatgagcaaaattatgcttctctgtggatgcaaatcatatctccattacttacacccaggagaacttgtatgaagtagttaacttctctggattttagctttttcatgtgtacaatggggggtttatgcctcatagagttgtagaaactgcaaatgagagacttatgaaaagcctactgaatgaccttatgaataataatatcatcagtggaaggtgatttgaggatgtgatgctgttat

SEQ ID NO: 176874 - DNA, 228 bp, Homo sapiens
ggagtaagctctgaaacccaaatattgtggcagggttaatgataccagtgagctatattgaaggaatgtccatcataaatattcagtaaaaaacattttgtctcaaaataccacagaatttgaaattccaccttttaacatttactattttgatttctgaaaggtttagttcttcaaatttccctaaataaaacataagtaaactaaggacaacaagctcttgcgggg

SEQ ID NO: 176875 - DNA, 972 bp, Homo sapiens
gcttttgtggcacaaagcttagcatctaaggttctttctgacaaagttagtttgaaaacaatggatattgtttagtacagagtcagaaagttaactagttaaaaaactggatacgaagaagagtcatatataatgtaaaggtattttactttttattgatttgcagatgtaatttctagtaaaattacttcaagatgtgaatagggtacttggggtatgaaacaaatttttttaaagaggtcataaacttaacacttgcaggtattcatttattttaataacacacttcaaaagactccctatactggtgattggttttattccctatggaattttgccctgtttttggggggtttcacttctattgtacaaactcaagacatcgaagatatgccctaagatataaagcaattaaactgtatgttagggcctgggtagagcttggaattgttaatcattctattaggatttttcgtctttttttgtttgtttgttttgttttttgtttgaggcagagtcttgctctgtcacccaggctggagtgcaatagcacgatcttggctcactgcaaactctgcctcccgggttcatgccattctcctgcctcagtctcccaagtagctgggactacaggcgcccgccaccacgcccggctaattttttgtatttttagtagggacggggtttcaccgtgttagccaggatgcgtcttgatctcctgacttcgtgatccgcccgcctcagcctcccaaagtgctgggattacaggcgtgagccaccatgcctggccaggttttttcaacattatagagataaaatggttcattgcagctctagttgaagtcgtgaataaagatgagattgaaactaagatatggatttgccaagtatacgaattaaataaactcttgatcttgactaggttttatttgttggtaagctacttttttgtggaagagtattttgatacat

SEQ ID NO: 176876 - DNA, 170 bp, Homo sapiens
ggagcactcagcattgacttcaagagtcctaaaatgtgggaggagttctgggggcctgactgcaagcctcagtcttgagaaggcagaggtgaaggtccttgttagatggtgacagttcagtggtgctgtggcctccatcatgactgatggagagcagctctcctgggttt

SEQ ID NO: 176877 - DNA, 323 bp, Homo sapiens
tttgtttgttggtttgttgtattttactttggtagttcttatatgtaatgtgtctggaaatatgtacccccaagtaatcactgtaattatttttcagtgctcatattttggccaacataacatttacctgttttttagagcttttctatgatgagtttagactccctgtgtaatttagagcagacaaaaattgcaggctggaatatttgctgagaatgaaagctgtagagtcccccacccctagctgtgccactaggctccttgttgagactatttgaaatgtgagcctggcactcttggccaccgtgggagcttgcgtgcca

SEQ ID NO: 176878 - DNA, 415 bp, Homo sapiens
gaatatggggtctctttccttagtatatttatgaaggaataatcgtaaaatatctggtatggtatgatatgtggtcatcatcgttcatcttagcagagttgggatgagttagaaactgaaagaccattttaatactaaggaaagagaccccatattcccagcaagagttgggtgccaacctagttggcaaaaacagatgtaattcctattctttgcttatggcaagagaacagaattagagtattaaaccagcttcagatacttcaaagtggaggcaggagagacagacaccaaatcatcccaagagcactcaattggaaaatggcacatgaaccaaagtccacttcactcctaacactatgagaacaatcataattttatattataattacaaacgcttatggggcatttgcta

SEQ ID NO: 176879 - DNA, 297 bp, Homo sapiens
taagccaagtatatgaatatgtatctccacatttatgggtaccataaataataatgcccatttcatagatgaggaaaccgagggatggagaggtcaaggaacctacccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcttcctgggttcaagcgattctcctgcctcagcctcctgag

SEQ ID NO: 176880 - DNA, 149 bp, Homo sapiens
ggaactgtcctggcagaaacaactcttttaattcaaacttcctcctttcttttcccctttcttcccttctgccactattacattattactgaactactgagatatatcatcaatcataaaattctagggatggatataaagaaatatga

SEQ ID NO: 176881 - DNA, 488 bp, Homo sapiens
gagttgtcctggggagagtcagagcatgtggattttcagcctggcacttccacgccacaagctttgtgaccttgagtattctacaggagtcatctaacatttcattacatgaagaccaggtgatcagaaaggccccttcgtctccagtcttaccagggtccaccagggcctgattcatttgttccagtgatatcactgtggggtgtcagcatcccaatggttcactcatagatccttcaggtctcctccagccaccgcccgtgtaccatgacatgacatggcatgtaccatggcccgatgtcatatgtaccatggtgtggtgtgatgtgtaccatgacatgaccatgttacatgacatgctatgacagtgacctccctcagcctctcccaggcacacagttttaccccttctcctaaagcaggttcgcacgcccatctaaaggcaacttcagtatttgcttttacttctctttaaagattacagcctt

SEQ ID NO: 176882 - DNA, 255 bp, Homo sapiens
attggctcagtcatgttttggcctaaagacagagagctggagtatatgactttcctatcctttcctgctctgtgataccctgattgtcctttgaggtgctgaataaaggaataaagcatctcagcttttccatctataaactaaggatgttaacacttgccactctcccactttgtaactgacctgggaaatgcagctatgtgatctacagctagacatttagagttgaacggaaaccactccccttggacagtt

SEQ ID NO: 176883 - DNA, 172 bp, Homo sapiens
aatgaacacacactattgcaaaaaaaaatcaacaaatcacaatgaaaaacatcaagagaagaaaaaacgtattatcattgcaatcaatgcttaaaaaccattgacaaaatccaaaatttttaatgataaaaactctcaacaaattaggtatagatggaatgtacctcaacac

SEQ ID NO: 176884 - DNA, 349 bp, Homo sapiens
tactaaaccctgtgtggcaggcaaaataatgggctcccccaaaaatgtctacttcctaatgcccagaaccttacctggcaaaataaccttgcagatatgataaagttaaggactgtgagataagggcattatctggattatccaaatgggctcaatctaataatatgcatcctttaaaagctgaaaaactgtccaggctgtggtaagaggcagatgtgactgtgaaagaacagtcagagagatgcaacattgctggctttgaagatggaggaagggatcatgagtcaaggaatatgcgcagcctctagaagctcaaaaaagcaagggaaaagattctctcctagagcct

SEQ ID NO: 176885 - DNA, 543 bp, Homo sapiens
gtaaacccgtattgtagatatggactctagaataggattgcgctgttatcccatagggtaacttgtttccgtatggtcaagttattcggatcaattcgagctatatgctagattacgctttgactggtgaaatcttagcatgtactgctcggaggttgggttctgctccgaggtcagccccaaactgaaatctattaatgcaggtaaggtaatctaggacctgtgggttagtcaggtactgtatgcattaataaattaaagctaccatatggtcttctcgtcttgctgtagttatgccctcctcttcacgggcaggtcaatttcactggttccaagtacgagacagccctcatactgggtcctagctgtttgctgattcaagctttctagataattccaaattgttaccatgcttggctttaagtcacagatttttaagtatcagatttgcgattagttttctaatgagtagtatagtctgatttgaatttgttttatgtgtagtatagctttaaatggttaaatactggcatctattacaac

SEQ ID NO: 176886 - DNA, 229 bp, Homo sapiens
agccactatgcctggccaagaagctttcttttatacaatcacacacagatggcaagtatttgacatgctcttactacaggtatggtgtatttatgaggttttttaatatatgtgttgtgtctgtctcaatgctactgcaggagtctttgttactgaaggagataattggtggaaaaagggtgattttaaatgcattcattcaagatagcaaataatagggacaaaatgg

SEQ ID NO: 176887 - DNA, 325 bp, Homo sapiens
attctgagagctagaaaagggaggaaaatatcttcccagaggtgaggaccacatgtgcaaaggcatagagtgggtggtatttggagaacttgaaagggcccgtgtagctgcagcatatggttcatggaagagatagagatgaagcttagaggtgggatgggaccagatggtagattccagaatgcagttgaagtaagtttggattttattctgcaggtactagggagccattgaaggtttttgaagtaaggaacatattgatcatattttgttttagggagataactctggcaacagagtggagggtagatttcatagatcaggg

SEQ ID NO: 176888 - DNA, 457 bp, Homo sapiens
gaagagggatcagggaccctctggccgaacaaagagctttccctgatggcacaaaaatgaagagggggggtgacaatgagtttcaatgactccaataccagccagggaactggaccttgaggagctgatcgcctgcagatctttaagctggggttagtcgttgtcagtttccagggtagaaagaccttactggttgccaatcgtgaggtccagagtgagcctctagcttcttggacttcctggaaagttggggtgcatttcgagttgacacaatgatgaaaggggtaagtcctagggaccggggctggtcctgggtggccttgcaatagaaaggagagtctcacaccacaaagaaaggaccctcctcccatgcctcctgccagggcctattgtggctgcaaccatgctcctaataacctaacccaagccctaactcgtttgtcatataaacttaaag

SEQ ID NO: 176889 - DNA, 454 bp, Homo sapiens
acacctgcttaccagataacaaaaacacatgccagtaacccaagcctctgcagaggacttagccctgttagtatccacacaatgacccatccattcctttgccctgcagtttttcacgattttcaaagaaggaaaaagatttagattattctgccaacatgcttattagcaaccctaccttcttccaatatgataaagtcactaagtcattcaacacaacataacttttttcactttaaaatgacttttatgttctcttattttttcctaaaaaaaaaccaaaacatttaatcagctcttttaaacacatgaaaatttaatcctctgaggggacacggtatgggtttgtgccagaagagaaaataattcaaacatttatttgccttaactcttaaagatatacatgacaagaatataaataagcctacaaataaataaatgttcttgagtattt

SEQ ID NO: 176890 - DNA, 532 bp, Homo sapiens
aggagactgcagcaccagcatgaactaagaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcataagctctcacctccgaggctagaagactttgcagacttgaccgtggagccagcccctgtaagatctgagaaatcagagatgggagtggagggtgctggagaagggccaggcaactacggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagcca

SEQ ID NO: 176891 - DNA, 934 bp, Homo sapiens
gggggctatagatcaagggaatagcagagtcaggggaggtgtttttagggtgcagagacaagcaaattttaccagagtaaaatgccagttaatgcaaataagatgtaagtgaggccaggtgcggtggctcacacctgtaatcccagcactttgggaggccaaggtgggcggatcacgaggacaagagatcgagactgtcctggccaacatggtgaaaccctgtctctaccaaaaatacaaaaattagctgggcgtggtggcatgcgcctgtagtcccagctacttgggaggctgaggcaggagaatcacctgaactcccgagacggaggttgcagtgaaccaagactgcgccattgcactccagcctagagacagagtgagactctgttaaaaaaaaaaaaaaaaaaaagtaagtgaaggaagagcccaggaagggggttcaacgtggcttggagaagggacctttctttcctcacatgtgtgagcaggggcaggaaggtgagtggaggcacagagacttaaatctggaggggaggaggattaaggtgctgtccacagcaagcttccatctccagaagtgggggcagagtgagagctcttggctgagcgtggggcaccaggattggcaagagagctgggggaaggaccccatgggacaatgttctgaggagtatgaggttcatcccaaattagagctgactggggtacccaagcagcaagagtgtgggactttgtccagccagtctccactgtctgggagtgaaaatagagaagcagatattggagttatttcccagggctgaggctggcaaagcagccatggtgggagttaaagggcccaggcattctaagaagctggcaaggggcatgtgttgggaggccagtaggagactccaaattgagtaggagacagcaggcaaatacagaaacatga

SEQ ID NO: 176892 - DNA, 144 bp, Homo sapiens
tgaagagtgagtgagtttatgtagacagtgtcccgttttacatgttcacagctatgcccatttaccgtccctcaaattgtcctctctttctatatattggtcaaaaaaacataactagtttaaaaatttatattctgatgtaaa

SEQ ID NO: 176893 - DNA, 265 bp, Homo sapiens
cagggtttgctgaccccttcctgggcttgattggcggtggggtttgtagcagaatgccacctcctatctagagccttcggcatctctctctgtccatgtctcctgtagttggtgcgcaggatggcatttgagctcacaacgctaatgcaggcaaatcatgacgtggtgcaggaaaacatttgcgtaattttttctctttagtcccagttcttgtaaaaaaaaaaaaaagaaagaaagaaaaaatataattttttgccatcttttc

SEQ ID NO: 176894 - DNA, 207 bp, Homo sapiens
tttaaatactatttttaagatttttgtcttgacatctgtgagattagcctgtaattttctgtgtgtgtggtcttcgaaatcaatactgtgcctccttgtgaaaaagaattggcatgtttcttaggctctgaagttgtgtgagtagccctgaagctagctgtctgtttcctgaaaatctgataggattgccttcccaaaatcacttct

SEQ ID NO: 176895 - DNA, 149 bp, Homo sapiens
attaaacacctgataaacattagctattaataatgcctcttctgtcttctacctgtatctacctttaaactcttgatagctctaaagtgacactaaactgattcataatatcagtgaagaagaaaaaaagtggagagaagagttttaag

SEQ ID NO: 176896 - DNA, 869 bp, Homo sapiens
tttccttcaagttttattgctatgagattgagaactccaggtcccagcaatctactaactaattccataaaaaataagtatcctcatggaaagcatgtgtttaacccttcttaccacacataattccctttaacagcaatcagcagggaaaagaatctaagaatatggtattaacaatagtatagcttttagatgtctcaaaaatcccttacagaacaaattttttaaaaaatagaagcacaaactgggatattcctatcacaaatctatatcccttgtgaatgccaaaatatgaacaggtgaagacaaaccatcaatagtcccaaaacgtgtatggcatccgaatctgtgcaggaaaaaaggtaaaagtaacaggacatcagacagacatggcaactctgaaatggctaacagaaactcactggagaggtcagcatgccaagataagaacagtagctgaaactgagagaggtctacacaatttcaggtaagtacaagcagtcttcaataaggagtcagtgggcccaaaaaactctaaatactttccagataaagcccgacactgaggacaaattgctgggaaaatccaaattgaccaaaccagagacaatagagagagaagaaagagagggtcaagataaaagtggaagaagtaaatgaagtcagaaaattataaaatgttgccactatattttttttatcagacaaaaacacagaattttaaaatgagagaaaaaaactatcttaaatgactcatttaaaaagtttaagagaaccaattccatgtaaaaacaacagaagcacattagttgaatcccatacaatgctattatatgaaaaaagaaggaccagaatgcagccctaagaaa

SEQ ID NO: 176897 - DNA, 244 bp, Homo sapiens
tgagccactgcatctagcctaagcaatttttaaaaagccttttggtaaccaaagaacaaaaggttattcttccaaggcccaggtgtcccatatgaagcctttcctgattattccagcttccactgccttctagcccttctcctgcaacacttacagtctgtcatgggtttagtactggtcaaagggcagtgctccacattttataagtatgtattttttcatatcccttatcaagcacttacgt

SEQ ID NO: 176898 - DNA, 408 bp, Homo sapiens
tctctagcagggtagggaggggcttgggttgccctggaggggctggcctgtggcctgtgctgggtgaagttcacacctgggtgtgccctcgggaaaggggcctctggggacagggtgaccatcagaaaggctcagggctcccagtgcaccatgctgtcctttgtcccagctctgattctgtgcttactgtgcccaggttcccaggtatggaattgcagggtagcagcatggggacttccaggtgggcccctcctagcaggtgggggtttgagccaatgaagaattcagtctgctgacacaggtctccctccaaaagggcgtgtctctaggacagaggcagcaattccacagccatatcactcactttctagttttttgttttgttttgttttggagagagggtctcgc

SEQ ID NO: 176899 - DNA, 675 bp, Homo sapiens
ctgatcctgtgacattgactactcggctggtctttatagctaggctgatggcctagtagtggacgaagtactggcatcgacggagtatggcgaggtgtcggcttcggtttctctccgtgggaagaaccgcatcttcccagcctcggctgcggggagcttgatgttccaggagagctcccctagagtggggccttgaggggagggggcaggggcttcgtgactggacgggggtcctgtccctaaccttgaccgggccacagtctctgtatctcggggtcaggggccattctgaggaatccaggtccagatctgtaccttataaacgctgcttctctttgggaccgatggagtctccccttggcctgtcaagctcttgtagcttagagaacaggctcagttttgaccattataatgattttcacccttattccgacttaagttcgtcttatggtagagagaaagagcggctgcgtctggactagttagtctcgtcccgttatttatatggaatgtaaagttcttcactctaaaactgtgttttaggttgggcctgatgtcagatttgtatggctctcttttacacttttaaaatgttggggttattccttattatcattttgtgggtgaagtgatggctaccttgtagtacctatttttaagtaaattactttgttg

SEQ ID NO: 176900 - DNA, 435 bp, Homo sapiens
ataaacaggtggcatggacagcttccatccctataaggaccaacaggcgggtttctgaggaccagaaaaatttccagctcgcccaagtatgttgatttggtgcctgggctggtggctccctctgatgtcacaccccagtgcagctccccagggctcctctggaaccttcggggaactccagccaacttctgtgaaccttgtttccaccccaactctccctccagactcacatacctgctcaaacgtgcagatgctgctttcattgaacctcagatgtctcaggcatgtagggtgttttaaatttcagacacctaaaataaagtgtctgaagtttaaatgttaacctgtgccagtaaaaatagcagaagtgcctgaggaaggcctgtggtgggtgggtaagaattgttggcattattgaagaaaaaggaaagagct

SEQ ID NO: 176901 - DNA, 392 bp, Homo sapiens
acgtttttaaataaaattagtgccttaaagccagtgcagagagacagatttgaggtggacttccatttccctgtaagtagacttgcaataaaaagcttttctttcctcaaaaacctgggacttagtaatggcttctagcacattgggcagcaagccccttttgctccataacactgtaggaaataaatttctgttgtttataagctacctagattactgtattttgttatggcagcttaaagggactaagataccataccacgtatttcattagattataaatgtctgcctattcccccaaaagttccctgtgggcagggcctggatctttgtaaccttgatatcaacctagcacagtgcctggctgataggtgttgaatatttccactcta

SEQ ID NO: 176902 - DNA, 854 bp, Homo sapiens
  misc_feature (500)..(500): n is a, c, g, or t
  misc_feature (573)..(573): n is a, c, g, or t
  misc_feature (593)..(593): n is a, c, g, or t
  misc_feature (735)..(735): n is a, c, g, or t
  misc_feature (742)..(742): n is a, c, g, or t
  misc_feature (752)..(752): n is a, c, g, or t
  misc_feature (757)..(759): n is a, c, g, or t
  misc_feature (761)..(761): n is a, c, g, or t
  misc_feature (765)..(766): n is a, c, g, or t
  misc_feature (770)..(771): n is a, c, g, or t
  misc_feature (774)..(774): n is a, c, g, or t
  misc_feature (776)..(776): n is a, c, g, or t
  misc_feature (778)..(778): n is a, c, g, or t
  misc_feature (790)..(792): n is a, c, g, or t
  misc_feature (795)..(795): n is a, c, g, or t
  misc_feature (799)..(799): n is a, c, g, or t
  misc_feature (803)..(803): n is a, c, g, or t
  misc_feature (805)..(805): n is a, c, g, or t
  misc_feature (813)..(813): n is a, c, g, or t
ggctggaagcaacagatggggactgcagaggaggtggtggtatgggatagtgctgcagccaagaacttaacgactgaaagtaactgggatatcttcataattatctgaaggtcacagtgggagaacaaaattaaaagaactgagaagacttacaagagaacctcctaagagtcacccaaacaatcggctgagaatgagaagaggttcaagtgattcttgtgcctcaggctcccaagtagctgggactacagtagctgggccagcacacccagaaagcctcacattgtgcagtggagaagctgagagaagaggaaaagaggagtggcagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgnctttacttatactgggcagatggcagcaggtgtctctggctgaaggggataggttcctactgcttcgaaagancaatccgactggtggttggnaagagcctagaagctcctccactctcgaccatcttcgtcccagcagctatatgatagaggaatcatcccttccagagtcaatacgtcaatccccggcaattgtctggactcctgggcgaaatgttcatggtcctggagaggntcaggcncccaagaggncaggnnntngaannctcnncantncngaaaggtggagnnngangaantgancnaatttgancttcgaggacagggaacctcggaatcttacagaagccgcat

SEQ ID NO: 176903 - DNA, 792 bp, Homo sapiens
tttttttttttaagtggagatggggtttcaccatgttggccaggctggtcttgaactcttgacctcaggtgatccaactaccttggcctcccaaagttctgggattacaggggtgcctttaactattttttaaaccaaccacataggagagcaagaccttgattctaggaggctacaagtcctagccctgctgtgactgcagccttactttctctttatcctgaatcaccacgattcttctgtttgtaatattggcagatggtggatgtggtgatcccaagttcattcttggcaacttattttgaaaaatctgctgttttattcttcctgctatactcccatatcccttagttaactcctgtattgaagtacttagcacacatgacttgaatagggattttgtcataatcatttgtgtttccttagcatctagcacatggtcacttggaaaatatttgttgacacatgatgatcactttccaatgctgagatggtgtgattttgtgatttctccaatgaccttgacctagattgtgatactagtggtagtcttgtataggtccctctctgtgttgttcttcttcgtaggtgctttgttctcaggctctggaccattctcttgttttgggacattccagggaacaggagagaaaaatttgcatttaaaacaaaaggagtatgttacatcgatgttcctcattgccaggatcactggaatgttccagttgctatcaggatgaattcactgttggtaacagatgccagggactcattatatttttgttattcttc

SEQ ID NO: 176904 - DNA, 317 bp, Homo sapiens
tttttcaatgttaactatcctaccaagttttctacttcttattgcagttttcataacttaagtttattagaaaagcatccacctcctctttttaaaaaatatgttgattagagttgtatgaggtatctttttatcacttaaaaaatcatattgatatctgtggttatgtctcctttctcattctggatcaggcagtcttacatggagggaaatcttgaaaaatgtagattccacatggccatttattttctaatatggatgacatagcaactcagggaagcagacttctttccaaacattgaaataattaaaacctt

SEQ ID NO: 176905 - DNA, 746 bp, Homo sapiens
tccatgtttgccccatacagagtattttccacacagcagccagtgtaactgtttacatttcaagtcatagcatgtttcctctctgttcaaaattccaatggcttccccaaagcccttccatgcacaaggccctgcctatctggtcatctgcctcctctctgacttcatttcacctttctactctcttggctcttccttcgctctctatagttactctgtatgggggatctcgagatcccccatacagagtattttgttttcaattagggagatagttggtattaggattaggattgttgtgaagtatagtacggatgctacttgtccaatgatggtaaaagggtagcttactggttgtcctccgattcaggttagaatgaggaggtctgcggctaggagtcaataaagtgattggcttagtgggcgaaatattatgctttgttgtttggatatatggaggatggggattattgctaggatgaggatggatagtaatagggcaaggacgcctcctactctgtatgggggatctctatctgttgtttacaaagatactctttggcattctgttttcctttggccttggggactcttgttactcctgatatccctcccacctctctgatgactgtctgctccctatggcccgttatacgcaactcgtcgcccagcccacatccctaatgctcgcgactccctgatggatgcagatcttgcgtgatcctcttcttacctctgtatgggga

SEQ ID NO: 176906 - DNA, 521 bp, Homo sapiens
aaatcatcatgagttgaaatttaatgaagattaacatcaagacttagattcattagattgaaataatcaaattacgtgagtactggattgggaagatctaggtggacagggttttagttgaccataaacttagtatgagccaattgtgtgttaagactcagatacaggaaagtactggtactactgggctgcctgtttgaaataaaattgctaaggcattttgtaggctgttgataaactcagccacatcccacaactgagatggtggaaggttttaaaaacaacagttaaaaaaaatactgggttgtttaatctgaggagaaagtaagtggagacatccctgcctagagatggtagaaggctgtcctatgggattagccgtattgctccagagggaaggcctagtatatagtgggtggaaatcaggagatgtatttcagtttaaaatgacctacttatgatgtaacagctcttggatttatgcatctcttattatggaatgtattcagataaagcaggat

SEQ ID NO: 176907 - DNA, 307 bp, Homo sapiens
  misc_feature (17)..(17): n is a, c, g, or t
cagtcacctcggccctnctttctcttagaatagtgcaggggacatcattattcctcagtcagtagtggtcagtattataacgagatccttggcatctgtggatgtaacaagtttcgcaattctctagggacccctctggtccatgacaggtaatggtttgttgttttgctgagacaaaagttaactgctctcatggaatgatattatgacaatttgaaaacacacacatacacttctttgtgaaaagtggccaccgcgcccggccagcttttggcgaaccttctaagagacgtaggtcccgagctta

SEQ ID NO: 176908 - DNA, 316 bp, Homo sapiens
ctgtgtgcagactccacagagggggaagagccaagctcttttcttttgcagctgggaggtgggtagcccagggcaagttttcaagcctgtcatgctgtctgcctggaaacggattgggggctgttgcagggggcacagtgggagtgaaaccagcccttcggtttgcatgggagctgggtgaggcctgtgactgccggctttcccccacttccctgacaacctgcagagacagccataatcctcctagagataggcagcaacacaataatagtgggagatttcaatactccactgacagcactagaccagccatcaa

SEQ ID NO: 176909 - DNA, 652 bp, Homo sapiens
agaatccggtaccacatttatcaccatctccttctggagttttcagatgttagaaaaatgacaactgttgcgcagcggaatggatgtttttgctgccccgactcagaggaagggcatgtgtatgcactgttagaagccaacctcccacccaagggcctggctgtgtgctttcccaggggctggagcatccaggggcttttctggagttccaggatgggactctcgttctccctgtccagcatatgacccggtgccagcatgaccaggcaaagccttatgggccaaggtgagtagagctgatgcctgctacccttgaaggtatcttccctgcttttctcacggttctccaagcctggcatactaaggaagcctatggtcacaagcccatgatcaacctgaccctcaagctctgaaacgttgagttcctcagtaaagcatgcttgggtaggacctgcagcaggcatatagcactaggctctgggggcagtgcctagtgctattgtgccctcagtgtgaggttcattcagctctaaatcccattctttggactttgcccaagttccaatccaggctagcagctgtcccccatgtttcacagatggggacaccaagagctaagggcagtaatgacttgccagggtattgaaatggg

SEQ ID NO: 176910 - DNA, 364 bp, Homo sapiens
attcattgttattccactcaaattaggaaaggctgactgctgacatgggggaagggaggttttgccttggcaactagtcttgcctggcaaggcagccatcacggttggaatgtccaatgcctgcagagaaagcttcagaagaggcttgttcagctggaaggccaaagggccaactctccacccccagcactgtatcagaggacagcggaatggggctctctcttccagacatctgtagtggctgccctgcacattctgatgttgaaacagcgggacatggtgtctgaaaacacctagccacactctaacggatattaattcgattcccctgagaaagcaagtcagagctccctactggggtgtg

SEQ ID NO: 176911 - DNA, 717 bp, Homo sapiens
gagtgggggcaacgcagtactgcagaaatgccatagaagctacctttgcagtaggcctggactttagccagagcctgtagatacagcaaggctaccttctactacagtatgtaatttacaactgtgaaaccacagcatctgcactggaatccttccaggtgttaaaccaggagtactttattacagaggcagcacaacaaagtgctgatgtatgtggaatcagaagtcagacagactagggttcaaatccaggccctgacacttatcagctatttgatccaaactttggaccacgtatctactctgtgcctcagcagcctcctttataaaatgagatcaatgcccacttcacagggttatgaagagtcaatgacatgatacatttatcatacatagcaccgtgcctggcacatacaaagtattaaatggatagtaaccaacaatcaaaattaaacgaatcaggccgggcacagtgcctcacacctgtaatcccagcactttgggaggccaaggcgggcaaatcacttgaggtcaggagatcgagaccagcctggccaacatggtgaaaccccgtctctactaaaaatacaaaaattagctgggcgtggtggcgtgcacctgtaatcccagctactcgggaggctgagacaggagaatcacttgaacccgggaggcggaggctgcagtgagccaagatcatgccactgcattccagcc

SEQ ID NO: 176912 - DNA, 381 bp, Homo sapiens
ggtcaggcactgaagcctggtcaggcactgaagctggtcaggcactgaagcctggtcaggcaccgtgcctggcacatacaaagtattaaatggatagtaaccaacaatcaaaattaaacgaatcaggccgggcacagtgcctcacacctgtaatcccagcactttgggaggccaaggcgggcaaatcacttgaggtcaggagatcgagaccagcctggccaacatggtgaaaccccgtctctactaaaaatacaaaaattagctgggcgtggtggcgtgcacctgtaatcccagctactcgggaggctgagacaggagaatcacttgaacccgggaggcggaggctgcagtgagccaagatcatgccactgcattccagcc

SEQ ID NO: 176913 - DNA, 469 bp, Homo sapiens
acagctataccaggaaacagcttatcaccaggaaacagcgtatacctgggaatcagactgtaccagggaaccagtgtacaaccacataaaccagtgtatgaccagcgtaataacctttagatcactcataccagtgctgtcataaagccatcattactgatagaaaaaacaatgcacatttcaagtgtttatgatagtggttgataatatcatcttggagtagaagaacagcaaacctcctatgtcaaacagagcagcacagaatgacaggtctctccatgcaaaagctctgtatggactcctcagcaaacctggagatccaggaagagattcaagctaaacgattgactttttggctatcagttaaggagttcatcaaatgcctgagcccctgtcatatgctggactctaccttgtgttaggtatacattttctgagccttaacaaaaagattcttccttaatttatt

SEQ ID NO: 176914 - DNA, 466 bp, Homo sapiens
aggtgagggggtaggggagtgctgtaacagatggctttagattgcctcaaatagggttgtaaatttgactataagatgagtcagttttctgtgttcatttcatgaccatgcatggcacctctaaccttaagtttctctcaaatgctgtcataaagccatcattactgatagaaaaaacaatgcacatttcaagtgtttatgatagtggttgataatatcatcttggagtagaagaacagcaaacctcctatgtcaaacagagcagcacagaatgacaggtctctccatgcaaaagctctgtatggactcctcagcaaacctggagatccaggaagagattcaagctaaacgattgactttttggctatcagttaaggagttcatcaaatgcctgagcccctgtcatatgctggactctaccttgtgttaggtatacatgacacctgggatcctctagaacgccaca

SEQ ID NO: 176915 - DNA, 289 bp, Homo sapiens
agcttatgcagggaaactgccagttttaaagccatcagatcttgtgagactcatttactatcatgagaacagtgcaggaaagacccgcccccataattcaatcacctctcaccaggttcctctcatgaaacacgggaattatgggagttacaattcaagatgaaatttgtgtggggacatagccaaaccatatcaatagtggcattaaaacttgtgtggttcttaactaaccaccttccagtgggaaagctgatggaattaacacaattgtgggctgggatcttttctg

SEQ ID NO: 176916 - DNA, 458 bp, Homo sapiens
tatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctgg

SEQ ID NO: 176917 - DNA, 256 bp, Homo sapiens
aatctaaagggatgctcattaaggccatgcagatatccccctaccacccctagatttacatcccattaatgattctggcctgaactattctttttttatagactggtcaacacctcattccataaaatggaaaaagtgttcctgcaactattctttattctgatagttgcaaaatgattattttccaaacctagcactctcagaggagaactcttttaatgccaaaaatatggagatgggattggctcttgccaac

SEQ ID NO: 176918 - DNA, 544 bp, Homo sapiens
ctgtggatccttaccctccagctccttgggttgtggcaccaaaaacgtggctggatctggtacccaagctaatgtggtagaggaaaataattagtgaaaaccatcagcacactccctctgttctggcttctttgtgcattttaacagtggagtctggaaataatagtcccacttcagctatttaacccaagactgactggaatgctaggaatgtcaaatcaggtagggcagaattttgtcatcagagcaagcaaatgtcaggtgaactggaagacaaagcaggacgtaggtaagaatgcagattctgagtcaaatcagttgggttcaaatactggcttcatttgctagctgtatgaacttggactagctgattaaccactttgtaccttgtttcttcatctatatagtaggtgttattatagaacatacattataggattattgtgaaaatgaaaacaaaataatctataaattagtgatagatcggaggtcatcagtaaattgatgaatggataagagtagatgcctgattgcagaggactga

SEQ ID NO: 176919 - DNA, 439 bp, Homo sapiens
tacaaaattacactcattgcttagatgctgggctcacacctagacaaatggtatgtttttaaaaatacatgcaccagagttgcttgaatctctcaattgcttttcagcagtttataaaacagtaaaagaattaaagactctaatgtggtttaatgtcagggattaaattagaaatgctaaataaagaaacctgctcttattcaaagaacatgcatttgcatgtaagattccagcataactgttactaagtcttttatttccatctcatctaaaatgacaaagaatggaaaagctcaggcaatttgtccaattaaattataatatgggagagacatggtggctcatgcctgtaattccattttgggaggccaaggtgggatgatagcttgaggtcaagagttcgagaccagcctaggcaacatagtgagacccatctcta

SEQ ID NO: 176920 - DNA, 660 bp, Homo sapiens
aacatgtaatgtaaacgttgtcggaaaaaaggggaattctttttacctttaacttttctaatttaaattatggtatggcagtaattccatagcaaaattgctttgctaacaggtgaattctcttttgttctttcaattattctacccatttatttagaatatgctgaaatatatatctacttctatacttgtagagttttaaacagtaagtgttaatagcctctcacagactattattctaagtgaagtaattcaggaatggaaaaccaagcattgtatattttcactcataagtgggtgataagctttgaggatgcaaagacataaaaatgacacaatggactttggggactcaggggaaaagggtgggaagggggtgagggataaaagactacaaattgggtgcagtatatactgctcaggtgatgggtgcatcagaatctcacaaatcaccactaaagaacttactcatgtaaccaaacaccacttgttccccaataacctatggaaataaaaatattttaaaaagtaaagtatactgttgaagaaaaataaataaataaatagcctctcacattaaataaaattcccagtgaagaacagtaagtttaaatgaaagataatagaaaaaaatttttaaatatacttgtttcataaacc

SEQ ID NO: 176921 - DNA, 430 bp, Homo sapiens
attgctaacattatgaggtatttcttctgaaaaagcatccagaggttgaagaaaaacatactgagtatattatttgaaagtgtaatgaacatattaaacttatttaaaaataagtttaccttttggttcctgatttttaaaataacctatataataaaatggttccaggattcattatctggttcacttctcaacacaataaactctctgaacacttgaagtatggaactctaagttagactaacacctgcctcacactagataaaataaacttttatgtttccgcattatatttataaactggaatatatccttatatcttaaaaatattataagattaagtcatgtttaatttcaggtttactatgacctacttagcaatccccttctgcaataagcttttatttagaaattttcccttagaatgaaa

SEQ ID NO: 176922 - DNA, 195 bp, Homo sapiens
gaagtttatatggctttattttttgcacagagtagttattcaatatacgctgactgaatatattttaaaacttcagggagtaattaaatcagccaaagtaaatttagtctacacatacatttatagaatgtacaccatctccagcctcagacaactgcactcaagttgcccctttcccgagccactttctggcta

SEQ ID NO: 176923 - DNA, 493 bp, Homo sapiens
ggtccgctctagagtatccccacgttgacacttcagaacagtgttttttcacattctagtcatataacggactagtaagctacgatcagcattttgtgtacatgtacacaataatagaataaaatcagcaattgtatcacagagcatcatatataatgtaaaaggtatttctctgtgaggcaaggtcaaagacgtttgaaaaacattagtgaaggagacagcattcaaataattacacaaatggacatatggttaccaaccattcattattaagggaaaggtaccatggcacctggtgccatggcagcatctaacaggtaaccaattttagtctggggagagaggaagagggaagagatcctggaaactcagagatagtaggtaaaagtgaggggaaaggagttttccggacagaatagcacatgcaaatgggctgaggtttcgagattttttttttgagatggagttttgctcttgttgcccaggctggagt

SEQ ID NO: 176924 - DNA, 517 bp, Homo sapiens
caacttgggcattaattctattctaataaacaggagtttaaaacatttttattgaaggtttggaactggacacacaacttcttccctgcctcctcagacccagagatcagctaagggtgacccccgtggcaatggcagtgatttcaccatccccaaactgggagaagttggagggaggtaggaaagcttggaaagggtattaggagatgatctcctcctgaacagatgccacagtgaaattcagccatccagccatgcctgaaatgctcatgggccccttgtactttacccccagcacatggccctcctgtccctctcaggggtcccagagttcccaaggaccagcttcattgacacagccaagtcctcaagtctcaagcagctttcttagacataattgcttggggtggatgttaagtcacatggtttgggaggcctttttccttgctcaacagcagatgcccctgtttagagagaggtagcatctgtcatcaaccagtgaggccagatgtatctg

SEQ ID NO: 176925 - DNA, 369 bp, Homo sapiens
aaagtaatggcattaagagatggggcctttgggagacagttagtgcccttataaaagaggccctcaaaagctcagtagtcccttccaccatgtgaggacacaggaagaaagttttgcttgtaagccagaaagtgagtgctccccaggcaccgaatctgccttaatattagactttccagcttccagaactatgagcaataaacttctgttgtttgtaagctccccagtttatgggatttgttatagcagcatggagaggctaagatgccatccttaaagggaggacgaggagagggcgcttcctcccctgctgagccccagctctgggttgtcaggtagcagagcatttagggagaggagctcattaag

SEQ ID NO: 176926 - DNA, 467 bp, Homo sapiens
aaccatctctttagggaatgagtaattcaggtcttgttaggaacaatggagactgggacagtcttggcatggtaatgactgttgcctaatcattttctgacaagcaatcaaaattattttagttcagcatactccctcatgagacatattgttctgcacaatcgattccttctagcattttggaggggtgtgagtatgtgtgtgcacacatgtttgtgtgcacacatgtttgtgtgcatgtgtgtgccagccaaaaacagaccttggcagtgatccacactcccatctttgaactaagaaactgacatacagaaaaatcaaaggtttgaatgaatggtcagggaattggtagacaacttagctgcaaaacataccccaggtgctcctgtgagaagggagaaatgcaggactagcaggaataagtgccataaacctcaccatagcttacatttgcacagctcacccca

SEQ ID NO: 176927 - DNA, 542 bp, Homo sapiens
gaggaaaggcagtgctagctggtagacaaactcaagttctaatcatactctgacacctatgagtcagttatatgacgttgggcaaaataaaatctttctctagccttattctcatcagtaaaacgaggataattgctctttgtcctcatcgcaggccttttgggtttgtttgcttgtttaagaatcaaatacatgatttcagggggaaaaacggctttgcaaactgttaagtgctataggaacacgaacatattgaacatacatttattaaatccctcttactcatctaccaccgctattactaataaatatgaccatttactcgcttgaaacccatgctggaatttgacatgcaaatatcctgagtgttgctcatttgcattggaaaaagggaaagaggtgggaggccttttgaagccttttaaaaattgagctaaggggatgaattcttatcactgggcccaagatataattgattttctacacaatggctcacaggtgctacatttaacaccctgagtagtaggaggatggaaacgtat

SEQ ID NO: 176928 - DNA, 407 bp, Homo sapiens
ataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgc

SEQ ID NO: 176929 - DNA, 415 bp, Homo sapiens
tagacgggagagctggaggcactgttacgaacagatctgtcaggaccacaatcaccagtgttgattcaaggacttcactggcccagaaataccttcctttgaatcttactggacataatctatccctctaaagtggactcaactcaccattcaagtcactcccagggtcaggatgaagaaattaatttcatgttttttgctagggtgtgcatacttcttttaccaagaaggctatgagtctccctgggttaccttagtcagaaagtgtactttgcttgccctgcctttgaggatcagtcatgaattttcaaagccctgtttccaggcaactgatattttggcagaatggtttctatccatatctctagcttcacttcctatgaggaagcagacatttcaggcatggaaggaggga

SEQ ID NO: 176930 - DNA, 361 bp, Homo sapiens
tgctgggattacacgtgtgagccaccgcacccagcccagctcatgttttatacaaatgttgaggtgttttggctgtacttaaacaggaggaatagaaaaaagtaccagttcattcctttttttattcaattgtttggatataccacagtttgtgcattcattaactaaatgaaggtctacatttaggcagtttgtaattttgggcaatgatgaataaagatgctataatcttttttttttttgagaaggagttttggtcttgtcacccaggctggagttcaatggcacaatcttggctcactgcaatctccgcctcccgggttcaagtgattctcctgcctcagcctcctgggattacagg

SEQ ID NO: 176931 - DNA, 256 bp, Homo sapiens
ctgccagattactaagtctagtctatctcttgggtgtaaatacattgatcaagctcatagaaactcatacattaaaaacccaaccaggtgcagtggctcatacccgtaaatcccaacacttttggaggctgagacaggaggatcacttgaacccaggagtttgagaccagcctgggcaacatagtgagacccccatctgtgaaaaaaaaaaacctgcaaaaaacctaatatataatctgtcatgagattacagtta

SEQ ID NO: 176932 - DNA, 555 bp, Homo sapiens
agacatatttctgtaagcgtacacatccttattttgtgcagacttttctttcatgctcctgtttcttttccttttgcttgtagccagactttttggactcagtgtctatttctcactagtgatgtggattctgcagtttgttttctaccctagctttctactaaagttgttcttttcatggttgtcactgatttcctacctgttttcattggttgtttgcttagttttcattttcctggagctttctacagtgatttaagaccattgatttcccttttctttgtaataacctctcattagctccatgtcccagttctgtttcttctattcagtatgtttgttttttattgatttctctcttttctccacttagttgtagacatttcttttttctttttttgagacggagtctcgctctgtcgcccaggctgtagtgcaatggcgtgattttggctcactgcaacctctgccttccgggttcaagtgattctcctgcctcagcctcctgagtagctgggattataggtgcaccaccatgcccagctaatctttgta

SEQ ID NO: 176933 - DNA, 556 bp, Homo sapiens
aactcttaatggcacacaattcgcatttactttcaggtgtctgtagattagttgagctcagctgggtagctctgggttgctggttgggcccacatctgttccacttattgctcagcctcctaggaccagtggtctaggtatgcacactcttcttgtggagatgcaagaggcccaagagacaaatggaaacaaccaaagcttgggctcagaactgacacatgatcccttcaccatctattggcctaaacgaggctcatggaccagcccaaagccaagggacttccagctttggcaaagggaactaaagagttacacagcaaagggtgtggacatgagaagaggtgaagaattagaatgatgactcaaccaacttcttaaactattacaaaacaacacctaaaaggtagtttgatacttgccacagctgacactactccttaatcacagtgacagccatgtacatgttctcttcctcaaaagctaaagttccataaggatgacttctacatctgagatgagccttttaaccccatccactctcataactcaatgtagt

SEQ ID NO: 176934 - DNA, 463 bp, Homo sapiens
tcccaagtggctgggaccacagagtgcaacatgcctggctggatcatttgttctatagaatgtctgccaatttgaattattctgatactttctcataattggaatgaagttatggatttttggcaagaataccacagaaatgatgttgtggtgtcctcagggcatcatactaaggggttgataatctctgtgtcttattattgatatttactttgattgctttggttaagtgggtgtctgccatgttttttactataaagttaccatttttccctttgtagttagtatgtatcttagggaaatatgttgaaactatgcaaaatctattctcaaactttcagccacaaatttttgcatccatgagagtaccttatctgtctgtgacagttactattgtggtggttgcctaatggcgattatggttttttatctaatacatttatttaaattctactatgaggaa

SEQ ID NO: 176935 - DNA, 557 bp, Homo sapiens
tgttaggggaaggaaggagaaagcctgagggaagcaggaggagagagctgggagaaggttctggagtgaaagtcttgccagccagtggacctaggctggacagagcagatgctgggttttgaaagagattgatgacaaccccttcactcccggcagcattgggaccaggcgacctgtggccttaatcagcctcttttaggggacagagagcttatggaggagagtcaggacataaaagaaagacacttggatgccagaaaagattcgtatgaaaacatttagaggaatgcagtggaaaagcaggttaatccattgtctggtatgcacctgtgtatatggtactatgtaaagtttgatgcatcctgcttcttgtaactaatggtttattgtgtatcatttcccctgttcattcagtgctaatttgtaagattgtgtaatcagaccctaataggtttgggcctttgatgaataacttttaaaggaccttctaatttttaaatgcttttatttttgccattgaattatggctatatcttcttccatagccagccccagca

SEQ ID NO: 176936 - DNA, 406 bp, Homo sapiens
agccacatgcgttctctctcataccattaacagacacactcagtacagtaccacattttattttcttcatagcacttctcagtatttgagactaattacgagaaatgcatttattttgtgtttctcaccgttgaaatattgttccataagggcaggagcttggtctctctggttcaccactgaatccttacacctaaaacactccttggcaaattaagcacgtgattcatatctttggataaattttgaaaagaatgagatagatgtgtataagctaaaatggaaagatgcctaagatcaaccacaaagtgacaaaatcaaatcacgatataaattaaatgatcccattatcataaaaatggatataagtacatacacatacatagaaatagcaaaggtataccca

SEQ ID NO: 176937 - DNA, 773 bp, Homo sapiens
ttggggttgttatgaggataatacgtgagaatactaatacaaatgcttagaataaattactattataatgactattctataaataaagaaactaaggcttagaaaagttaagcaacttgtctatcatataaagcaggtaatagtagagcagggattaaaaaaaccaaaccaggtactacatctcactccaaagcctgtatttccactatgttgtactgtctcctaccatgtcttgtcataataaatccacaaaaatttaaactcacatgaaagatatatctcagaagagttagtttacacagtgagaacagcttatttagatttcatattttaacacaggttttttgtggaatgttaaaaattataaagcaataagtttaatgctaaatattcaaactatataaatgtaaaaaacataagtggcttctattctattccctgattctactcccctatgtgtgttctcatctactgtaataaatacttcttctaattagccacatgagctaatgtgtcccttatgtgaaaaatggggataatgatgccatttgaagtttctaagattaaaaatatgaatacaaagcacttagcagagtgcccaacacgtaggcacccaacaaatgttacatgtcattacaagaaagtcggaaaaaactctccaatttcctcatcttttctttttaaatttttttttgaggcagggtcttgttctgtcacccaggctgaagtgcagagttcacagcaacctcaaactcatgggttcaagtgatcct

SEQ ID NO: 176938 - DNA, 666 bp, Homo sapiens
gtgcagagacctagcggacagttttccggtggcagcaatgctcatttcccggacacagatggtttttggcccctgaagaactctttaatccctgcgttttgtagcgctcgttctctggctttcactcctgggtcgaaaaaggtcaccaactcctactaaatcttaaacattaacagcaactgaagcctcatcttcagacctaagagaagatgaaaatcagaagaagctgcattcacaagacctgtgtccagaaaattaaactattcaaccccctagtcccagggactattgcagaagaagtgggtgtttggacttgtaaggacctactttaagagagaaagttagttcagtatttctctataaacagtggttttgttttgttttgttttgttttgttttgttttgacaggaactagctctgtcacctgggttggaatgcagtggcatgatcctggctcactgcaacctccatctcccagacacaagcgatcctgccacctcagcctcctgagtagctgggactgcaggtgtgtaccaccatgcctggctaatttttgtattttttgtagagacagtgtttcatcacattgccaaggctagtctcaaactcctgagatcaaggaatccacccacctatgcctctcaaagtactgagattacagatgt

SEQ ID NO: 176939 - DNA, 797 bp, Homo sapiens
gagggcctgccctgagtcacctcattagcatacacatcaattgtgactggggtccatcatggataacaaagatacccatatcactcaagaaattccaagagttaaaatgttacctcccaggaaatggggatgccagactaattcttcattacacaatgataaatacacaaatttaacaactttcttacagagcagaaaaacatttagctctttggatttctgtgtgtgaattttgaaatgaaatgagaaaaagtggatggccatagtttataaaatatctataaccttcattctccactacctttattaaaatagataaaacccaataccatactattcatttattagacttccacttttttaaaaaaggaggaattcctttctgctgccaaaccattaacataataataataatgtgagcaatatatttttgtctgaatcaaaagcttgaaaaatgaaagcataaactataagcttaagaatcaatgagaactcaaaattgatcaaagacttgaatttaatagctaaaaccataaacttttcagacaaaaaacttagagggataatcttcatgtccctggatttggtaatgagttttcagatataataccaaaagtacaggcaacaacaacaaaagtagattaattgaacttatttaaaaatttttgtgcatcaaagattattatcaagagagtaaaaagacaacccatagaatgatagaaaaattttgcaaatcatatatctaatattggtttaatattgagaataaatgactcatacccttccaaaacaaaaac

SEQ ID NO: 176940 - DNA, 192 bp, Homo sapiens
ccatattacagaaatggcctctttttaaaatctgtaaataagcttaggctccataaggttaggggactgaggctgccatgtctaacagcctcactgcagcgcctggctcataagaagcactcaatgaatactccctgaatgaagaaatgttaagcttttattgagtgctgaccatgcaccaggcacagagta

SEQ ID NO: 176941 - DNA, 450 bp, Homo sapiens
ctgtagctagaacaaagttgacgggtgagacgttattttgtaaatattttttacacctcatagtcattcaaataggtacacgtcctttttgactcgttaagaaaaaaatagaaacaaaaaatggcatgtcacatgcaatgaacaaatactatgagaattattatgcaagtgtagaatcaatgaatacttaaggaatgaaaggagattgtgattaactgcatttcaggtcattacttttgaagaaaaaaaggataataatcctagtgtcttctggtaatctcacattcgctaaattcattttggcagttgttaatgtcaaaaatgttactgtataatttatggaaggtatgtgggtagaaggtggaagttgcaaacccatttcttgaaaatattttactaaaatgttttgcattgcatcttgttactttttatttctaatatgtgtttcat

SEQ ID NO: 176942 - DNA, 722 bp, Homo sapiens
actttctaaatgtttccatcacgtcatggatatatgaaaattcagcagcacttttggaggccaagctgggaggattctttgagcccaggagttggagaccaatctgggcaacatagggagacccccccatctctaaaattaaaaattaatccagatgtggtgacatgcatctgtagtcccagctacttgggaggctgacatgggcgaatcccttaagcccaggactttgaggctgcactaagccatggtcacgccactgcactccagccagggcagtagagtgagatcctgtctcaaaaaaaataaaatgctaggcatggtggctgatgcctgcaatcccagctcttttggagactgaagcaggtgggtagcttgagctcaggagtttgagactagcctgggcaacgtggtgaaaacctgtctctacaaaaaatacaaaaattagcctgtgtcccacatgcctgtagtaccagctacttgggaggctgaggcagtaggatggcttgagccctggaggtcgaggctgaagtgagccatgatcatgtcactgcactccagcctgggtaacagagcgaaatcctatcttaaacacacacacacacacagagtcattgtctggaatttagcttttagttcattgaaaattgaattttaaatatacccacttaagtctgctagttttccactgctagttttatcagttttctctaagtcctgactaa

SEQ ID NO: 176943 - DNA, 129 bp, Homo sapiens
gcagcaccgagcttaatagtctggagctatttattaagtaaaaggtcctcccaggtaaatctaaaagtagcatacaacaaaaccaatgtcttgtaatgtaagtccagggcaccgaagttattctcaaaa

SEQ ID NO: 176944 - DNA, 274 bp, Homo sapiens
atctatagtggatctggaggactctacttggttgtcagtgttcctttctgttgtacagggttcgttggaattgggaaaaaccctgggcggttcaaatccatcagcaaattcctgttgcttctttatctagtaaaaaatgattttttaaaagatatcactgagtatagtgatactgttgtagtaaaattggtttaatcacttagcaggtttaacaaatagatacattccattgttaaattatagtatgatggtatcaggcaccacaatagtattc

SEQ ID NO: 176945 - DNA, 523 bp, Homo sapiens
tcagtgatctacctgcctcatatcaaagtggtgggattacaggcatgagccactgcgcctggcccaatacttagtttttaaagaaattacaaaattaattattggctgtatcattttacattactaccatcaaagtatgagaagtctagttttcccatattctcaccagcatttggtattgtcacttcaaaataattattttagatgttctaatataactgaacaaaagtctggctgctcactgcttgaggaccaaaacatgagaaagaaagagtggtgaaaggaaagcaactttattgaaatgctagcagttggaataggctaggcttatgtctccaaaagaccatttcaagtgttaggctgagggaaggggtttaaaaagaggagacttggtatgggaaacataagagtaacacaggatgcaggttcctatgtgttgttccaaggactatctcgaattattgtctgcctggagtacaggctggtgccattttatttgctgctgagttacagattatcagtt

SEQ ID NO: 176946 - DNA, 452 bp, Homo sapiens
tccaattattgtgctgctaagcgtgatcacctgatgctgctatcttaatctttatactgcaccaatcatttcattccctatgtaaatacctttaatgaatgtcagccttcatactgaagtccgtattacttagctcgctattcaaagtcttccacaagtgattgcaacttacttttttagtctcatgtagcattatcctgacacatatgctctaagcccttgccaaattgcctttggctgagtactgatctgcacacatgcatgaaaaactactggaggcctgggaaaaaccagcagaagagtaagtatatgtcccccaagtttggatactgtctccaaaaggagaggaaagagaggaggggacagaaaaaaaaatccgaggaaatgactgaaaatttcccaaactgatggagatataaacctgcaaacccaacaagctcaatgaaccacaa

SEQ ID NO: 176947 - DNA, 277 bp, Homo sapiens
ttgagagcttgccattcattgaaactggaaggttcaatgacgcaacagagagttgcaggagatggggtgaaaacaggacacggcagacactgtgggataaccagttatttctaatccccttcaccagtgctgccttccacttgatttctcagccctgatggcagctagggggtgtccaagacagagttctagccaatcagacataaacagaaatttggctgggtgccgttgctcacgcctgtaatcccagcactttgggaggccaaggtaggtggat

SEQ ID NO: 176948 - DNA, 291 bp, Homo sapiens
tcatagaccagtgaggtaaaatagaatgtaaagtatgttatgaaggtggcatcactgagaaaaagatggacctttttcaaatgactggataatcgtttgataaaattgtataattttatcatacaacatctccaatcaaggtcactattattcacattttatttaccataaattagttttgcctgttacaaaactcatataaatggaattacgtagtatgtgttcctgtgtctggctatttttgctctcataacaccacaagttcatccatgttgtgtatattagtagttc

SEQ ID NO: 176949 - DNA, 693 bp, Homo sapiens
tagagaacccagaaataaacccaaatacttccagtcaactgatctttgacaaagcaaacaaaaacataaagtggggaaaggacacccttttcaaaaaatggtgctgggataattggctagccacatgtaggagaatgaaactggatccttatctctcatcttatacaaaaatcaactcaagatggattaagggcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacaaaggactaatatccagaatctacaacaaactcaaacaaatcagtaagaaaaaaacaaataatctaatcaaaaagtgagctaaggacatgaatagacaattctcaaaagaagatatacaaatagccaacaaacttatgaaaaaatgttcaacatcactaatgatcagggaaatgcaaattgaaaccataatgcgataccaccttactcctgcaagaatggccataatcaaagaatcaagaaacagtagatgttggcgtgg

SEQ ID NO: 176950 - DNA, 437 bp, Homo sapiens
  misc_feature (87)..(87): n is a, c, g, or t
  misc_feature (95)..(96): n is a, c, g, or t
taatagctgacatagatatttttgagccaggaatattcaagagtgtcttggaaaataggcagcagtaaatagaatgacgaaaattanagagattnnaggcaaagtgatgtgtaggattctggtatgttctagggaagtgtagcttgctctctttggctagacagaggcagagtcactgtgaagctaatgaagattgcacaggccccttccaaagctctgtaactaatgttcaatcacaatgtcgtattattttcctcagagagtctttcagattgcataagcctaagggctggaaaaacctggttctgcccctgggctaacacttggagtaagcttggggaaaaaaacggtgagatgaggctgaagaggtaagcaggtgccagatcacagaaggatttatgatcaaggcaagaggtaaaataggtgctgagataggg

SEQ ID NO: 176951 - DNA, 400 bp, Homo sapiens
cggcgcgctcagtgctcagccccgcgggggtgggcggcatggggcttctggggcccggggggctccctggcttctacacgcagcccaccttcctggaagtgctgtccgacccgcagagcgtccacttgcagccattgggcagagcatcggggccgctggacaccagccagacggccagctcgggtaggtgaggagaggttgcgctgctgcctgactggggggcgacagccgggagccccgcgccgtcggctctcgcttgctggaccaggcctccaggcggaaaagttcctgccaggccgggggtcgccgcctgggccttgggccgacgcgcctggtgatggggcccgggaggatgcttcggcgtccgcagggtttcggccccaagcgtttcgggcggccg

SEQ ID NO: 176952 - DNA, 109 bp, Homo sapiens
ggatgtccgggattactttccacgccccgaggcccgcccctagctgggagcctctagggagcctcaggccccgcctctccgaggcaggcccctcccctgagacccaggc

SEQ ID NO: 176953 - DNA, 496 bp, Homo sapiens
ttgcattccccatgtcggccgacgtggtcgtggtacgtaattctttttgtatgctactagattcggttttctactaaggcaaccactattaattattaaaaactgcacagatgatctgaacattgtacaaaaacttaagcagaattcttctatggaaggctttgttttcaggttaaaataaggcatgttcacaattagtaatacatgaactattatcttctagtaattcttgcccgtatgagcataaagccactacagatattccggaaatgaactcagaccttgacttgcacatagtaataacagaaaaaggcactgcgaatccccaatagccgccttataagaaaggaatctgagtcaaattcttagacatcagtttaaagtctagaagacaaagtaacctttaagaaaaagacctaacatcagccgggcacggtggttcaccaatcccagcactttgggaggccgaggcaggcagatcacaaggtcaggcgtt

SEQ ID NO: 176954 - DNA, 536 bp, Homo sapiens
ttgcattccccatgtcggccgacgtggtcgtggtacgtaattctttttgtatgctactagattcggttttctactaaggcaaccactattaattattaaaaactgcacagatgatctgaacattgtacaaaaacttaagcagaattcttctatggaaggctttgttttcaggttaaaataaggcatgttcacaattagtaatacatgaactattatcttctagtaattcttgcccgtatgagcataaagccactacagatattccggaaatgaactcagaccttgacttgcacatagtaataacagaaaaaggcactgcgaatccccaatagccgccttataagaaaggaatctgagtcaaattcttagacatcagtttaaagtctagaagacaaagtaacctttaagaaaaagacctaacatcagccgggcacggtggttcaccaatcccagcactttgggaggccgagtgaggcaggagaattgcttgaacccgagaggcagaggttgcagtgagccaagatgacgccattgca

SEQ ID NO: 176955 - DNA, 357 bp, Homo sapiens
cactctttcctgacctacagaaattgctgcctttagtgacaaagtaattcgcttcatgttatgaattgtgacactgttgctgtttcaacatatttccacttagacgtgaatacacaccaagaaagaacagttttgaccacatgaacatcatactcttaaaagatttaaacaaattttacaatgttattatgtgctattaaaagacctagtcctacattagagagtcacttcataattaacccaaatgaagtcatcaagcaagaagatgaatgatcttccaagaggctgaagggacaggggcactatatcatgtgaaatctcatgggaaaatctccctgcaaactgaacaccagattc

SEQ ID NO: 176956 - DNA, 340 bp, Homo sapiens
tgcaagctgaaaacaaacaaacaaaaatacatcaaattacacttgggcagtgaattcattttgtaaaaataaatttgaaaagcctaattctttctgttatccatctcagtatgagttaattcggctctgagttttttcttcagctgagtattataagctacctttgaatttagtgctaattaatattcttgaagcttcatttaaaggaagactatatgtcggagaagagagaaagtctctccgtttgctgaccttagagaaatagaacttagaggaaaacctcaaaacgcttgagtgatgttttcctgacagtaactcccacatgttggccaaatatgtg

SEQ ID NO: 176957 - DNA, 199 bp, Homo sapiens
attcagaatgtagtgtggggtctgccaacttgggaaaccatgttacctctctgagactaatttgtgtcatctgtcaactaggcataattataccttccctgtctaccacataagatgactgatccagtgaggtgaagatacaggttagcatatagtataaactttatccttactaatctcttaaaacctggcagacagg

SEQ ID NO: 176958 - DNA, 444 bp, Homo sapiens
agcaagtgactgactctagagaagtagataaagtagtgggagtgtgcattagtgatatggtttggctatgtccccacccaaatctcatcttgaattgcacctcccataattcccagtgtcatgggagggacctagtgggaggcaattgaatcatgggggctggtttttccaatgttgttcttgtggtagtgaataaatctcgtgagatctgatggttttataaaggggagttcccctgcatatgctctctttgcctgccaccatataagacgtgactttgctcctcttttgccttctgccatgattgtgaggcctccccaaccatgtggaactgtgagcccattaaacctctttcctttataaattacccagtcatgggtatgtctttattagcagcatgagaatggacagactaatacaattagttttctattattatttcta

SEQ ID NO: 176959 - DNA, 345 bp, Homo sapiens
gggagaccagatatatcctgatattttaaaataagagaccatttcttatctattacaaacctttatcatgtttgctaggaagtcagctgtcatgcagggaatcccccaagcttgtccaacccaggacggctttgaatgcagcctgacacaaattcataaactttcttaaaacatgatgagatttttttgcaattttttttaaagctcatcagctatcattagtgttagtgtattttatgtgtggcccaaacaatcctcctcttccaatgtggcccagggaagccaaaagattggacacccctgtggctgaaggagtgagccacaggcttgctgttaaccctttcc

SEQ ID NO: 176960 - DNA, 660 bp, Homo sapiens
ttattggccccggttgaactcttcatttcggccagctgtctctcaaattctatgggtcacaagggaaacctggctagaacatttggccagctcaaggcaaatgtgtcactactaacaaagcaaaacatcatgaacagttgaccaatttatgatggttcattggtattttctctgtgttaaagactgcgttttttacagacatactctgttgtcctacccacctatcccagtgacatctcctttggccattctccactcacctgtctacagaatcagagttctagggtgaccccaggtcagctgcggggaccagcacacccaggttcccccatcggcatttgttaccacggaagccaaaccgaaggattcagaagcagagcatgttgcattattttggtttcctgtccttttcatcattaggtccacttaaggggccaatttctgtttgttttgtttaatgattgcttaaggaatcctacaagatatagttgctatttatatgatggttataaactgacaaggcaagagctggtaaaaatagccttgtgcagtgtggattacaaatggggatttctggtgtgcttggatggaggtaagtgacctctggtgctcctgtcacttagctcacccagaagttgatagcaagtaagtaaaaatagg

SEQ ID NO: 176961 - DNA, 332 bp, Homo sapiens
ctctcctgtttctcatctttacttgccattaacatcaatccagatacccaagctatgagctgaaccatctattgctggtttttttaagaccaaaaaattaaatacaattcaacctgatggaaacttctcatcagtatctctgacctatttctctacctgtttccctcatatccaatcagtcaaaaagccttaacaattccaccttcctatgctctcttcttccatcctgtcatttcctttcccacccattatgttctctattcctacaacagatttttcagttttactggtcttccatctctttatacatctataatattatctccagaaac

SEQ ID NO: 176962 - DNA, 382 bp, Homo sapiens
ccctcccttctcccaaggtctctagcaatttccacactgaagaaagcaaaaacagcaacagtgtcccaggggccagaccagaggtaaacggattaaaacaaccacttctcggcctccctgaatgttactgcaacgtctagtgaaatccagtgagcagccgtgaaaatggctttaactagatgggatatcagagttagtgccacctcgtaactccctgcctcactccgccaacaagtaagaaaagcaactgggacgctcggagcactgacagccgctttgtcagtcacgggacacgcatttcaccgtccagcagagggtgtctgctaatgatttccgaaaagttcttcaaaacactccgaagtacagaacaagtctacataca

SEQ ID NO: 176963 - DNA, 342 bp, Homo sapiens
ttctaacacatgttggaaatgtcgatattttttaaacacctgaaatccttctcattaaacataaaaaaaccccaaacaatacaggaaatgttactacatatacaaaactgaagataggaattgcctgtgagtgaagcaatgaagtctgagcacaatatggaaagtggaaatcagaggttgtattttaaaaatctccacttttcttcagatagactggtgattattttacctactgtattttatctatcttaaacagaatgtaaggaacctaaagagaaaggctgtcagcaattgatctgtcctctcaatgaacagtgaatgccagtggttaggtctacatgg

SEQ ID NO: 176964 - DNA, 573 bp, Homo sapiens
acccaccaagacaggagataaaggtagatcgtgcttacgggagtctagtcttgtagttgacgtacccatcttggccacttcctcttctagcatgccagtgccccttctctgctggctctcctgcctccagggtggtgtggagattcagaaccacgttgcacctgggagagtgggtcctggagccgggctgcctgtgtggagagctggctccactggttactcgccacgtgaccttgagccagcttggtgatgatcctgctctcagagttcttgtttgcgtgatagacatgatgaaagcggtgctcattttgcagtttaaatgagatagtacatatgacatgcttaacagagtgcctagcacatactaaacactcaaaaatgttagttatttttatggttgttgttacgttcatttgaactggcctttttatcttctcacttgatttttgtgctattgacgtatatggtcacttttgtggtcattgacgagtcaaggacttacagatgttttcctggttgtgtcctgtggtttccagcagtaggcaggtggaggagagacagctggtgaaagca

SEQ ID NO: 176965 - DNA, 245 bp, Homo sapiens
actgcactccagcctgggcaacagagtgagactccatctcaaaaaaaagaaagaaatagcttctgggtctaggtgacttctctgtcctcctttaccattagttccttattgatcttgcctttaagaatgtacagtcctgtacctgtttgcccgcagatcaagtcctcacccttcccctactctaggctgtaacacaggaaaactaatccctctaggaagtgttttttcaggcttccgtggctact

SEQ ID NO: 176966 - DNA, 186 bp, Homo sapiens
ttagtctcttttttacacgttaggaagaaatacacaaacctcccagtttcattaatgaaaaaatcttaataaatcactttcatggtttatcaccagtaaacacgaacctgcacaaattgtatcaaggagcttattttaaaagcctttgagatacaaaacaaaaaccttatttctcagactataatt

SEQ ID NO: 176967 - DNA, 528 bp, Homo sapiens
ttcagagtcctagaacaatggtgcccaatataacatgagccacatgtataatttaaaatatttttataataacattgaaaatgtataaagaaataggtagaattttaataaaacaatttagtgatttctgccaataattaatataaaattatttctttctgtaccagatttgatgtatattttacacttaacagcacatgtcaatttggaccagacacttggcaagcgctcggcagccacacacatactggacggtgcagctctccaaggtctcacatgtgttttaaacactcctttgtaaatgcagtcacaaagtttcagagttctagaagcggtctggaatgtagaaaatgtttctcaatgattccgcagtcacaaagttcttatgcaatcctctctctgtatctgaggaaagggggattggttccaggatcccccatagataccaaattctgcggatgctcaactcctttgtataaaatggcatagtagctgggtgcggtggctcacgcctgtaatcctagcact

SEQ ID NO: 176968 - DNA, 360 bp, Homo sapiens
ctggaaaggagaagcaccaagaacatctcctggtgcagtgggaagttaacagacatttttagtgtgctcttgttgctgagaaacatggcataggaaaagccacgaacaaagatgaaaaacacaacttgaagtttatctgtttcacgtcctgtagtttgtctgtttgttttaaaagaaagtagctgaaataataagggtagggtaaaataagtaaacagtgaaagcctgggatgacaataacgaacagatcattgtacctagtttctgtgcatgttgctagaggtgggctttggattaagctttaaaatttctagaggcaaaggcaaatagaaatattagttaaataattaatgattgtta

SEQ ID NO: 176969 - DNA, 168 bp, Homo sapiens
acaaaataccaccactggatattcctaataaaatacttttaagaggcaaggtaccacgtgaccacatacataatttcgaacatttttgtcaaaataacaaatatgagattggctggctgatcctaattgtgctgaacaaagtagagaaaggatgagctcagagatctg

SEQ ID NO: 176970 - DNA, 344 bp, Homo sapiens
tgagcagaagtgacaggaaagaagcacagggaagcatcatgagacacagcccacgagaaggttaaatacactggaattttatgcatgtgagattctcagacagcatttggctgtgtgaccttgggcaggttgcttgacctctctggtgcctcagttccttcatctttaaaaggagagggctcaattttaaaaaaattatgggccacgtggtggctcacacctgtaatgccagcactttgggaggttgaggcaggcagatcactaggtcaggagatcgagaccatcctggctaacacagtgaaaccccgtctctactaaaagtacaaaaaattagctgggcatgg

SEQ ID NO: 176971 - DNA, 302 bp, Homo sapiens
cacaaatttagagaaaagagcaactccattacccccagactgcctcacagttaagtacatgtcttcatcctgctggtttagatgagatttctcaataatacatctctttgaaaaaaagctttctttctcttcaattccatagctgttcttagaagagaaataggaaaattcaccaacatcaggtatcatttcaattgatactcagcactcagacaccatgtgaagtaggttttgcaacctgaattgagatggaaatggtcattacgttgccaaggaatctttgctgtccattggcaatacag

SEQ ID NO: 176972 - DNA, 459 bp, Homo sapiens
gacctaaacaagtggagagatatcaaactatgttcatagactaagacttgatatgattaagatgtaaattcctaatgtcagattgagctatatattcaacacaatcccaatctcactacagatgtgctttttgtagaaactgaaaagctagttttaaaatgtacataaaaatacaaaagacctataaagtcaatagtgatcttgaaaaggaaaaacaacattgggaggaattacactttctgatttcaagacttataataatctacagtttgtattggtataaggatagacataaagactgacagaacagaatacaaagcccagaaacagaccttgcatgcatgtccaactgagtttccacaaagataacaaagtaatcaaacggggaaaggctagacttttcaacaaatggttttccaacaactggatctctataagaaaaaaaaatgcctcaaccct

SEQ ID NO: 176973 - DNA, 154 bp, Homo sapiens
ggaactccacccccggtcccagttcaagcatttctcctccctcagcctcatgagtagccgggattacagacagaaaccacaccaagtaattgaacagagagactttaatgttaaccagggctgggtgtggtggctcatgcctataatctcagca

SEQ ID NO: 176974 - DNA, 1027 bp, Homo sapiens
ccaggctagtcttgaactcctgagctcaagcgagacacccaccttgacctcccaaagtgttgggattacagacattagccaccacgcctggcctgtaaacaggaataactttcttgctgtgtgattcaatgttatttactgctttgttcatgtactgcctatgttgattatcaccagtggtatggatcctgcacattgggaaacactgcagtgttatttaattttgttcactgtgtttacagtgcagttttagtcacctgaaattctaagagaaaagatcaatatggttttgccaatcaaaggtcattaatacttggaatgaaagataacttctcctggtgatgaacacatgccttttgaaaagcatcagtatctccttaaaatgtataaactactgtaatcaatgaggaagactttttcttatcagatttattaaactcatttaccatacaaatagcattataacattaaagaaaattttttaaaaattctgtaccataaaacaattactggttccttcctacctgtttttaggtttgcagatgaataatgtgtggatttttggcagacacactgctgaaaatttttcactttgttgggtgagcatctcaccctatctccatttgtctccctgctcgtgagttctagagaagaccaccaataagcaagtgaaattctttggccaagtcactgatatcagaattccccagaggcaccaagaactttgatttccagaaattgtttaggcacagccactcattcaaccttatattttgtatctcagagttaaggttgcatttgggctacctagcctgtagactctattttaagacaagcaggcatttaatagttgtcggttggttgattagagcttctagccaatttttaaacaattatttgaatagataaggcattcactggttcaaaaaaaattttttaatcatcacttccacccatccagttatcactactgaagtaacctctactttttgtttcttgcatattctttctttcttttttttttttt

SEQ ID NO: 176975 - DNA, 391 bp, Homo sapiens
atccatccaccatccatccatccatcattcatccaccatccatccacatcttgactgaaggtctgttgtagacccagtcttgtgtatgaagtaagagagtggcagaagacacactgtcctgccctctttttcatttttttgtccatctagctggaaagagatggcaaacacccacgaaaagacaacatacaagttcccttgtgatcaggtgccccaaagcttggtcaaaggaaacactgtatagaaatttccaggacagggagatcagagtggtctggggtggtcagggagggctatgtggaagatggggcactagagctagcccttgaaagatgaagactgtttaaaaagagcagaagcaggaaggagatttggggtggaagggatggtg

SEQ ID NO: 176976 - DNA, 296 bp, Homo sapiens
agaatgatatttagaaaccaagatctgagcattaagggtactcagtgaccttgcttctaggcctcactcagctcactcagcatatagcagatggaactaggaagggagaaagagaaagagagagagagagagagtgtgtgtgtgtgtgtgtagctgtttgatgcatgagtttgtgtcacagcttcttttttttttttttttttttgagatggagtcttactctgtcacttaggctggagtgcagtggcgcaatcttgcctcactgcaacttccacctcctgggtccaagcgattct

SEQ ID NO: 176977 - DNA, 594 bp, Homo sapiens
acctagaggataccctcgaatcgacggtttctcgaagcatgataaagtctgaattgaggccgggcccggtggctcacgcctggaatcccagcactttgggaggctgaaggggggcggatcacttgaggccaagagtgcaaggccagcctggccaacatggcgaaaccccgtctctactaaaaatacaaaaaattaggccaggtgagatggctcatgcctgtaatcccagcactttgggagtggaggcaggaggatcgcttgaggccaggagttcaagaccagcctgggcaaaatggcaagactgcctctacaaaaaaaaataataataaaactggtcgggtgtggtggcgcaagcctgtagtcccagctagttggggatatcccttgagtccagtagttcgagactgcagtgaactgtgatcgcaccattacacttcagcctgggccacagagcgagatcccgtctctaaaaaagttatgataaataaaaataacttctaaaaatgtttttcatgtcagaagctcaaaaatcagtttcatcttatatgttgtttaaagggaagaaattggcttatgtcatttctgttctgaaat

SEQ ID NO: 176978 - DNA, 520 bp, Homo sapiens
ccttagagatacctcaataatgcgttcagcaccgtatttagagtatgggctatataagtgcctgacaccaggataggtgttggggacacgaagatgatcaaagtaagctttctgctgcctccaatcttatcagaaagacagctaactccaaaacaatgtgatctgtgctattagagttgcccttgtttgccccggactctcctagttttagcactgaaagtctcacattctgggcaacttcttcattcctgcctggactgggacagctggtccaccttaactgtcctagaggaatgtgtgtgggcaggggtgaatttgtatggggtggtgggggattgtgcagaagagattagcaaaatcttcacaaaggagcttatgtcttgtgtgtagaatgattaggaggagttctttaagcaaaaaatggagaggagagggttaaggaagagcattcctggtggaagaaccagggagcagtttaggcaaaggctcggatggaaggagtttagtaaagttaagagtc

SEQ ID NO: 176979 - DNA, 637 bp, Homo sapiens
cagctgggattacaggcatgctccaccatgcccatctgatttttgtatttttagtagaaacagtgtttcttcatgttggccagactggttctcaaactcctgacctcaggcgatccacccgcttcggcctcccacagttgtgagccacagcacctggcctattcactgatgttttatcctcaactcctaaacagagtagatgcttaaataatattcaaatgaatgaaagaaggaacaaagcaagttactaagaaaactgccaaggcctagtgcagtttgacactcagagcccagtaggacccattgagtagttttccgatgttggaaataacaccagtggatctgggctcgatcctccttagtcgcatgcgtgtgtgttttcttcttttgtatcagccaggataatgcagggtgtgttccaggcctctgtgattaaggtttcagtaacactctgatgtcattttacaaaacaaaactacctttgatggaaacagcttattgtgtctttagcttttgttgtttttattatttacatctcttgactttgttttttggtcaaatatgccagagacatgaaaccatatacctcaacaaagtcctgtaagttagatactcagctttgtttacacttcaggta

SEQ ID NO: 176980 - DNA, 559 bp, Homo sapiens
ctggtgttaagttgccccaaatacccagtctcctgtttcacatccttaggcaaagatcccatggccaaggtgccctttcggcttagctttcccaccggctgcttgcagacagataagcttctaacagtagggaagggggaaggtcggaggtgggcagaatgctgagcagacccctttgtctgcaggcatagtgggctctgcagctccccagtatcgtgttggatggggcaggccctgggtggtgaccagctgcctgtccccaatcctccacttctttagtggcaggtggaacatggcttggctggggcacaatcgtacatatgctccggctttaccttggggtggaaattggaggctgaaagtttgtaagtgttgagaggcaagcaaactctgtgtttgtgtgagctggagaatgcaggggctgcctgagccaggctctgtctctgcagagtctgccctggctgtgccagactccctgtccagacctctcagagatgtttcattccttgggctgggttgaactgagacatagccctgccgcgagacaggagggagaagg

SEQ ID NO: 176981 - DNA, 127 bp, Homo sapiens
aagggaattcagactgggaaagccaatgagctgtgtttattggtactgattagttagaggctttaagaaatacttggaggcaagagagagatgctggaggttctaagctggcctgagtgtaattggt

SEQ ID NO: 176982 - DNA, 532 bp, Homo sapiens
aatcacgggttgtgtgtgaattgggggctttctttgtgaccacagcctccatggatctaattagaggttttctcatgcctccttgaaagagaaagggtaactgtcaaacgtgtgagtcattgtgaggcaggagaattgggaattagggtaaccaagggttaaggcagaagcaaaagaacagcaggtgcagccagttctaggcaacattaagcagcatacagcatacatcctagctcctgagataacaagacagaagtttccacttcagcctctaattgaccatgagccaagtctccacttcagccactgattggtcacaggccaatccttcatagggtgtgaccaactggaggcctctaaagggcacctaggggtgttaccaaactaaataaaaattaataaatatcttaataaaaatcttaatgggaggggaagctcttgaaccacttgctggagcccgctcctacaagagctcctacaggctcctactctgtgaaaagtacttttgctttaataaatctgtgcttttgtt

SEQ ID NO: 176983 - DNA, 428 bp, Homo sapiens
cttcctagctatcaaattttaaccaactcaaaaaatgtcagccttctattttctgctttctatatataatctgtacttcaccaaagtaatgataataatagctaccatttataaaacacttcctacacagcaaacgctactctagaacacattttatgttttgttcaattctcacaacaacctataagagttactatttacattcttcacacgagtaaagagcagcacaggaggtcaactgcccaagtgataaagttggtaagcactgaaggcagaactccacccaggcagtgtgaccggcaaaccgaagcacttacgcactctactatactgacttcctcagcaactactcactttatgggaataactggttatttagataagcaatactatacagaactgcagaaaaagttcatgtttatctgtat

SEQ ID NO: 176984 - DNA, 625 bp, Homo sapiens
gtggagaacacatcagcttcaaaggcagagagaatcgaaggtgctctccagctttggacacttcctctgcttgaggacaccttgactaacctccaagggcaactaaaggatcaagaaaggcccagcacagcagaagatcagctggatctagctcctgcaggagatgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaagtaagtaaaaagaagagcattttgcctcttataagaagctcaaaggaacacaccacccacacaaacaaaacaccaacacaacactttgggggcggcctcggcgcccggaaaaatttttaaaacccttctggtggggcgcgggggccccatggggtcacgccaacctggggccaaaggcgggccccagggacacccggggccacgaccaaggcgcggc

SEQ ID NO: 176985 - DNA, 408 bp, Homo sapiens
tgaggtaactctccggatctttgaatcacagcagattcacagagactccagcacagtcatgtggtggaagaagatttgtagacaaaagggaagtggcataccgaaatcggaagtgaggtacagaaacaactcagcgtttgccttgtttgagcacagtttgaacatttggcagtgcctgagtggttgaagtttggccattgggattgaccaagatgtagctgttgtttgaggtgcatacactcaagttaggttttcattcttgtttacctattaaggtaggttgcaggtcatccacaaggactcatatatataattatggagtccttctcaggacatacttagttcactttaacaatgccttccctttggttattttctcaattttgagagattggccaaaacttcagt

SEQ ID NO: 176986 - DNA, 458 bp, Homo sapiens
tccacattaaaggcatgtgcatgcagatggattgaggagagggtattactatagcatttggaaactttccattttatcttaactcatctaattcctctttctcttgttatttaacttggggtttctcagcctcatcactaatggcattttggcccaaatattttgtttgtttgtttgttcgtttggggtaagagcctgttctgttcatcacagaatatttctcagcattcctgacctctactcatttaattccagtagcactacgttcccctatccacactgttgtgactaccaaaaatggctctagagcagccaaattgatcccagttgagaacacttttaactcattggcttcttattcagtaaggctttctttgaaaatccagtgcagtgtaggcactagattagtcatgtggataaatgaaatggattcatcttgaggataatagggccttcct

SEQ ID NO: 176987 - DNA, 725 bp, Homo sapiens
ggctggagtaagtgacatgatctcggctcactgcaacctccacctcccaggttcaagggattctcatgcctcagcctcccaagtagctgggattacaggtgcctgccaccacacctggcttatttttgtatagtagagacagggtttcactgtgttggccagggtggtctgaaactcctgacctcaagtgatcccccagcctcggcctcccaaagtactgggattacaggcctgagccacggcgcagggccaggccggtgttcttggagccttgtctctgctggggatgtgtctccagggatggattctcgggaagcaagtgtgtgccctgcagcccccaggcacctctcctggactaggaggcccctgatcgcccactgctctccctcacagcaggcctctgctgttgctgtgtgctctgcctggaccaccctcccgctgggtacacatggaaaagcctcttcatccttgggccctctctgctgtgccgcctcctcctctaggaagccctcctagctccccagggaggctctgcccctcctcagttccagccctgactgcctggggctgggaagggctccatgaagttcaaggtaaactcaggaagggtccccacagcccctcagggagcctgctgggaccgatgtccagacggggccctcttgtgtgtgggtggagtgacgtcagcctccaaactagtatgttatgggcggggctcgctgggc

SEQ ID NO: 176988 - DNA, 330 bp, Homo sapiens
acagggactcaattctttttggtgtaaatgtcactcctgctagctctttgtataaagaattaattcccagagtcatatttccttctaatggaaagattactctactgattgctaggaaaacagggtaatggaaggcactcaattaaaccaagccgtttccaaatgcaatgtatgttttatgattggcttgtgataggcgatgcttcatgtgtctacttggtgtttccctttgagctttgaacttatgtcaaactttgttttcattgttctgttggcctagtgttttccattgtcagcctgtaattcctgctcagttgcagagggaattat

SEQ ID NO: 176989 - DNA, 419 bp, Homo sapiens
atactccactgttgggattttactggcattttgttgttgttgttcaagtgaacatttattgagcccctcacatcctgcttgccctgggctctatcacagcagagatcagtaggtccccagcctctgtcttctgagagtgtaatcaagtagagggagatgtgggtacagatatggtttaaaaaggagtcccacatcatgggttctgtggtggaggtgtgagcagtgggcagagatcagagccagaggagagagtggccagagcgtgctggagggggagggtcagctgtcggggaaaggagcctgccgcctcacctcatgggctagagtggggtggatagacaggtcacaattcagaagcacagcagcacgtgagggatgagtgcgcatgccttctgcatcctcatcttcacgcctagtat

SEQ ID NO: 176990 - DNA, 588 bp, Homo sapiens
atactccactgttgggattttactggcattttgttgttgttgttcaagtgaacatttattgagcccctcacatcctgcttgccctgggctctatcacagcagagatcagtaggtccccagcctctgtcttctgagagtgtaatcaagtagagggagatgtgggtacagatatggtttaaaaaggagtcccacatcatgggttctgtggtggaggtgtgagcagtgggcagagatcagagccagaggagagagtcaccacgtgatagcagaaatacctttagccttggaagttctgaggattgctctgaaccagccacctgccttcatggtgagagataaaggaactgctatctgggagccctgagaggtatacactgtgtaggaggagctgacaaatgaggtagtactaagaagacggttcgagcctagtcggaaattcaggtacgtctaggccatccagaaatcgtgaacaagtgattcttctatctaacttggtacgttgaatgtccttgtgggcttaacactgatattcccgggcatccaaagtatccagtaggaaggaagagctcgtgaaaccattctgtgaca

SEQ ID NO: 176991 - DNA, 533 bp, Homo sapiens
ctcacacagctttttcagggagtaagtatgtgaggtggatagtgttactgaggctatggaggtaacacatgaggcttagtgcacctggcgtgtgattagatactcagctaatccgtccttgatttctgcaaggtcagaaataggctttagtgtataggatggtttagaattttaagtgcaaaatggctctttctctggagaccatatcgccaagtaatgctgatacgtagacactttggacttcaggtgtccacatttatgggttgaagaaggcagcggttgtgttacatggaaagggtgggtataagtaagacagttttcttgtggagtgcttgattctggtctaggattgaaacagttgctcctgtgtctgacatgtgtgtctacacgatgatctcagcagtgggcatggaaggtggtattgagggtgtttctttctttttttggcaagattttgaaaaagaaatggagggattttcttaaggcactttaatgaagggaattgggtgaagggaattcaaattgtaattgtc

SEQ ID NO: 176992 - DNA, 523 bp, Homo sapiens
ggagttaatggttacatgccaagcaaggtagatttttttcctaggaagtgacatctcaggtggattttataggacagatgtaagtttccaacactggtaggtggtcggtggggtggaaggcagtgtatagcaaactgagaaaactgcgttatctaaagcacaaggggaccaagcacagtggctcacgcttgtattaataatctcaatatgttaggagcctaggcaggagggtctcttgaagccagctctggcaacaaagccagactccctggctctacaaaaaattttaaacttagccaggcgtggaggggagtgcctcttgtctcagctactcgggaggttgaggcgggaggatcatttgagtccaggagttcaaggctgcagtgagctatgaatgagccattgcactccagcttgggcaatagaggccttgtctcaaaattagtaatactaaaacacaaaggtatgaaaccagagctaacaggagcgccacacgttttaacaacaataaactacgtaaagg

SEQ ID NO: 176993 - DNA, 263 bp, Homo sapiens
tgaatttgagtaaaacgttcagtaagcccagcatataaagtgcaagagaatcaagaaatagtaaaaataatggaaatattaaatacttgtcacttgtcaagaccactataaactttaacttacttctctaggctaggtaattacccatttgcatttgttcagcaccatgtggttttcaaagcactcacatatgccaacacattggatccctacaacttagaggctttcggacagaacacaaaagtaggcccatggccgggcgc

SEQ ID NO: 176994 - DNA, 615 bp, Homo sapiens
ttctcaggagtgtatgtagctgacgggtgaggtgcggctgggcagtgactccctagtgcttcctgcttatttccgttttatttgaagccaaggaggagtttgtttttgatgtgagtcatatgcccaggacactaattccaatccattctcttatcacctccctgaccagttcctaatcagaatctgtacctcatggaggttacagggatccaaggtcatgataactgaggcttgtactgcatctggactcagaacagagcaaatgtgtgcctggtctaagtacttccgtaaaatacccagtgtcttggtgtccttctgcagcacagtctctgtcgtctttgacataagtatcgagattatacacacatcactgataagggataaaaggcaccctggaaatccgtaaataaaggactagcagtcacggcagtgcactgcattgagtctggtttggttgggtctgaaactgtacctgaaatggtttctttaagtatcttgctttctctatttctcgatgtttaataaaggaagggacacggacatgtagagaaggctaaaataagaaatgctgtgtgaggccatttttccccacacaaaccaagaaagaaataaaga

SEQ ID NO: 176995 - DNA, 724 bp, Homo sapiens
  misc_feature (259)..(259): n is a, c, g, or t
  misc_feature (295)..(296): n is a, c, g, or t
  misc_feature (568)..(568): n is a, c, g, or t
ctccagcccgtttgaacgctccccgcagccaccgccacccattggaatggccaacaggggacctgcattatggcctgagccaggaggtgcagcagaagattgagaaacagtatgatgcagatctggagcagatcctgatccagtggatcaccacccagtgccgaaaggaatgtagaggccaggccctcaagccctgtgactgcagcagaacgttcgcagaaagcatggctttcaataggtaatgtgcgacggagtgtcntattgcatgatgctctacttaattgtcgacctggtnnaccccgcagggcgccagtgcccgccagctacacagacacgatccgaaggccatccgagccatggggccttacaatggcgagcatgtgacgacagaatcttctcgagattcgctggcacagcatgcttgatgcggctctatgacgcatttaactacccacgtgactatcgttccagaacctgtgcgacctcgtgggcaaggacgagacacatggctctagtgtgcaggcggtacgtctgatgaactctggcgtgggctggcagttagcccgangatgatgcggctcgttctctggggatcccaactggttccctaagaaatccaaggagaatcctcggaacttctcggataaccagctgcaagagggcaagaacgtgatcgggctacagatggggggcatctcaggcaggcatgactggctactggatg

SEQ ID NO: 176996 - DNA, 256 bp, Homo sapiens
agagcctaactataaaagccaaaactataaaagtcttatgagaaaacaggttaaatcttggtaaacttggatttggcaatgaatttttagatatgagcaaaaagtacaagcaatgaaaaaaataaattagactttacaaacttttgtgcttcataggtcactatcaagaaagcaaaaagacaatccacagaatgggggttaggtccataccgtggggggatctccttcaaaagttcgaccgtgcaggcattgcaag

SEQ ID NO: 176997 - DNA, 162 bp, Homo sapiens
  misc_feature (7)..(7): n is a, c, g, or t
agccagnctttctgtgggtcctctttccccaaccaccttgagattaaggatagagtctaccttatctttctttcagtgcctacctcagatcattcttcacagaaaatgagacacagaagtctgggaaaacttctattccaacttctgcatttatgtatcaga

SEQ ID NO: 176998 - DNA, 327 bp, Homo sapiens
  misc_feature (28)..(28): n is a, c, g, or t
ctccgccggttgaaagcgcgtgtttgcntcgggttctgttggagtgcgttcggtgtgccgtgggtccgcgctgcttccacccaacttcctgttgactggacctcactgtgggaacaacaagatcaacaagaggagcaagaacaacatcaagagtcagggcccgggggtcctgacgggtacaggatgggtacagacccacacaggaatcccagagtgtgttccacagcaggacacgcctgcgctgaaagagtggacagaaaggagctgacctggcaggacatggagaggaaaacagtcactctcccgtggggagacctggcaggcctc

SEQ ID NO: 176999 - DNA, 1097 bp, Homo sapiens
  misc_feature (28)..(28): n is a, c, g, or t
  misc_feature (1005)..(1005): n is a, c, g, or t
  misc_feature (1036)..(1036): n is a, c, g, or t
  misc_feature (1039)..(1039): n is a, c, g, or t
  misc_feature (1062)..(1062): n is a, c, g, or t
ctccgccggttgaaagcgcgtgtttgcntcgggttctgttggagtgcgttcggtgtgccgtgggtccgcgctgcttccacccaacttcctgttagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcctctgctgccccctgccccatacacgtgatggagcagaaaacgtgctgtgtgaacctgtgacttcagggcctgttgacgtggtcgtgcttgcatactctctggactggacctcactgtgggaacaacaagatcaacaagaggagcaagaacaacatcaagagtcagggcccgggggtcctgacgggtacaggatgggtacagacccacacaggaatcccagagtgtgttccacagcaggacacgcctgcgctgaaagagtggacagaaaggagctgacctgggattatgatccaaacacagctgggcctcccctccctgccccaggattgtggagtgagaacgttgcagcaggagagaacaacgcagcaaagcacagcaggggaaccggaaatgctcaccttttgacagggtacttttagttctggggccttatcttaaggatattccaacatatacaaaaagattcatgcacagagatatttactttagtattatttaccataggaaaaaagttggaaacaatacatttgatgttctgtaaaatgaaagaacagctaaataaatcatggctctaagacgactccagggctgtgtacggaagttcagggacagaatcaggtgaagctgttccacctgagcctaagcttcctctgctgtatgtcgggaatcaagtgggggccaagcgagatcaccacagtgcaggccagtgtgcaggcacaggtgggcgccagggagggacnccgtacatccccatgctctctccaaaaacgngcngcacaatttggaagaaacatttncttggttataaagagcaacggctctggcctaattg

SEQ ID NO: 177000 - DNA, 345 bp, Homo sapiens
ggaggtgtagatttgggagttgtgagcatacacgtgacatctaatgccttgaacctggatgtcataacccagggagtgagggcaggtgacgagggctgacctgtggtgtatccctacctaaaggggtcagtctgatgagaaggaaccagcagaaaagagaagaagggatcagtaggtaggaagaaaacgtagagtatagcttcgggaagccacgaggaaaggggatctcaagaagggaagggagttattaccagtgtcacctctgctgtgttaggcttagtaacatggaggtcagcatttcccttgatgagagtttttggggccaacgtctacctgggtttgaga

SEQ ID NO: 177001 - DNA, 831 bp, Homo sapiens
agggactctggcgataaagctgccagagtctgcggtggaggcagccgcggcgagcaaggagctggacaaggaacaatgcaaagatggcttttcagagcagccaatcgggatcttgaaactattaaggcctaaaatcattagcactgttttctccctctaagacatatgtggcttttcactttattttcagctgaatgcttttgctgttttgggtttagcaagcttttggtcttaaaaatatccaacaatgcagttaagaggccagatgactttatgcatgaaacattgttaagatgaggaattttcccatagaaaggtgaccagatttgaggaaattatttagtcagtataaacttttctctggatgtaaacagtacagattttactttcaggctttcctaataaagtttctaacagacctggaaaggagaaggaagagtaacatctgttgcaaaaccccagttacgtgtaggacaaataagaatctgggagagaggtgacttgcccaagtgacacaccgatttgggatatattagggagaaccattaattcttgtccataaggcttgatttagaattgttttttattttaatggaagttctgtagaaagaaaggaatacttggaaaaattgagccacttgtaaatacttggaagatgagaaaagagaatggtttaaaatcttcttaccatatccctattctcctcctcttcctcctcatcatcagaatcacagtcagtcagtcaaggttggcactttattagtgtgaacaaggtcagtatgaaaacacaaagtatagggaagttgtgacacccaatgtgtacaatttcta

SEQ ID NO: 177002 - DNA, 537 bp, Homo sapiens
cagtacggatgtgcgggccagtaggttattgccttgaatcaggaaagagtatatgttttactaagtttggtatctctcttgccggccacagtgcttttcccctatagaaagagattaataagcacttgtatgttaaatcagcaggaaaccaggcagaagagatgtgtcttgtgagcctacaaaaagccctaggtgcaccatgccatgtaaacctgataaataggaagctgtgtaatatcttagtgtcagcaaactctaacaccagtgtcagtgggacagatcatgtgtgtgtcaagcaagaagatggtgtggcatataaggttgatatgtatatgatgataccaataagcaaatgatgaaacaaacaaaggccttccttctcaagatttggtgtgtgaactaggagtatttttttttcccgagactgagcctcccactgtctgttgcccaggctagagtgcagtggcatgatcttggctcactgcaacctccgccttccaggttcaagcaattttcctgtctcagcctcccaagtag

SEQ ID NO: 177003 - DNA, 455 bp, Homo sapiens
agatcacttaaatgccattttgccctgtgatgaaacatgtcactaactctacatttgagctgtttccatgtttacttgtttattgagttatttacgtgtttatgaagagtggtaattgtaaattgagagcacaatcccacaaaaggtattggagagccctaggtgcaccatgccatgtaaacctgataaataggaagctgtgtaatatcttagtgtcagcaaactctaacaccagtgtcagtgggacagatcatgtgtgtgtcaagcaagaagatggtgtggcatataaggttgatatgtatatgatgataccaataagcaaatgatgaaacaaacaaaggccttccttctcaagatttggtgtgtgaactaggagtatttttttttcccgagactgagcctcccacttgcactccagcctgggtaacagagtgagactccgtctcaaaaaaaaa

SEQ ID NO: 177004 - DNA, 837 bp, Homo sapiens
aaaatgcctctgtgccacagcttccagtcagctctgtgtacgtgtgcctgtccccctgctctgacccttaggtggatttaggaggagccctggttggacaaggtaaagggacctggactgttctttgaaccgtgaaaagccctggctcccctcctgaagtagttagggaaaggcatgatcctttgctgggctagggagaggggattcctgtgatgggttgtggtgtcccagaagagatgagtcctggatggaagtaacagatgaatggagttttaaagagctagattctttttcatgcagatgagagcagagagtttctacaacaagaagaggaggatatgctgacacaggcggttgatctgccaaagcaactagttggaggatagagggaggggaagggtggaggccccagaagaggaggctcagcttaacaagttggacctggctggggatccaagcaaggtcaggattccagagtccatgaggagaagcttcaacttgaacctgctaaaacctgatagaaaaccagtgaccaggggggtgagggatatgcctcaggcttggacagggcagggagcaaaggtgaaccagcaagacagagcagagggtccagtgacctcggctagctttctaggtggccaaagaaaatagtcagtcattggctgggcatggtggctgatgcctgtaatcccagcactttgggaggccaaggtgggcggatcacttgaggtcaggggctcaagaccagccaggccaactgagtgaaacctgtctctactaaaaatgcaaaaattagccgggtgtggtggcagacgcttgtaatcccagctactcggg

SEQ ID NO: 177005 - DNA, 635 bp, Homo sapiens
aaaaggctgcaggtagaatatagaggatcgcccacggactgactggtgcaagtgaccgatgaatggagttttaaagagctagattctttttcatgcagatgagagcagagagtttctacaacaagaagaggaggatatgctgacacaggcggttgatctgccaaagcaactagttggaggatagagggaggggaagggtggaggccccagaagaggaggctcagcttaacaagttggacctggctggggatccaagcaaggtcaggattccagagtccatgaggagaagcttcaacttgaacctgctaaaacctgatagaaaaccagtgaccaggggggtgagggatatgcctcaggcttggacagggcagggagcaaaggtgaaccagcaagacagagcagagggtccagtgacctcggctagctttctaggtggccaaagaaaatagtcagtcattggctgggcatggtggctgatgcctgtaatcccagcactttgggaggccaaggtgggcggatcacttgaggtcaggggctcaagaccagccaggccaactgagtgaaacctgtctctactaaaaatgcaaaaattagccgggtgtggtggcagacgcttgtaatcccagctactcggg

SEQ ID NO: 177006 - DNA, 252 bp, Homo sapiens
ctccccagcatacctgaccagtgctggtccccgggcaaggacctggaagtgggcacagccctagggcagaggggttgggtcggggcaggggcagcagagacagccactcacaacaggatctgagggggccaggcagccacagggcctgcaccaggaccactgtgtgcacccttggaggtgactgagcctccatgcctgggtctagtgctgccatggacgtggggagcctcctcgccagagttcctgggccct

SEQ ID NO: 177007 - DNA, 474 bp, Homo sapiens
cggccccccccctcgttgcctgctgttcttgatgtatccctggtatgcagacaaggatgcccccaacctcaatgactgagcatggaggaatacaagacccctcaattgtaatctatgttccagagtaaactattgggctgatcaagtctttctcagaactctatcacagttggggctctcactacccagtcctttgatctgcccccattcctttcataagcctcatttcagtatcagctctcaagtccttccctacatactctttttccttctccactttatctttcataggcattacctctattaaacctcttgtacatctaaattcatcttggcatctacttcccagaggacatgaattatacatctgtcagttgcttctgactaccttcagccaatgagatatactgtatggggcttgcagggaggaaccaagagtgacactggggaacaatttctctctctgctacagga

SEQ ID NO: 177008 - DNA, 642 bp, Homo sapiens
agtgggggaaatattttagtctctgtctcaataaccccttgcactgggctttaggggttaaagatgcatccagggtgacagcacgtaggttcttgcacagcacaggctgaggactatacatctgcctgggatggaaggagtgtttctttgtgggtttctacttctgcaatctcctagtccaccttaaaattccaaatcagaatagcagcaaaagagcaaggcttaatgcacactgcagtaacactgaccagcttaatcaggaccatttgtctcctacatggggatctggacattctgagaatgaattacacagtggcctcaattcccttctgccttaaggcccggtggttttgcactgatttctcaaccgaaagagatcatcatcagctttctgagggtggaagtgtttcaaacagagaaccaactgcctctgcccatcaaggtcactttcctgcctttacctatctgtcttcttacctcgaaatgctttaagaacaatttgttggtcacaacaaactctgaggcagcgaagggcagggaaagagagggcattcagaatcaaaggcctaagatttgagccctggtgtctccacaaactgcttgtgtaagctgggcatacttcacctctctgacccattcccc

SEQ ID NO: 177009 - DNA, 330 bp, Homo sapiens
gaagtatggtgctggcatctgctcagcttctagggaagcatcaggaagtttgccatcatggtggaaggtaaaggaggagtaggcacaagcaggagcaagaggggtcaggaggtgccacaccttttaaatgaccagatcttgtgagaactcactatcacaaagaccgtaccaagccgtgagggatccgcccccaagatcaaatcctcccaccaggccccacctccagcattggggattacatttcaacatgagatttggatggggacaaatatccaaactatatcatgggatctggggagataaagaggaggaaaacactgttcttgcttg

SEQ ID NO: 177010 - DNA, 1713 bp, Homo sapiens
cccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaaggaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataaaacttttgtttgtattaa

SEQ ID NO: 177011 - DNA, 1682 bp, Homo sapiens
cccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaaggaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataaaacttttgtttgtattaa

SEQ ID NO: 177012 - DNA, 1481 bp, Homo sapiens
cccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataaaacttttgtttgtattaa

SEQ ID NO: 177013 - DNA, 1607 bp, Homo sapiens
cccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaaggaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataaaacttttgtttgtattaa

SEQ ID NO: 177014 - DNA, 1739 bp, Homo sapiens
cccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaagacgatgagagcagcaaagcaaagattgggaatgacaccattgtcttcaccttgtataaaaaagaagcggccatgtgggagaccctttctgtgacgggtgtgagccccagactacctaaagagttttaaagaatcaggttcctgttttttgacctcttacttcctctgtgactcattgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaaggaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataaaacttttgtttgtattaa

SEQ ID NO: 177015 - DNA, 1495 bp, Homo sapiens
cccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaaggaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggaattctgttctcttgagggcattgaatgtcaggcctctgagcccaagctaagccatcatatccctagtgacctgcacgtatacatccagatggcctgaagcaagtgaagaatcacaaaagaagtgaaaatggccggttcctgccttaactgatgacattaccttgtgaaattccttctcctggctcagaacctcccccactgagcaccttgtgacccctgcccctgcccgccacagaataaccccctttgactgtaattttccattacctacccaaatcctataaaacggccccacccctatctcccttcgctgactgtcttttcggactcagcccgcctccacccaggtgattaaaaagctttattgctcacacaa

SEQ ID NO: 177016 - DNA, 270 bp, Homo sapiens
accaacaaaatctgtctccaagcccaactcctccagcttggtgaagaactgatattacaggaataactactggtctgcaggcacgtattctgtgctaggaacttaacacacacaatcccactggctcctcccaacaaccccatcagctttcaccaaggcacgatgaggcttagagaagtaaggtaacttgcgagagtcacatgcctatggatggctggaccagggtttgaatctggattgtctgatttctaaatccttgcttttcacctt

SEQ ID NO: 177017 - DNA, 349 bp, Homo sapiens
aggccgcctcccaggaaaaagcagaacaccggaaaagaccttgtgaagacttcttatcttcccctccaaatggtgtctcttgctttggctcttgtcgagttggggcttgttggaagaccaggtgaaggcccagctgctaaagcttcccctttctacttcttgttactctattactcaattaggactggtgctgatttaggggaaaaacattatttgaaaacacagaggttccctctgctttgatcctacacaggcagagatatctccaagcagagagatccaaaaaagagcgccccctgcgggaaacgttcttttaatttagactttgccgttcctcctgtggagacgt

SEQ ID NO: 177018 - DNA, 315 bp, Homo sapiens
ggttcgcccaaaacctgggagaagcaagggcacattctatgctggcagcctctgcctgcccagctcatgcccacactcaggggcctttcctgggctttgggcagattgggtgggattcaggttgtctttatgaggcttgagcacagcttgagttcctcctcccatcctccaaccccttcctttgcccctacctcctagcccccaccttctacaatctgttatttccttttatatccaaagaattataaacagaagtccttccctcaagggaacagcaagattcagcaataaaggccagtggggtcacaaaggaca

SEQ ID NO: 177019 - DNA, 132 bp, Homo sapiens
caggtgagacaggtccagaatctggggctggcagttagcagcctagagtctgccctgggccctaacacagaagagttttatatgttcaggaatttttcctttattggtttcttcctttaagcatgaggtcta

SEQ ID NO: 177020 - DNA, 514 bp, Homo sapiens
gtcatttcacttctttctgccgtggtttttccatcagtaaaatgtgagtgataaccatattaatagtatcagcctcctttcattgttgggaggagctgatggtgtaatacagtgatgcaatgtaatgcctggcacatagtaagtgctcagttagcagtagtgatggtggtgatggtggtggtggtctttggtcaggttccctagaagcagagactgacatgaggattctggtgcagtgattcattgagggaaagctctcaagcgaaacccataaggaagaaagggcaacaactggggcaggggacaaagctaactacagatgtggtttcagctgagccccagcctcagcccagtcccatggggacccctagagtgtgaattgcatcactgagttggtggtgccttgaggcaaggagacctgagtgttgtgttctgtattggtcagtcattggctgtgggcatctggacatagccttcagtaagggcagttctccagaggagggtagagctctga

SEQ ID NO: 177021 - DNA, 2094 bp, Homo sapiens
aaatagcccaggcccgaggcagccaggccgcagctgtggactcctcacctcccggaggctctgctggtgcaggccccgcattggagggctcgattggctgcccggctggcactgacgtccccttggagctgggtggcagaggagataaacagccatgtgcaactctccacactatatttaacagctgcggcggagaaggcagggaggcagccacggtggcggctctgggggcagctcttgtcttcggggagaaggcccttggagccgggctggcatcggccttctcggggtgagcgaggtcaccatgccagcttcccagagccgggcccgtgcccgggaccgcaacaacgtcctcaaccgggctgagttcctgtccctgaaccagccccccaaggggggcccggagccccgcagctcgggcagaaaggcctcgggcccatcagcacagcccccacctgctggtgacggggccagagagcgacgccagtcacagcagctgccagaggaggactgcatgcagctgaacccctccttcaagggcatcgccttcaactccctgctggccatcgatatctgtatgtccaagcggctgggggtgtgcgctggccgggcggcgtcctgggccagtgcccgctccatggtcaagctcatcggcatcacgggccacggcatcccctggatcggaggcaccatcctctgcctggtgaagagcagcacactggccggccaggaggtgctcatgaatctgctcctggccctgctcctggacatcatgacggtggccggcgtgcagaagctcatcaagcggcgcggcccgtacgagatgagccccagcctcctggactacctcaccatggacatctacgccttcccggccgggcacgccagccgcgccgccatggtgtccaagttcttcctcagccacctggtgctggcggtgcccctgcgcgtgctgctggtgctctgggccctctgcgtgggcctgtcccgcgtgatgatcggccgccaccacgtcacggacgtcctctccggctttgtcatcggctacctccagttccgtctggtggagctggtctggatgccctccagcacctgccagatgctcatctctgcctggtgaagcgcccgccggcccacacaagcctctgggggcagggctggccctagagaaggggcagggggtggcgaggtggcgggcgtgggtggaacagagcggccaggagtcagagcggccacccccacctcatcttcccctcctggctggaggctggcgaacccaggccacccctcccggagacaagcgtgtttggcagtgccaggcctcttgcccctttgcttggactccaagtctcctctctaggcagccaggacccacccatggggacagccctatttagcttctgctctgggaacagcaaaaatcaggatggtgggaggggccgagtcttgtcttgtcctttcatcatcatgactgttgagttcttggctgtgcccatcacgccacagcacgacgcctgccaaaatgcccccaacctactgcctgatgcaggtgccattgccattagcggtcatcgacagcttagggcagcactttccaacgggtgcccatgggacaccagcctgcgagatgcttttgggggaaaggggttttgtggttcaataactttcggaagtgctgcacactctgtccccaagttggacattcacaaaggccgttattgccgtaaaggctctgacaagccctatagaaaagcttcttgctaaaccttctttaacccatgttttctaaacttatttgaccacagaacccttttcttggggaacagctattaacccccaaggaattattggttcctcaagtgcgttttgggagctgctgccagagagctaaagggcctggggtgtgagctgactctcctctggggaggccgggtgcacacgccacagcccgaggaaagtgctggccaccgcccgtgggcatcgatgaggctttggcccccaggggccggactccgtgtgacctaataggtcgtttccaagtcacccgttttggatgtgcatttcatgtgacaatacagatgacatgcaaatggc

SEQ ID NO: 177022 - DNA, 811 bp, Homo sapiens
ctcctcacctcccggaggctctgctggtgcaggccccgcattggagggctcgattggctgcccggctggcactgacgtccccttggagctgggtggcagaggagataaacagccatgtgcaactctccacactatatttaacagctgcggcggagaaggcagggaggcagccacggtggcggctctgggggcagctcttgtcttcggggagaaggcccttggagccgggctggcatcggccttctcggggtgagcgaggtcaccatgccagcttcccagagccgggcccgtgcccgggaccgcaacaacgtcctcaaccgggctgagttcctgtccctgaaccagccccccaaggggggcccggagccccgcagctcgggcagaaaggcctcgggcccatcagcacagcccccacctgctggtgacggggccagagagcgacgccagtcacagcagctgccagaggaggactgcatgcagctgaacccctccttcaagggcatcgccttcaactccctgctggccatcgatatctgtatgtccaagcggctgggggtgtgcgctggccgggcggcgtcctgggccagtgcccgctccatggtcaagctcatcggcatcacgggccacggcatcccctggatcggaggcaccatcctctgcctggtgaagagcagcacactggccggccaggaggtgctcatgaatctgctcctgggtgagtgtgcctgccgcccgccactcactgtcaggcccctcgggaggcagcctggcctgcccaaccccaccctggccgggacctgcacagccctca

SEQ ID NO: 177023 - DNA, 323 bp, Homo sapiens
tattatctgagtggtgcgggctcagtgggatgtacagcttctttctagatagtttccacaaagtacttacaaccttggtatcgaagcactcatctttgaatgactcaatggcttcatttcctgcagcatcattactttttcctctgaggtttctcattcacatactagtcttcactggcttgtgacttcacagtgtcaattgataagtagcttacaagaccaaagggatctcatttccactaaggaactataaggaactaaatgtatgttctctcctacttgcttgtgaaaatccagaaataaatgttgtgtaattaccaaat

SEQ ID NO: 177024 - DNA, 183 bp, Homo sapiens
taaaactcttcaatgatttctgttgtcaaaggctaattagccgtgtttttgcgcgtagcatatggagcacccgccagccacacatgatgtgattccccacctgcctcttccgcattctcccttacaatttaaaccaaccagcatcattgtattacttgctcataccacgttgctttatgcctc

SEQ ID NO: 177025 - DNA, 215 bp, Homo sapiens
ctcttctctgacgcgtccacgttctgtagaatggaaatgaggcccatccccagtgttgccgccctcaagtgggggtttggaaggtccgtgctcactcccatgtcacgtggagctggctcctagtttttgccatgagtttttctggccgctccctgctttggggcaacatgatatgtcccctgagaggccttaattttcctcacctgtgaaggagg

SEQ ID NO: 177026 - DNA, 1020 bp, Homo sapiens
accatacaaatgcaacatatgtggaaagtcctttagtcaaagttccaacctggcaactcatcagacagttcatagtggaaacaaaccttacaaatgtgatgagtgtggcaaaacctttaaacggagctccagcctcactacacatcagataatccatacaggagagaaaccatatacatgtgatgtatgcgacaaggtcttcagtcaacgttcacaacttgcaaggcaccagagaagtcatactggagagaaaccttacaaatgcaatgaatgtggcaaggtcttcagtcagacttcacatcttgtggggcatcggagaattcatactggagagaaaccttacaaatgtgataaatgtggtaaagcctttaaacagggctcattactcactcgacataagataattcataccagagagaaacgttaccaatgcggtgaatgtggaaaggtctttagtgaaaattcatgccttgtaagacatttaagaattcatactggggagcaaccttacaaatgtaatgtgtgtggcaaggtcttcaattacagtggaaacctttcaattcataagagaatacatacgggagagaaacctttccaatgtaatgaatgtggcacagtcttcaggaactactcatgcctagcacgtcatctaagaattcatactgggcagaaaccttacaaatgtaatgtgtgtggcaaggtcttcaatgacagtggaaacctttcaaatcataagagaattcatactggagagaagccgtttcaatgtaacgaatgcggcaaggttttcagttactactcatgcctagcacgtcatcggaaaattcataccggagagaaaccttacaaatgtaatgattgtggcaaagcctatactcagcgttcaagcctcactaaacatctgataattcatactggagagaaaccttacaattgtaatgagtttggaggggcatttatccaaagttcaaaacttgcaagatatcacagaaatcctactggggagaaaccacacaaatg

SEQ ID NO: 177027 - DNA, 183 bp, Homo sapiens
tcccaaggtgctgggattacaggcttgagtcaccgcacctggcctagaaatttttaattctaagtcctcgggcaccaggagcatctctaatagagacttttcaaaaatgattttaggtttctatgtgggtgactgcttcctaagcaggtgagtaacaaacccatcttaatagcacagctgcat

SEQ ID NO: 177028 - DNA, 521 bp, Homo sapiens
tctgttccttgtccatgtgctctattagcttctaggctgtatgatgcccagttgtgcctctgatgtagaaacaaacacattccctgcacgttgatttgcaagatttgtaaaggtgaggttccagaatctgatttgcttgtaaatttacgtcacttaagctggattttaccttacagttgtttttcttttaaagccatgctttatagcttggcttgttagaactcttctggagtccacgtagaaaacaaatagggaaaaatgctgagaggtgagaaagccattgggagattgccagttgcagggcctcagttgtgcagtctgtccagcaggcctaggcggcatgtccagtaggcctaggtggcatgtccagtgcatacatccaagcacacctttctctttgaggctgccaatgaaggctcttctcacctcagtgacagctttggatgcttacacattcaatgcagggctcattctacacctcctgttgcgagtgtacaggacccttccccagcccaaacgcc

SEQ ID NO: 177029 - DNA, 319 bp, Homo sapiens
ttagattaaataagagactttgtagtaaggcatgcctaatgacaacaggatgaactctaacagtaaaagaatgaaaatgaaaccatctggcaatgaactatgcaaactagacagtatttcagtatttttatccccttaactaatggccatcaccacagtacagcacgaagacagaaacaacatggagatgtaacgttttatttcacaaagttatctaaacaagtttcagggagattaaggggggcaattatgccctaccacacatttcatacacatggctaggttccaggttgtgtgggtgagcaccttttaaattttt

SEQ ID NO: 177030 - DNA, 295 bp, Homo sapiens
ctacatttaacaaaggaaagattatagataaacctgtttatcaaaagacattccttcagcaaaaaacacagagatgttgctcagacctgcccttagccttctgagaatagggacatatcagcaacgagaaaagggctgtgcaaaaggaaaaaatgatatcaaaatttctattttgtgaacaaatatgttgatatttgaaagcatcaacatgacaatatagaaataacaatagtaaatgtggtcaaaatcattttgttggagcccaattttgtttgtaaacggggaaaggtacagg

SEQ ID NO: 177031 - DNA, 357 bp, Homo sapiens
ccctcgataaggggccaatagagacagggtttcaccatgttggtcaggctgttgatctgctcaccttggccacccaaagtgctgggattacaggcatgagtcactgcgctgggccctcaatcattttcataaagctagaattttcattgtaaatgtttgctctgtagagacagttttgttttgaagaagctagtattataaaatgataacagattaagatcagggtcattttatttaacaatgcaaagttattagcaatggtggatttaggcatagaattttatcttaattttttaatttaatttggccttttagaaaaacagcttttgccattaagcagtgtgtttggccagaggc

SEQ ID NO: 177032 - DNA, 395 bp, Homo sapiens
gttaactgacttttgagaaaggtgctgcagtaggctgaatgatgccccctcactccccacatcctaccaaagagaatatggaacctgtgaatacacatataggaccaaagagaatttacagatgtcatgaagtgacggatcttaagatgaggaggttatcctgggtcatctgggtagactcaacataattacaagggttcttataagccagagagggtggagtgagggagaagattatgtggtgacagaagcagagactggagtgatgtgctataaaaacggagcacgggccacagccaaagatgcaggtggtcccagacgctggaaaaagcaagaaacaaattctcttctcagagtcttcagaaggaactagccccaccaacagcttaacttta

SEQ ID NO: 177033 - DNA, 475 bp, Homo sapiens
tggggccaggagctcactgaaccaaagtcctcaggccaggcctgaggcacagttcatgccaagaatgcctggggcgttgtggggaaatggagaaaatctggatgagaaactgtggaacttgttctgtcccatatcccaactgatctcgtgacacccttctgagctactgagctgactttgctaagtatgaaaagtgcagaatccatcccccaaccaatccagacagctggggttctttttttttgttttgttttttgttttttgacacagagtctcactctgtcgcccaggctggagtgcagtagcacaatctggactcactgcaacctctgcctcccaggttcaagtgattctcctgcctcagcctcctaagtagctggggttacaggcacgtgccaccacgcctggccagatattcttaactgaacaaaaatgaaaatatatcaaaatttgcagcatgggcctaggagttcat

SEQ ID NO: 177034 - DNA, 380 bp, Homo sapiens
agacagtgtggaaatagctgctctatatcaaaggaaaggcccatcatggtacctggggagaaaccaggggaggaagcctcctggaagtaggagactggatggaagaattccttgagccccaggaatgttatcagacagcagaaacctcctggtgtccttccagtctacccttgctccagcagctcataatccaggcacaggttgccgatgcaaagcaggaagaagtgctcttttctttgccagtaacctatctggaactcatctacagtgccagccagccatcagggcagcacgggtgtgcctccatcacagcttcttggatgaccacctcccatatcgacagagacctgcaaactattacaacagacaggttagtgtac

SEQ ID NO: 177035 - DNA, 249 bp, Homo sapiens
atctgtaaagcactactgacgtaaggtactatcattgcaaggttttctccagcttgatggggttcgacaggctagtgcaggtctgtagaagttacgtgaattgaacacaatagtacttcaacctaatcaatacctcctttttctgccattcaaccagtcttttaatttacatgtttattcgttggcccttgccctccctacataccacttcacaaatctatcaatccagtgacatccctcccttaaagc

SEQ ID NO: 177036 - DNA, 332 bp, Homo sapiens
cactacgatggtattaagaacaatgaaagacactggaaacaggaagttatacttccaaagaactgtattttcctcatttctgtttcctttatttttccagatgccagatggcttttcaccaaggttttccttgactgagccgaagtaagcaattcaaagaaatattgtacttttttttatttttgtaaagatgaggtctctgtatgttgcctaggctggagtgcagtagcatgatagttacaggaaaggggtcccaatctagaccccaagagagggttcttggatcttgtgcaagaaagaattcagggtgatgccacagtgtgaagtgaaag

SEQ ID NO: 177037 - DNA, 761 bp, Homo sapiens
tgaaaggtaccaaaagcataacatcaataaaacaaagtttgtaacagctaatgattttactatgcctatgatacgttgaacagcccttatccaaaatgcttgggacaagaagtgttttggattttggaatatttgcatatacacaatgagatatgttgggatgggacccaagactaaatacgaattcatttatgtttcatatataacttatacacataggctgaaggtaattttatacaatattttgtgcatgaaacgaagttttgactgtgtcttgactgagacccaacatatgaggtcaaatatggaattttccacttgtggcatcacgttgctaaaaaattttcagattttggattttcggactagggatggtcaacctgtaatatcaattgttaaactgcctttacttgtgaaaggtcaccttttcatacgtatgagtattcattatacaccctccttcacggttctcacagaccctcatttcaagcatcttactgccttggtggaatctttgtggtaacttttagctagtgggcatgtaacaagaatagctaatacttacggagtgcctgatgtatgccaaatatcttatacatatcatcacccatgaagaaggtactgctgtgatccccatcttacaggtgagtggatacacaagacctcagagctactcggctaggctctggcactcactccatggcccgtggtgtctaacccctatgctatatactgcctccttaaggaaagtcagctagctc

SEQ ID NO: 177038 - DNA, 515 bp, Homo sapiens
aagtaatgctgagcatcttttcatatgtgtgtttgccacttgtatatcattctcgaggaaaaattgtctgtttgaaagttttgtttgccccctttttaactgtttgtataaacaattattgttgggttttatgagttctttacatattctgaatattaaccctttattggatatatgatattcaaatactgatatatgattttcaaatattagaaattaataatttttgtaagttgatcttatatgggacaaccttgctcgatcctcttattggttttagtggggtttttgttgttgttgttgtcattgttgttattgatattctctctgtctctctctttttccaggtagataatagtatcatctgcgagcattgttttgtgttttccctcttaatccttagtgttttatttttcatgttgcttgactaggatcttcaatgctgtgtcaaacagtagggtgataatgagcattactcttaaaggaaataaacctaaatattctcattaagtata

SEQ ID NO: 177039 - DNA, 137 bp, Homo sapiens
agccaattttgatgttttcatggactgatacttgtaataaacatttcaattatatatagcattgatgtagaaatgtaccaaatttacatttttttagcttatggaataaataaatgtttaaactgaaattgattcga

SEQ ID NO: 177040 - DNA, 467 bp, Homo sapiens
agcgcagtttcaagtgaaggatgcatctgtgatgcaaaatcatcgaccatttatttgtaatggtgtgtatgtaaccttcaccaaggtattttactggggctagtgcttttacaggcatttccaactttgtagattgctacctctggatctgagaaactgcagctaaagtgaagtcggctttaatactgtttcatggattcattggtacaccctcccaccgtgtttatttgtattttgcaattgtttgagattattgttttggttttttgcactaagcaattgcttggttaatcctaaacaaccacagtgatgaggaaagcatgtgattgtaactaactgcctagggtgagtacctttcagtgagggtttgatttcagtgttagccagagaaggcactagtagccatattattagaagattgtagtaaattgtaaagtctgatcgggagttttgttattttttatgta

SEQ ID NO: 177041 - DNA, 221 bp, Homo sapiens
caaaatataaaattaaagctcacagttcagttgtatttctatagacttgaacaatccgaaaaggaaataaaaaattcaatttgcaatctcatcaaaaagaataaaatacttgggaataaacttgaccaaagaggtgaaagattggcacactgaaaactacaacatgtttttgatacaaataagtggaaatgcatctcttgttcatggattggaagacttaa

SEQ ID NO: 177042 - DNA, 575 bp, Homo sapiens
ttgtggcactttcactacctttcaagtagagacaaggtcttgctatattgccctgggtggtctcaaactcctggcttcaagcaatcctactgtctccaaaagggctgggattaaaggtgtgaactaccacacccagccatttataacaataaagttggctatatcaattgactcttcctttcataaaacattgctctgtagtatgtgctgctgtttgacagcattttacctacagtaaaactttcttcaaaattggggcctattctctcaaaccttgctgccactttatcaactaagcatagggcatattctacatcctttgttgtcatttcaacaatgtttacaccatcttcagaggaaatagattctatctcaagaaagcactttctttgttcatctatgagaagatatacattcaagtttgaccatgagattgcagcaattcagtcacatcttcaggctccacttctaattttagctctcttgctattggccaccacatctgcaacctccatcaaagtcttgaatctctcagtcatccatgcaggacagaatcaacttctttcaaactccgg

SEQ ID NO: 177043 - DNA, 422 bp, Homo sapiens
aaataagacccaactgtatgctgcctacatgaaatacatttcaaaaataatgacacaataggttaaaagtaaaaaaaaaaatatcatgctaacacttgtcaaaatgaagcctagaatttaatatcagactataaatttcagagcaaagaatatgatcacagacaaagaaggttacttcataatgtcaatgaggccgatttatcaagaggacataacaaacataaatgcacctaagaatatatcttcaaaaaacattaagtaaaaaataacagaactgtaggccacaattattgttgagtatttcaacacccctctttcagtaattgatagtactagataaaaatcaaatatctaataacaaatatctgaataacactatcagccaacttgatctaattgacattatacaataccctatacag

SEQ ID NO: 177044 - DNA, 454 bp, Homo sapiens
ggtcaagtatatgccaagtaagaatgaaaaaaacacacataccgactcagaatggtgagcaaaaaaactttgaccaaaatcaagtgctcttctcttgtccatccacattcatctatttccaggtctttaaatataatctgtgtgagaacggcccctacatttatatctccctccagctctggccaaagctccagacttatatattcaatttggtatcttctcacagacatctgcatctaaaactttccataccccaaacaaaactctttattcccctctttaccataccccctcaatactgctcctccctctgtcttcccccatctccataaattattctacctagctgctcagacaaaaattctgggccacatctgatttctttctttttctcaccacccctcatatcaaaactgctagcaaattccatcttctctacctccacaatatatac

SEQ ID NO: 177045 - DNA, 443 bp, Homo sapiens
tgggtgttagaatgccagggtctattctgaaacaacaacacaattcactagagctgttttagggaatacggaaatatttggggaagtccagaggctgtctcctcatcacgtacaaaaattttgtaacaatttccttcacctccccctcttcccacagtaaagctcagcagtgacatttcctttcccctatctagttatatgaatcacttcttactttactacatttttagggattctgtgtttttaccttgaatcaaaagtgatgccaaattatcactaatacatcttgactcttctgatccccaatcagaatttcccctcccctaattgaaagtgacattttctagtacaaaaattttcacgcaaaatgaggttagactagaataaatatgagtcagatgaacatgaactgaaacagaaaaatgtgctggtgcaatccctcc

SEQ ID NO: 177046 - DNA, 473 bp, Homo sapiens
cttgaagggaaaaggcagaagttttttgccaagtgggcaggctatataggaccaggcagtgatggcttgtctctggagtgctttactactttctaaggccagtcgtttaatcaggaactctccagtcttagtctcattttctttctttcttttttttttggtatttttgggtagcagtggggtttggctgtgttgcccaggctggcatcctcctgccttggccccccacaaagtgtggggattacaggcatgagccaccactcccagacccagtcttattttccaaataaggaatctaaggcttagggaaagggagcagttttcgggtcatgctgttgggggagccaggacccaaatacagaacttcagagttcaaacttcagagtactatcacttttatgtcctgtgactgtttttaacagttggaaaatttacattattttctccttatttctcttttgcttgccccacaa

SEQ ID NO: 177047 - DNA, 252 bp, Homo sapiens
gacttcagaggtcgggaatgtcagacaggtttatccaggccaaggggtagcagtctttgctcccggtgtcaccccttccacccctaacatccttgcaccctgcctcgctgcctccctgtgtgatctacggaggaaactggggaccatagggccgtctggccctcgagcacaaaccggggcctgggctacacacaggggaggggcccaggagcaaaaggtgtgtggtgaccctgctgcatactcataaaatac

SEQ ID NO: 177048 - DNA, 303 bp, Homo sapiens
tgaggcagatcccgacaccacattcttcatctgggtatctcttactggaaagggccccttgtcgtgcaaataatcaaaaatagcttctccaaaatttatatcatcatacattcagccagtgttcatatttcaccgactcttgtggatgatgcttgtttagttggttcaaacgtttagtttgaatcaggttgcaaccacgctgtcccaatccattgcagctggtcaccctgtccattcagtctccgcttctaggagccagcctcggtttccttcctgagaaagctactctgcacagcccatccc

SEQ ID NO: 177049 - DNA, 484 bp, Homo sapiens
ctctatccacatctataaattaaatttcatcaaagaaacttctttatatgttaatgcctcagaagaaaacatatatattccttttttaaaagtttcattctttcagagggaaaatcaaatcatttgagagagacagaccatcaaaaatacaacactcagacataaaaggtgattgaaacatattagataggtaagtacataaaaaaaccccacggcagggtctaagtcactttcatttttgatccctgacatgtaggcacagcaactgcacacaggattcaagcagtgtttgtacaacaaatgaaactattcgtctaatgaataaatacgacctattcactaattaaaagcaaattaagttacatatttaaaaaattaacatcaaagtgtttaactcctggcacataccttagaaaactagtttacaagttttacttttcagaacaccatttaaaggctatatgatcagattaagggatattaa

SEQ ID NO: 177050 - DNA, 428 bp, Homo sapiens
tatttttagtagagacggggttttgccatgttggccaggctagtatcgaactcctgacctcagctgatccgcctgtcttggcctcccaaagtgctgggattacaggtgtgagccaccgctcccagcaaccccgttacatttcttatataaaatacactagcttacgagtgctgattctttctgccatacaccaaggcatgtgaaactcaaaattttaaagtcaacagatctcaacatttatgaagaaaatgctccttgattatgccttccttaaaaaaaaaatgaacaagttgctcacaagcaaatcctgattatcacatacacaaagctgtttacttcagactctgacctcttaagcagatatggttaacagctactttcctgtattgacggttttatattatgatcagcgatatcacgcagttcac

SEQ ID NO: 177051 - DNA, 461 bp, Homo sapiens
agcggtggctgggggtcactggctttatagagcagatgcctcaaatcaaatgccttcccaatgccaagctcatcatggtcatggaaattgattaatgcatgcttcccagtttgctcctgtctctgctttcgttgtacaaaaccaatgcaacacctacagctaagatgatatttaaattaaatttagaagtgaacataagctcctggatgaagtaaataatatgatttcgttataagcacagggaatgtgggatgtttcaatgcagatttatggtgttttaaagaaactttgaggaaaaaccaaccacatacacatatgctgactccatggcttatgtttgctctaccccacctgtcctgctacaactgggactggcaaagtgcggcctgcaggccaaatcccgccggggcctggttttgtccagcaaactaagaatggattttacatttttaagcacttga

SEQ ID NO: 177052 - DNA, 492 bp, Homo sapiens
aagagggaatctggtgtgggctaggactatattcagaggggctgtcctcttcccttcctcagagttttgttagatctctgtttcagtggttcttaagggcatccggttcatatgcctatgtgctggggcttcaaaagacccttcttcccagacctccctacttccctgaggtcccattaaagctgcatcaaatgtttgtagaaccagaaaagattagagcaggtaaagaccttagagtccttgctgtccagccaggaaagctgggatccagagagtgggagagacttgcccaggaccacaaactccttggaggcaaagctgagtctagcacttgagtctcctgactgccacagtccttccccactgctccaccaatcatttgctcaaatggtgctgagaggggaagaaaggaacatagtcatgatcttgggaaaggactttcttcaggatgatctagtgccattaaatttacctgaaagccgggcgcggccg

SEQ ID NO: 177053 - DNA, 341 bp, Homo sapiens
agcggatatgcgcattatttttcgttccctcgagacatatacgggcgcgattgagacttatctgaccaaatcatgttgcacatgataatctcgtctgcaatggctgcactgccgtgggcagtaaaaatcgtctgcgcagattactgggcttcgtatgacaacatctttgggaagggatgcattatttctgcctcacacttctaaatatgaaaagctctgtatggctacaactgtctaaatcaagatttctcaacctgggttctgtggaatcccagggtgtccctgaactcgctaggagctccacgcaaaagagtgatttctatcaatgcactgcctttaaa

SEQ ID NO: 177054 - DNA, 152 bp, Homo sapiens
cctggctactccttatcttgtccggaaagaactgactgacaggtgctgagctcaccgggaaatttatttcaaatttcaaaccctatgtactgctccttgtcttctgataatactcatgtgacccctcttctatggactgtcccatccacttc

SEQ ID NO: 177055 - DNA, 328 bp, Homo sapiens
ggataggagcaagagctagtaattgggtttggcaggcctggtcaaaggggagctttaaggtcaggtatatccaaacatatcaggaagtaggttacatggtgtggtgaaatataccagatgtaaaatctgcagaatgtactcctgctgttgagtccaacttgcaatgtaagtccctttgcagtgaaggtcttgagtatgtattgcatgcagcaggcagaggagcgggaggagaaactgtataatgtatttggtcttgaacatcctttgttttccaaaaccacattcatctctaccttggttgaaatgtataaaactaccattttaagtt

SEQ ID NO: 177056 - DNA, 246 bp, Homo sapiens
ctacccaatgaacactgtccttcctagtcattgtccattcaggcctgcacattttagcagactgagactatccttctgttgtcttagaattatcttggtaaacacatatagctggggacatttctgcctgattaaccctcagtgcaattttgatttcatttagaatctgaagacatgagttgattcaaaacaaatatttcctcactgggcatgctgtttcactcactgacaacaatttgctattta

SEQ ID NO: 177057 - DNA, 307 bp, Homo sapiens
atactcaaattgaaaaccagatacatgaaactcaactgatggtaacaaaatgtcagtaaaataaattcacaagctcttcctggaacaccacaaataaatgacattatttactactctgttgcatcaaggtctaaacacgacagttactacgaatgtgacatatttgttttctttttaagtagtattatcagtctcacccagctagaaatactagtggctggaatccttatttacttaataatacttaactagcatcttcttgcttctatgatcttagcatctttcagaattctcctatgtgtactct

SEQ ID NO: 177058 - DNA, 446 bp, Homo sapiens
gcattgtcatttcttatcctgtacatatttaatatgaacctcagattatcatggaaattgattgtttccttggtagctggttgtggagtgtttttgtttttgtttttgttttttaatttttccctgtaaagaattgaagggtatcagagaaaaaagcaggagtccagacgagataatggtggcttggattacagtagtaatagaggagatggtgagaagtagtcagtttggggctatgtttttgcaagccttgtgatagactggatgtgaggtgaaagaagaggagtcagagataatgcttaggtttctagtttagcactgagcaatccagtggatgatggtttcacttactgaggtgggaggatctactgtgtaaacataatttgttaagaactttacatgcttgatattgcttacttgtggcagggctgggattcaaacccagg

SEQ ID NO: 177059 - DNA, 333 bp, Homo sapiens
cagtcctgccgttgttattcatttgcatcaaatgttactggagagatatgttttgttaagctcacatagtgactatttagaattcagaagagagagagacttctgtgctttctgcattccaggttgttgcaattgatttttttctgcttttctaacaactgccctgattatctgttttgcttccattttctgttgcttcttgccctttgcttgcaaaacaaacaggcaagcctggtaagtaaacgcttttccccctaatttgacacctgcccattgcaaccctttgtttgtttgtttttctatttttgttatttttgctttgtgtattgctgc

SEQ ID NO: 177060 - DNA, 185 bp, Homo sapiens
tatttttccagtgtgtctgtaccatgttattcttgccagcgatgtatgagaggtccagtttctcggcagcctcactatcatttggtgttgacactactttttcttttagctctcctaatagatatgtagtgacatcctgccatggacttattttgcatttcctgtggctaatgatgctgagcctc

SEQ ID NO: 177061 - DNA, 379 bp, Homo sapiens
tacaggcactatcaatacaattgcaatacaattgcaatcaattatagttattatttttatcaatgcccaaattatcgcatatttggccagtgggaacccctttaagctggctcatcttttttgagatacactcattagtctgagcatttccttcctttctgggacaacacagtgtcccaggctcgcctagaatttcctctgccacaatgtggagccagccatttcttcaaggagtttattttcattttcatggggaatggtaatttgaagttaagatctggatgcttactgcttctggagtgtcattttatctccacccaatggacagagctgggaaatacactttatttttttgagacattatctggatctgtcgccc

SEQ ID NO: 177062 - DNA, 317 bp, Homo sapiens
ttgtggtggtgatgatgttggatgatggtgatgatattggtgatggtgattggtgatgatgacatgatggtgatgatgaagataatggtgatggtggtggtggtggtgatgatggtgttgatgatcatgttgctgatatgatggtgatggtgatgaaggtgataacagcaatgatgataatggtgatggtcatgacgatgttgtaggactttttccttagttcagctaagagccaggctgttgtcacaaggtcatgagagattaggcttgcagacactttgaagagtgagaaaaaaggagcttattggacaaaaagg

SEQ ID NO: 177063 - DNA, 396 bp, Homo sapiens
ccacagactatgtcaagttctacacagaaaagaggctatgaaactgtggctctggtgactgtaatctcaggacacagctctcacaccacgagaggaatagagaacaatgatgggcctttggtgaagaaatgtaccacgagggaagtgaggcagtttagctgtggatttccactccctcaagccccatccaacaatctcggggactcactgaaaaaggtaaagtaacaaacccccgagtgccactctccccaggctccttcacagcaggcagcttccgcctcaccctccaacacctccaaggcgctgccatctcccgaggtggtgagtggccccgtgcttgcttctctccaaggctgccgcaccatctccctgataccccaacgcgtggccctatgc

SEQ ID NO: 177064 - DNA, 247 bp, Homo sapiens
aaataaagggaactaaggggaaatttgctttaaaaggaagctggacaactgagggttattaactattgaaacaatatatcaaacatgaattgtggaatatttcatgagggtgctatttaaaaataggtatgcatttgtttgccctggagtaggaattggaaaaatagataatatgattgggtttcttttaactaaattatgtaatgtctaattcaaaaagcacttgtcccttggagaaagcactatt

SEQ ID NO: 177065 - DNA, 348 bp, Homo sapiens
acctaactgactgatgactgactacctgactgactgattacatgactaactggctaactacctgactaactgattgactgactacctgactacatcactgactggttaccttactgactacttgtctgactgactgactgcctgactgactacctgactaactacctgactgactgactacctaactacctgactggctgactaactaactgactcattgattgactgcctgactgactacctaattacctgactctcccactaactgactgattacctgactagctacctgactggctaactcattaactgacttactatctgactgactaactacctgactgtctg

SEQ ID NO: 177066 - DNA, 173 bp, Homo sapiens
ctatttctccaaagtttgggcaagcagagtcaacttgaactcctccaccttctttgctgtgcctagcctttccttcaatttaacctcagtagcatttatgagcttaagaaggggaagcgggtggcagagtgctggcaaaaagagaggagacttgggatgcctctggaagacat

SEQ ID NO: 177067 - DNA, 541 bp, Homo sapiens
attttaactcagttatgaaccttatatggaatgatagttaattcactttcttatttaatggattttattatttagaacagtggttgtttccccaaaacattgggcagataatccacagagttccagcatttttattccaggctggagtgcagtggcatgatctcggctcactgcaacctccgcctcctgggttctagcaatccttctgcctcagcctcccgagtagctgggaatacaggcgcacaccaccacacccaactaatttctgtattttttagtagagagagggtttcaccatattgaccaggctggtctcaaactcctgaccttgtgattcgcccacctcagcctcccaaagtgctgggattacaggcgtgagccaccgtacccagcatagttccccctattctaaacatcttgactggccaggtgctgagccttatacctgtaatcctaccacttaggtaggccaaagcagcaggacagcttggactcgggagttggaggccagcctaggcaacatagcaagaccctgtttcca

SEQ ID NO: 177068 - DNA, 679 bp, Homo sapiens
atctgcccgccttggcctcccaaggtgctgggattataggggtgagctaccacgcccagcctgctttttctttttttaacatttaacgctttcttgcaaaggcatgcaagcacacaccccaagttgctgcctacccctcagctgagactgtcacccacgaagcactgggccgtccttatactctcctgcagccgcagcctcagcctcccaagtggctgggactataggcgtgggctaccacgcctggctaatttttgtatttttagtagagatggggtttcgccgtgttggccaggctggtcttgaactccttagctcaaatgatccacccacctcagcctcccaaagtgctgggatgacaggtgtgagccactgctcccagatctgttttgagtcactttctctcagttgtcctctgtgttctttttacaactgtttgttgaaaccagagcttaattaagcccttgcttgctatgtcactttgtttaaaatggtccctctccccttgccattgatggggatgaaatgggctcatttgtcctgcagggaggcgcccagttttgatttggccaattgctccctcagggcaccagtccacctatgcctcatagctgctgtagcttgggaattgtatcccgtctggaagagtctgattctttttgttgttactgttggtaag

SEQ ID NO: 177069 - DNA, 392 bp, Homo sapiens
ggaaaagctataacaggaaaagctatgatcagtgtagagttgttatcaggtaggggtgtgcaacagggtacaggggtgactggactttttcatcaagctgtgaatagatagtgcagtgggaaaatgttgataaagaaaaagcagaatttagttatgtttcaggtaaagaacagaaagccccaaattataacagtatgtattttttagaaaatcaatgacttgatgaaactgtctgaaattttgctcagaaccactactttccatctgcctattcaggtcgaacaattttttccctcacatttcattttttccttatctatgcttaagttataaatgtaaatctcttaacctctttccaaagatcaaacctacatttccatctgcctgagaaa

SEQ ID NO: 177070 - DNA, 381 bp, Homo sapiens
agttaaggacaccaggctgggcttaggctgcttatcgcattctgggggccaaagggctcgggggggtcctggactttttcatcaagctgtgaatagatagtgcagtgggaaaatgttgataaagaaaaagcagaatttagttatgtttcaggtaaagaacagaaagccccaaattataacagtatgtattttttagaaaatcaatgacttgatgaaactgtctgaaattttgctcagaaccactactttccatctgcctattcaggtcgaacaattttttccctcacatttcattttttccttatctatgcttaagttataaatgtaaatctcttaacctctttccaaagatcaaacctacatttccatctgcctgagaaa

SEQ ID NO: 177071 - DNA, 501 bp, Homo sapiens
tgccctcattttagaatgatggtagtgactgtgaattagctcattttagtacccatctccatatcccagtttgactggatgcagtgatccttcttcacctcatgttatcaggccctcagaattcatattctccatcaagtagactgaaggccaagaaaagggccttgaacatggtgcttctatcacatacccaattcctagtataatagtccccacgaattcatgggggatacattccaagcccccagtggacatcggaaattgcagatagtaccaaacctgactgccatcaattggaacatgtttgtgttcatgtggctcacctacaaattttgtgctttttccctcataactaagtgctatcatgcactatgtccataatgcgtgcacttgaggtgcaacagcaaaactagcatgaatttgtctttcctccttcacaatttcacagaagattcattcttttttttttttttatttttgagacagagtctcactctgctg

SEQ ID NO: 177072 - DNA, 654 bp, Homo sapiens
ttccacgtatctcctgagctccctcagggcagaaaccatgcccgtattcacctttgattctttaataccctggataacaggacacagtgtaggctcaacaagtgtctgttgaatgcatgaatcaacaaaaggcaggtggactaaaagaaccatcctacttctcttctttgggacactcacaccatgagaccacctcataagccttgcccctgtgagtttcaggccgtcttctcaaatagacttacccacccatcgtaaacaaactgcatcatgcgaactcattccttccaggcattactaattctctacaagtccctcccctggaaccttacagtgaaagtactcaaaggtctcccttctgaggagaatatctcactgcaagacaccacctagaattccacaaattgataaaccaaaacacgatgggcatgacattcacatatataacttccttctccacctagatcgcaggggcgaaaacaaaaaaaccctttgctttgtagccttcatcttgacctaaaaacacccagaatcctgattctggggccaaccaaccacctacttccaagcagtaacaattctaggcactctccagcctccgtttatcttccttagtcctttctgattacttaagcagaaaacacatacacacac

SEQ ID NO: 177073 - DNA, 465 bp, Homo sapiens
agcagaggtaatgggcacagcaggatttaggcatctgtggttcctgactacaacaccatcaaacccccaattttctctcacaactggtattagtatttcacatctagcccatgaggcaactgaggctcacagagggcaattgactttgttccaggttacacaactatcaagtggcagaatcagggtaggaacttcaatgtgtctaactccacgagcgctctttccactatgccacaccgcattggagctgagatttgaagggtacacatgatctgtgtgccgcagaggcagaaagaggcaaggtcaccctgtcccactttaaaaggtctgctgagatctcacacacatgcacatgcacacacacacagtccgctgctgccacacctccaatgtcatcaggccagctgtctttacaaaagccaaaaaaaaggaactcctttgccaacactccgtttacaaagaata

SEQ ID NO: 177074 - DNA, 400 bp, Homo sapiens
cgcaaagatagatggtttgcatatggtaaattctctttatggtacacagttctgtgaatttttgacacacgcatgcagttgtgtaaccactatcacaatccagctattgaccaattagtgtgattataatagtggttacacaattaccacgattttttttttttttttttgagacagagttttgccctcgtcactcaggctggattgcactggcacgatctcggctcacttcaacctctgcctcccaggttcaagcgattctcctgcttcagcctcccgactagctgggattacacgcaacaacacgcccagctaatttttatatttttaatagagaaggagtttcaccaggttggccggtctggtctcgaactcctgacctcaggtgatccacccccct

SEQ ID NO: 177075 - DNA, 429 bp, Homo sapiens
ccgggtgaggtcggacaaggggaagaaggaaccgcctccgcgcctcccgcggccctgccccaccgccccgaggccggccggtggaggctctctccacccatcccctggaaaatgaaagtaccccagaagcacaagttggcctgcagagcgcgagagcgcggaaaggccgctgacagcaaggaccgcgcgtgcaccttgcggccccggacccttctcagcccgaggagtttgggcttcaggccctcccagacacggtgcaaggagaggctcgggctgccgcccccgagtccatgagcgccggagcagttcccgccctcgaagttcctctccgggagagagggagagagcgagggagagaatgagacagggagggagggagagaggggcgcgcggcttctgaggcgacccctcccggagatgctgcggccg

SEQ ID NO: 177076 - DNA, 152 bp, Homo sapiens
caaaccatcattttctctcacctggactaatgccagagcctcctgactggtctcccagcttctcttctagttctaatacagtctaattccacacagaagccaggatgatccaccttttcaaaagccaatcaattcatatcattccctgctct

SEQ ID NO: 177077 - DNA, 184 bp, Homo sapiens
cttaaaacttgtttaaattatacagatgagattgagaattttaaaattcctatctatgagacatgtacattctataaatcttggcatcagaggtgagcttccagttggaatccctattcagccagagggttgtgtcttcattcacttgttagacactctcttcccttttcccaggatggaatag

SEQ ID NO: 177078 - DNA, 373 bp, Homo sapiens
tgagaataatagcatctactcagagggttgttgggaggatgaagtccgatgacaggagccctcacagctgagccggcacctggggaggccctagagtgtcgccttcgctgttaaggggcatggcagaggaggcccacccatgacagaggagcttgtcatcccaagcaggaatgccacctggtctgacattaggattcaaaaggcaaatgataaactcctgactgtgaggccgtggtggctgctcggttaatacttgtgcacttgacctgaggtgagcatcctccacacctcccagtgctggcctaatagctaaatgatttcctctgactcacatttattgagcagtcactatgctaggtaggggagatgtgtg

SEQ ID NO: 177079 - DNA, 223 bp, Homo sapiens
tggcattaagatacagccatgcgattatcgtggatgggaaaacggcaagattgtaacaatctgcaagcatgttgattgatcagagttgcaaagtactatgagctggccgatggcatacacaaagtgcagaggagctctcaactctgtaagaagaacaatgccggaggagtagaatagctatccttagcccaggtgctcactgcccctgtcacgtatgctcatg

SEQ ID NO: 177080 - DNA, 517 bp, Homo sapiens
tcctcatatcctttaatctcggcccagagatttttctatatagtgaactgtaacccaactcaatgtgtaaacagattataacatactcttgtatcaatcacaaagttttggccaatcacatgttgccaaatcttcaaaccatgttcaaataagacaaatgccaagctgtaaccaatcggctatttctgtacctcgcttctgtttcctgtacattactttcctttttctgtccataaatcctctccaaccatgcagcagcactagcggcagactgaatctattctggctggggcaaggggtgaagataggggtagtcctgactcataaaaaattacttgctcggctgggcatggtgactcacacctgtaatcctagcactttgggagggtgaggcaggtggatcacctgaggtcaagagttcgagactagcctgaccaatatggtggcatgtgcctgtagtcccagctactaggaaggctgagacaggacaactgcttgaacccaggaggtggaggtt

SEQ ID NO: 177081 - DNA, 326 bp, Homo sapiens
cctcgtaactggagcagctctgttctatacaagttctctggcattggaaaaccgctccgcgatttcagtgcaagcattggcggcctattccaatcgctgctccctgatttgaatggcaggtgatcagtggcccctgtggcttatagacacaccagagctcccaggggaagtgctctgaaaactcatcctggtcagagttcagaaggacatgtggagtataaggtcagatgcagaaataaagggagatggtgtggccctcctgcctggggatgctgagcaggttgctggaggcggtgatctcactctgaaggagacagacacagaaa

SEQ ID NO: 177082 - DNA, 173 bp, Homo sapiens
actgggcatatatagatactcagcaaatatattttgaatgaatcacagagtttaagtttcctctgtcttcctttcttgacttctattgaaaatgtaagccaccgcgtctgatcctgtgctacattatatcactagcacataacacaataacccggacggttaggtctacctgg

SEQ ID NO: 177083 - DNA, 161 bp, Homo sapiens
gtaatctatattcaagaaccgttttaatcttgttggcatcattctgattttagaaagtgctgccaaagccaacactccttgctgattttctgtctagttctatcaattattgaaaaaggcatgaggaaatttctaactataattgtggattcatctatatc

SEQ ID NO: 177084 - DNA, 233 bp, Homo sapiens
tgtatcaccctaatcccactaccctcagactgcctgaaaaactctgttccttcaaaaccccattcaagagtcacttcacctggaaagccatccctgagcctcctgggcagggtgggggatccccctgagggcttccccgtaaacaccccacacactcaacttctgctagggcacacaagtcacacgtggtcgaagttaggtcaatatgtgacgtatgaatgacttgccagtag

SEQ ID NO: 177085 - DNA, 366 bp, Homo sapiens
gggtgtgaatgaacattgttgaaatgacaacaaaggatttagaatattacgtaaacttagttgataaagcagtggcagtgtttgagaggaatgactctaattttggaataagatctactgtgggtaaaatgctgtcaaacagcatcacatgctacagagaaatcgtccgttaaaggaaaagtcaatgtggcagacttcattttatttttgtaggacattttagttataacatcaatttctgtaatagttgcaggactattcagattgtctgtttcatcttggttgagttttggtagtttatagtttttgagaaatcagtttatatttaataacctgttcaatttatgaacttaaagttcttcataa

SEQ ID NO: 177086 - DNA, 453 bp, Homo sapiens
tatctccattaagtgaaccacagagaaaaaagaagagaagagttttacttctgtcatctggtgatacatgcttggtgaatacaagaaaccacaggataagcaacagggctcttgtggtaaattccacaggctctcctgatagggcagccaagtcttttcccagtagccagcccttggcaactaaaacatgtggttttatttctatggatgttgtgagtgtggacctaaacttctctaagagaacttgtatttctcaagcctaaagatgtattacatttttttgtatttgtatttgatccacataaagaaggggaaaaaaaattgtgtgtgtggatagcattccaagaaggaactctagccccaggaaagctgctatttctgctcttctccagctacctgccaacaatttgtcctcaaaagaggctctttctgactatttacagatctgtcact

SEQ ID NO: 177087 - DNA, 773 bp, Homo sapiens
cggttttcctaggaaaactctggagaaaattgaggcaggagccactcattcgtgccccttccagggtggacctcttatcaccctaaggattgtttgttttcctgtcacccacatcaagctgggtggtggccgcagcctttgatctccacctcctaacccctctcccaagtaccctgtgtttgcccagcactgaatgagacagctaaagtgatccctgagagaactaaagtgttccctcaggccgggcgtggtggcttatgcctgtaatcctaacactttgggaggccgaggtgggcagatcacctgatgcgtacgagcaggttctggaccagatggtgaaacactggtgtctactagtcttatgctaaattatgaccgggcgttggaggtggggtaggctggtagtccccgtgtactcgcaaggacacgggacgatgaatgccttgaagacctcaggagatagccggtagcgtgtgaggtggcgatgacgtgcgccgtgtgacgccgatgcaaaaaacaagggggaagaccacagcgggggagagagattgcccccatgaaggagtagtcccccatagatgtgtgggccccgattaccacataacgttattagtcgacaaccaaagggtggccccccataggggggcccctgaattattaaagagcgactgtagtggacaaggggccaggggacttagcaccgacggttgtagacacgcgggccaaaaccggtgcgaaaagggggcacccggggagacactacgcgtaaacgc

SEQ ID NO: 177088 - DNA, 121 bp, Homo sapiens
gttcagaaaacaagaggttcaggaaagcaatgagaattactcttactcaaggtgacatttgtacagcaggctgtgcggtaagcagtccaaatcctagcaggagaatggagcactccccaga

SEQ ID NO: 177089 - DNA, 249 bp, Homo sapiens
ccgcggttgactctgaggatccccctacagagatttaaaacatgatccctttgcctcaagccaataggaaacaagctaaaagcaagcaatcataatgaaaaggaaggatgttttaagtagtaaaggagaaagaaaaaagaaactcaaatggattctctcattctcaacaaacaagcaagtgaaacttctttgggtaaagagagaacaaccagaaagctattctggctcttcagtgctcctactgcaagg

SEQ ID NO: 177090 - DNA, 333 bp, Homo sapiens
cttctattaggcgtgatgggctcaggtatgtatactcctgaggcgagcaggattgaggtgtttagctcaggggtacttctagaggggtttagtgagtgaattcctgtatggtggtcagcaacctcctaattcgggtgttggtgctaggcttgagtggtagaaagctcaaaagaagctgaagactaaatgataggaggccttggatattgagagtaagaaacttgaacctgattctttatgttataaatatcttttgaagggttttgctaaaggagtgtgacgtggaaggggtattttagaatgaagaatctggaagagtgttgctggagaggt

SEQ ID NO: 177091 - DNA, 404 bp, Homo sapiens
gatctaaggatccccctggtacgggagtgggaaactgtgaggtgctgcttgcgtgtgtcatggtcctaagctgcccactgtcctctctcctggtgtgttcaggcctccccgaggtgcttctcacgactttcacacccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctg

SEQ ID NO: 177092 - DNA, 291 bp, Homo sapiens
cacccagctaattttaaaaaatttttttgtagagatgggggcctcgctatgttgcccaggttggtctcaccctcctgggcccaagcaatcctgccatggcctcccaaatcactgggattacaggcctgagcacccaacctcctaaaacttctgattagagtctagtgcaatagcagttaatgcattgaccatttctcaaaggtctgttctgtgcagggtactggagacatagtggtgagcagaaactgacacttccctgtccccctggaacttacattctagtgggggagg

SEQ ID NO: 177093 - DNA, 231 bp, Homo sapiens
gaagttttagctgtttcctcatgactcaaactgcctctgaacatttctctttttattctaatgctttccttcccccgccttctttctgccaagcaggtaagtgagggacagtggattaagagaaacgttccagttgccttctctcagtttcaccccttgacattttgagcaaacattttcagaactctgatttctaaattttcctggggaatgttctagtgaatatctagt

SEQ ID NO: 177094 - DNA, 521 bp, Homo sapiens
ggaaaattccctgcccaaggatcctgttgaatataaagaggttacagtgggaagcaagtagagaagattaatatgtgtagaagatattagctggggcaagcaacaaagtggccagtcagccaaaaatttaatggcaaaatttggagaaagggacagcctaaggacttccactaagatgaaacttactgatggtggttcagaaatcaatgggaatgcatatagctatgttcagtcaagaaaccagagaagtctctgtgagctattagtagtctccactattgaatctagtctatctaaaccttatcatttccaattaaactacctaaattatctaaatattaggtgtcacactctagaccatttccacaatctttttagctcacttactctactaaatttgttccaatcattcaatgacactgatgctttttcactattcttttcccttcactttctctcttcccaccatacccaaattagattcaatggttcatccctgtaagtcaatcccttgcacacac

SEQ ID NO: 177095 - DNA, 262 bp, Homo sapiens
agtgactccacaaacagagcgcaagcacaacacacatatatatgtgtgtgtgtgtgtctctctgtgtatctgcctatatgactgtctgtctgcctgtgtgactgtgtgtctgtctgtctgtctgcctgtgtatctgtctgtgtgtctgccatgtgactgtgtgactgtgtgtctactgtgtgtgtaccgtgtgggtgactgcatgtgtgtatgtgactgtgtgtgtctgtgactgtatgtgtgtgtatctgtgtgtctgcct

SEQ ID NO: 177096 - DNA, 420 bp, Homo sapiens
ttacaggctggtgatggtgggaaaaaatactgttgccacaaaaaagcgaagaagccacagtacaacatcaactaagattgtatgcttgagatttcacctcaagaggccctaaaagaggttcatcagggcagaagacagttttactttaagctgtcttttagagcttctgaagggatcaagtgagtatgtgataccttttttgaaatttttttttaatacaagtgttcaaagtgtaattcctttaagaatgccaccaaaaattttagcactaaagtagccatgagtatgaaaaggctgagaatcactgttctacacacatccttatcatgctaaatttttttcaagccatgcttcttcacctctcaatcttcagataggcttttccctgtatatggaaccttccaaaataccctcttctgc

SEQ ID NO: 177097 - DNA, 275 bp, Homo sapiens
ttgtgagactttcaaaaggtacccatggggagggaagtgagaggaggaggaggggacggtgaagaaacagcttctttatttctagccttgcttgaatggcttcttgacggttactgctccagttttgctgagtcagaagaatcccacagccgctcaccggaaacacagctgttgggcaaaaataaccacagagctgagcatcatgcaccttccagaaaagatggcagaaaacctcaaaacaaaagagaaatacaaaacaataggagacactgtca

SEQ ID NO: 177098 - DNA, 568 bp, Homo sapiens
agacactcttattcacagaaccagacttccagttcccagtagagggtatgatggtcctgccctgcttgtggacatttgtaatatgaaaccccggctttcaggaacattccatggatttaaaatggagactgctctgaggatatatgacccacactgcagatggatatgaagtagcctttaatcaacaggagaattctagtttcattatgcacttctagcttttggaacaatattgacacctgcagttagaaaacaaaaagcagccgggcgctgtggctcatgcctgtaatcccagcactttgggagtcacagcgagactccttctcaaaaacaaacatatatatatatatgtatgtatgtatgtaaatggtctccagcaggtacagtgaggtatatatggaaaaacatcttgagatttattttgaactttcaaactcagaatgaatagtatattgtgttcaagctattacagattttagactagtggaattctaattaaacaggcttcactgtgcatggattgtctgtagttcactgtcattaagtcctgctgtttttgttagtattt

SEQ ID NO: 177099 - DNA, 588 bp, Homo sapiens
acgaagtgctgccacgaagtgctgccacgaagtgctcccacgaagtgctgcccacgaagtgctgcccacgaagtggctgcccccgaagtggacatttgtaatatgaaaccccggctttcaggaacattccatggatttaaaatggagactgctctgaggatatatgacccacactgcagatggatatgaagtagcctttaatcaacaggagaattctagtttcattatgcacttctagcttttggaacaatattgacacctgcagttagaaaacaaaaagcagccgggcgctgtggctcatgcctgtaatcccagcactttgggagtcacagcgagactccttctcaaaaacaaacatatatatatatatgtatgtatgtatgtaaatggtctccagcaggtacagtgaggtatatatggaaaaacatcttgagatttattttgaactttcaaactcagaatgaatagtatattgtgttcaagctattacagattttagactagtggaattctaattaaacaggcttcactgtgcatggattgtctgtagttcactgtcattaagtcctgctgtttttgttagtattt

SEQ ID NO: 177100 - DNA, 650 bp, Homo sapiens
gtagggactaggaactgctgacaaatattttgtacccttacttcagagcagaaaggctatttgggagcaaaattctctcatggaatgaagagcctgttaagaccttttttcaccaagtaaaacatgaggaagctgtggatgtgcagtttctttcacacctgcaaattacacagcaatcattcacccagcaaaggaacatttgctcctaggggctggagggagctgccgtagggagggtgagaggaaactgaggcttccagagacaccctgtctgcagacggcaggtagctgttgcatgcacctcatcccatttaatcctggatgttactggctccatttcacagataaggggactgaggctcagtgaggttgagaggaggtagtggggctggattacaggggaggggtcactgatgagtgagaaaggtgggttgggggacttccctgaaagcctctctttctctggaacccaggcatctgggcctcctacttttctggctgcccccaaatgtctttgctaagcaacgtagctgaacagtgccaagagatggcagtccctaaggtataacaggaggcacccccttctccccatgggaattggatgcaaagaagggagaagcccatgacgatgttccctgtgggcacgtggc

SEQ ID NO: 177101 - DNA, 373 bp, Homo sapiens
gccaggtgctgcatttgtcccatgtgcccagtccacgggcagatggactgggccaggggggtgacacctggtccaagctgtcccacccaaactctccctagaagagtgtgaaaatggaatgctgaatggaggacaggtgactcagtggcagccatatgtgacccagatgcaaggaaaagcagagacggagagtgaacgaagcagttgtgatgagagtccatggacaacagtcccagagaagcagaaggtcaccttagctgctgacaggttctcctgtcctgtccctggccctcccaaagcccagctgtgtctctgccattgagttctgtgagggctgcccttgtagcccactaataaattatttttttcttta

SEQ ID NO: 177102 - DNA, 183 bp, Homo sapiens
cttgtttgcccaacagctactgagctcagataatgggcatcatagctctgtgggctttgcagtgcaggcctcagaatttaggagactgagcctcaatagttattgataatactaataccatacaccactgaacctaagaagccattgattagaagatgtagtgttattttatatacagctaag

SEQ ID NO: 177103 - DNA, 471 bp, Homo sapiens
tggcctcccaaagtgctgggattacaggcgtgagccaccgcgcctggccagattatgtttcttatcagacttaaagtcagtgttgatgttaaatgctggtgagcttttcctgaattccagaagggaggaggccacaatgaggcctgtctgactcccctcttcccataatggcctgaaccagtctttcagatgaaatttggatggccctggcctagaagaggaagtccattcagatggttggcaggccttgggattttaattttggtttacacaattttgaaattatttgcatataaaattattaggaaaattatttgaaattatttggaagaaagattgttgcctgagttggtctgtccctttctactgtgactggacacaaaatatcagttgtatttggtgcagaatttttctgtggagttgctcctgagtgagcattattgtgcagctctgatactggcctggcccagg

SEQ ID NO: 177104 - DNA, 648 bp, Homo sapiens
tattgtcttgggtatccaaaaccccatttcccccttttttaactgtcctagaaaacatcatgcttccctcctttatgcaggccccgtgcagaccacaggtgctcagatgccaggcaagcctgccttccatgctccctccaccatcgtcctcctcggggagctaacacagctgcttggtgagcatcagtcaatgagggaatccgatacacctgttccccttgacttcagctgtctgattttcatcttcatgaatattaaaaagattcaccttctcctggaatttttcattctccatgcccacatgctttcagacacctctcttctcctttttcatctggacctacattgcaacctttcctttctctttattttctgattatgaaatttggcataccaacgtagaaaatctggacaggacaaaaatacaaagatgccagaggcaactccccttaaatcccatcatctatgggcaactcctcttaaatcttgctacccaggggcaacttcccttaaatctcacaatccagggacaacttcccgtaaatcccaccactcaggggtaacccccgctatatcccaccactcaggggcaactccccttaaatcccgccacccagggacaactccccttaaatcccgacactcagg

SEQ ID NO: 177105 - DNA, 259 bp, Homo sapiens
ctcaagcattcctccagccttggtctcccaaagtgctgggattacaggcatgagccactgagcccggcctaaattgtattttctttttacttaactctttttatagattcaattaaatgtttgcttctacctaaatcttaagtagttagggtccttgggagtagataatgtatttagtaattatttatttttaagaagaaattagaaatctacacctaaagtgaatttctggggtagaaaaatctgggccctactagaa

SEQ ID NO: 177106 - DNA, 406 bp, Homo sapiens
ggtcaagtgtgaaaaggaaaaaaggaaaagaaatatggattcactgcacagcacagtgcagtgaggagaaacaacattcagagaggcagcaggggtggggagggagcaggaaacaatcttgttgaaggagaaagcgaagaacataaagaaagagaaacttttatttaaaaataagatgagaggtgaaggcgagggattgcctctgaccttgttgtccggggggagtgggagtacctggattcaggaagggactcttcctgatcttatcccctgaatttacctagctcagtgcctgagacagggaacccactttctaaaggtttgacccaaggaaagtgaaacaatcaaaggtgcatgatacctggaatgagttcacggcatgcattggttgggggctgctagtgct

SEQ ID NO: 177107 - DNA, 510 bp, Homo sapiens
ctaactgtttttccccacagactcaattaagagcctgcaccatttaccaggcattgattcaggcattttgagggaagtgggctgcaaagagcagctgaacgcccctcagctccacagcggtgcgaggttgggaggggtgagcagcccacactttcccgtggacagaggtcttaggttgactgaacagtgtcggctctcactgttagagcaatagaaacgagagggtgggagaaaggggtgcagtctctggggtcaacgtgagtgaattcagggcataatgaagcacttcataatagcatttcattacagtcaaatatgccacagcctaaaggccatgatttaggagatgagcccacgtatttacgttcacaattccaagtggacccatgtaagacctcatttttataatgaggagatggaaaaagcattatttacacccaatcaacaaattcatagaatatgcaggaaatatgcgagggaagggaaattatccaacctcctgccttcccc

SEQ ID NO: 177108 - DNA, 505 bp, Homo sapiens
cataggacctatcactatgtaaaatattatacatatctactgatttatttattgcctatgtacctatactagaacatagtaaacatgagaacagggaatcttggttattaattcctgcaggactcaactacttatcactcaaacatttgttcttgaaaagaacttcgtataacatcattagatttttacagaatctttaaaaaagctttaatattttcaaggttttttatttatataaatattgttactttaccactagtgatttcaatagtggcattgtcacatgattcaagaagaggaggccattacattactgttgtattaaaaagtcagttcaggcttaatatatatgactactataagtcaacctcacattttaatgtatgaagaagattgtatgaacgatcacattaattcatttaaatagtatgtattttgatactaatttttaagaagaaatgtatcattctcatggaaataaaagataatttgaaaagcatgttgt

SEQ ID NO: 177109 - DNA, 236 bp, Homo sapiens
tcttgctcacaaggatcttcttttaattccagcccactactaactttatccaagtctccactcactcacaaaccacacagcacttactcgggtcctctccatctcttcatctaataggaaggactgatagcacagaagtcatttcccttggtcacatcagctgtcatgggtgacaggtgtcccctacatggcctatgaggtgtcttccttttccatctctaaactctcagattatc

SEQ ID NO: 177110 - DNA, 1837 bp, Homo sapiens
  misc_feature (1363)..(1363): n is a, c, g, or t
attaacttacttgttcacttggtgtatttgctccatttcccaaccattctgtctgggttctccacctccaactcctaccacccactcccttaacctggcacagggacacctcttttggcacctccacccctcacttcctcattttcttcatgccaagagggaaggtgtcaggaagatgggaagggaaggactgcttttgttttgtaagtgatttttattttatattcctaaatcagtggtttgcagacttgagtgtcttggcttaaatgcagcagtactctaccccagagatagtgaatctccattttcagaggccttccctagttctgcagtgactgatgccaatggtacacagatcacatgctgagcagcactcctgagcttgctctgaagagctgggggtctgctgaggaggtgtccatctcacagatacggagcccctgctaagtgctagacattgaactggatgccgggtcatgtggggttaggagtacttataagcagggcttgctttgcttttttttatttccttttccttgcctctctcttcctgtccttccttattccctttcttctctcctcctctcttcattttctctacaattttttttctttgaacagggtttatagtttctagtctctgatcatataaatttgctttgggaaactttcccagcatttttcttccaagacgcaagcacctgctctgctgtgctttaattagacctgcccgtgtcactcctgtttgtgctttagcaacaggaacgcacctgggcctcctgaacactcacttgcttcagcttgccagctctgagcttatcttgttggctacagttgatcacaagagagtgaagcagtgtaaacgtcggagataagttgtagtcatttttaacattttaagtaagccaactcagctaccagtttttcaacaaactgaatttataaaaatgattttcatctcagtgtgcctgtgttgcctcacaagcctcaatgccaggtgtttggattgcaaggtgagactgcatagtaagcagccacacatccaccaaagggccactgctgcagccacggagcacaagcaaggcgaagtgccatggggcgttggcctgctggatctcatgtgacttcagggcttagattctgcatccatttctcagtttaacaaatgtgccaacttagtgtgtgcctcaacagggcctcatgggaatgactgatttgctgcctgcaaagctggttgagctcctgtttaaaggcactgtatcagtgggtgatggcagggtcagtgctattagcctaagatgaaaacacacagcaaaatgagtcacctggataggaaacttcttaaaaccaaaaaaccacctcnccgtgatgtgtgtggaagctcagttcccttgcggtagagtcacttcttttttggcagagtggagtcttcttctgttgcccaggctggaatgcagtggtgcgatttaggctcactgcaacctctgcctcctgggttcaagcgattcttgtgtcttagcctcctgagcagctgggattacaggtgtatgccaccaggcccggctaatttttatatttttagtagagacagggttttgccatgttggccaggctggtcttgaactcctgacttcaagtgatccgcccacctcggcctcccaaagtgctgagattacaggcgtgagccaccacgcccagctgtcacttccatcacagttgtataaagcctcattaaagatcgcagtgttgctgtagcgacatgcagtgctgtagtcagcatctgccatagtatcagagccaacagcccatatgacagctgtcttcttctcaccccaaa

SEQ ID NO: 177111 - DNA, 134 bp, Homo sapiens
cgtggtctgtgtttgctacatctttgtttacaaagtctaatgccaaagtaagagcaaaaacgttattagtgaagatccctttgaagactttttttttttttttttttgagaagaagtctcgctctgtcgcccag

SEQ ID NO: 177112 - DNA, 755 bp, Homo sapiens
gcggaaggtcccggcggcggcgaggatgcgccccagggcgggagcgggacgctccactttaccctggctgcccgcaacgggccaggcctgccgtctctacctctctacctgtgagttttttccctgcatttacttcagtctgccgcgtcttctccccgcccttctctgtaaggtaaatatgtggaggaaataattcctattaaaggtaaaggtaaggagagcaatttgaatgaagaaacaggtagttgctatcgtcgttttcagccaaagccctctggctgctagagagtatacatggttctctggtgtcaaggcctgttttccataagctttctggattctcagcttagttccctcaaagtgatctctgcaagtcggctcttcggtcagaagacctcctccaaaaacagaaagcccaaagattccctaactcgattgaaaagataggaagatacgaagaaaaactaacctaaagaattgtgtggtttatctgcaaagagttctagactaaaagccaacaatgcaaagatagtatgagttaatatgtttgttgtggctctcttctgccattcccgcttcctcaaggtaatgtgccccgatgcctggtagaactgttttgtagaggcagccaatagtgatccagttatcgtctttactggtcagaccacctctgaagtgctgtgttcagcatttgaagactttaatcagctggcattatatcagagagagcagcaaaatgatgacgagaactcaaa

SEQ ID NO: 177113 - DNA, 472 bp, Homo sapiens
gcggaaggtcccggcggcggcgaggatgcgccccagggcgggagcgggacgctccactttaccctggctgcccgcaacgggccaggcctgccgtctctacctctctacctgtgagttttttccctgcatttacttcagtctgccgcgtcttctccccgcccttctctgtaaggttgtatccacgagtaccagcagagtgcctgacacatagtagacataagtttctgataactttggaaatgtgacattggaataaaggaaaaatgcacaggactcatgaagagccaaaatgttcactgataccaagcaacacaagagttaactaaatggactgaactcatagaaaactgaatcaatctttttgacttttgcatggaatattgctgatccttgttttgtttttcagagtccaggaaatttattttgaactatttacagcctttaataattgagaaaattatactcctctgaa

SEQ ID NO: 177114 - DNA, 349 bp, Homo sapiens
agagcaatactgtataatgaaaaagggcacgaggaagtgaggaaatttgacaagctgcaaaatgtaccacaacctggccaggagaacacagacctgtcagacaacagttttgagaatcagaaactgtactataatgggagcagaaaatagacaatgcattattgacattattgaaactactctgctacccaaagaatttacctgatacttcctcctccaagtgtaattgattaagcagttaagcacatgtttttctttcaacaccaattcagacatatcagtgtatttgctgattacacatgtaacaacttcaagtattttaactgaatgactgatcaattaatgaaaa

SEQ ID NO: 177115 - DNA, 396 bp, Homo sapiens
atggggtgagcatgtccgcttatctttgaggagggcccggttgcatttgcacatgagccatcatcaaacattaagtcagatcctgtgtagtccccaaaggagaaaatgtcactaaagaaaagttgcaagtgtttagcatgaaagggactactgggacctgtttgtgtctgtggtattagtttttaatcaaattagagtgaaggatagtaacccatgtctctgacctggacttccctgcttcttgccctggactgatctgggccagtcctgtccccaccaccccaaggcacaaggctgcctccgagttctctccagcgtccctccctcagcagcaaacttgtggcagggctctgcagggctgctgtaggcaaagccactcgtccactcagatcccaa

SEQ ID NO: 177116 - DNA, 563 bp, Homo sapiens
aaagcatgacagacagggaaaaggtgccccccacccactcagccctgccaatcagatctaaggaggcagtgcccgttcccaacgtgagcaggccgccctgctctgcgtggactagcgagctcatttcctgaatgggtattcttgattctaatgaaggaatgccccctgccacctgaatgcatccaaagccagctcaggagttaccagctcaagcagcagcttcagcggacgctgctgccatgcacgggacaaactccgggaggcagtattcccccgactcaggtggcaacacagccattctcaggcctggcttagttagagagcacttgacttctacagatcccagggttaaagccagacctagaaacctgatggctggcctgaacgggcagaggcaaacaaattgccaggaagccaccagggcagtcctgggatcaagatgcttcagcctgcctctcccgtaacaggggaggtactgagattgcaagtggagagtctcctagccagaggggtcgatttagcccaattcagcactctaaggtaaaaaagggaaactaaaccat

SEQ ID NO: 177117 - DNA, 729 bp, Homo sapiens
ggagtccctctttccccggggcagagcctgagcaattgtcagaaatacttctgagccaaaatgttgtgcttttgagacgttaccttgttaaaacacacacacagggtggcgtacggttccatcttcagggagtgccgtgaacataatggcatgtccatagaaatagaaagcaggtctgtggtccttagggctggggagcccggtgttcaggggggcttgctcagcctacatggcttccttttcaactgataaaaatacttagggaccagatcgaggtggtggttgtgcaacattacaaatgtactaaatgctgctggaattatcactttgtaacgagcagttggccggacgcagtggcttacacctgtaatcccagcactttgagaggcctaggcgagtggatcacctgaggttaggagttcgagaccagcctggccaacatggtgaaaccccgtctctactaaaaatgcaaaaaatagccaggcgtggtggtgggcacctgtaatcccagctacttgggaggctgaggcaggagaattgcttgaatccaggaggcagaggttgcagtgagctgagatcatgccactgcactccagcctgggtgacagagtgacactccacctcaaaaaaaataataaataaaattttttttacaaagtgagcagtttttggctgggcgcagtggctcacgcctgtaatcccagcactttgggaggccaaggcaagtgg

SEQ ID NO: 177118 - DNA, 492 bp, Homo sapiens
aggaagtgatttgttcctgaataggaggaaagtggagggtgagtgcaagagaaaagggagaagttgaagatgtttatgtcagatgactctgaccacaaaggtgttaatcagaagatgttacagttgagccagactttgaagaatgttacaacggccaatgactggaagagacgacttcaagtgatgttctgtatctactatccaatatggaagccattagccatttatggctatgtgtaggaaagctgcctgttgcatggcaagagtaatgctatcttgaagtgaaacatcataataaccagtgtttgactcttgcataccaaggcattcccccagcaaggtgaagaaacaatgcctataacatagataacccctcataaagaaacaatacctgtagcatagaaaacccctcataaagatccttatctaattttcccactggtcagagttttgcaagagggtctcagacatgacaagctgcacgttttacca

SEQ ID NO: 177119 - DNA, 285 bp, Homo sapiens
tagatattaaccaacacagattatcagagatatttcaccttagctctgttttctttcttctgtctcaatagagttctaaacttaattataatttgaactataatgcccatgtatctctgggtcccaagtgaagcataccactagctgagggacacaggacctggaagggccttggaaatagatggcagattggagtccatgacgatggagaagtgaaaacacacccccaaatcttgaaactttatgaatgtatagaaacttttttttttttttttttgagacagt

SEQ ID NO: 177120 - DNA, 385 bp, Homo sapiens
taatggatatacacaattctgaagaaacggcattcgtattatgtaactcttactgaagtacagacgaggttttgctatgttgctcaggttggactcaagcgatccactcacctcggcctcccggagggctgggatcacaggtgcgagccaccgcccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtgg

SEQ ID NO: 177121 - DNA, 559 bp, Homo sapiens
tctagaggatcccgcgacactcgttgagtgtgtaaataaatgcctcttcaatttttaaaagtctcatttttgaggtttaaaatcagttcagcttttcccattttgcaaagtgccaaatttctgagatctctctattccctttcctttctgcttgcaagatgtctgattcattcagaagctcatatttttggtataataccttgccaaatgcagtcggcaatgactaatatacaccattaacactaaaatttccaactgtttctcctagagctgtaggtacattaggtatattatttgccttccaagtaattgcaggtattagtttggccaaatatttcaccacttcataatttcacttcataatttcataaattcacttcatgaattgtcatccttctgctttccgttaatagtttcccagccactcattgcctgactaccaagccagtaccaaaattttaggtttctgttttaggagcatcttcttttgatactaatttcagtataacctgattaggctgggttatgttgcagtaattcaacaaaattactggttgtt

SEQ ID NO: 177122 - DNA, 579 bp, Homo sapiens
aacgctccccgcagccaccgccacccattggaatggccaacaggggacctgcattatggcctgagccaggaggtgcagcagaagattgagaaacagtatgatgcagatctggagcagatcctgatccagtggatcaccacccagtgccgaaaggatgtgggccggtcccagcctggacgcgagaacttccagaactggctcaaggatggcacggtgttatgtgagctcaataatgcactgtaccccaaggggcaggtcccagtaaagaagatccaggcctccaccatggccttcaagcagatggagaagatctctcaggtttccccttggccaaaggccagagggcttgaaggcccggcttaatggggccaattttaaacaacccaaacttgacatcttccaaactgtggacctctgggaaggaaagaacatggcctgtgtgcagcggacgctgaggaatctgggtgggttggcagtagcctgggatgatgggctcttctctggggatcccaactggttccctaagaaatccaaggagaatcctcggaacttctcggataaccagctgcaagagggcaa

SEQ ID NO: 177123 - DNA, 422 bp, Homo sapiens
caaaaattaggcagcgtggtggtacacacctgtagtgccagctactcaggaggccaagacacgagaatcacctgaacccagaaggcagaggctgcagtgagccgagatcgcaccactgcactctagcctgggcgacagagcaagacattgtctcagaaaaaaaaaaaatacagaactgaatcatctaaattactgagaggcaccaagcaaagcacaggcagcggcactgaaggccctgccccacacaggatctggcattagtgcttcagctgctgaattatggagaggtctcaagagtcccaaggcaggggcgtggcaggaggggagcttgtgggactcaggccatcatttatttgcaaactggatgaaagagttgtgatgtcagacctgccgctgcctgtcagccctggcatacagcacgg

SEQ ID NO: 177124 - DNA, 507 bp, Homo sapiens
acaatatggcatttactgggtgccatgtcctggagctcagcagagcaagtagtgctgttatccccatttgcagataaagaaagttaggcacaaaaagcataggtgactctcccgaaatagctagtaagtcagggaggggaagtctgaagccactgtcccagactgcagagctgggtggctcaggccaggtgcagtacacctgctgtggcccagcctcttatctgctgcctacaggggtcagggcttggtgccctcagcacccactgctgttggccaggtaaagagcaccttcgggtgctgcccacgccacctcctatggctcccctgattcctgcggtaggcagcagggcctggtcccctggaatgggtggagtatgtgtgccctggttccctcacccaagcaggcccagctgcggcagggacagatccaagccacagaagacgctggcccagaaaaggcaaacactcccacagagcccctaattacggggccaatgagcgcggccg

SEQ ID NO: 177125 - DNA, 366 bp, Homo sapiens
ggtcatagaggaccttaatctccaggcagaattcagggaacccactaaaagaaagaggcagaatcaaaatggaatatagaaaacattgttgccctttcacaatacaggcataacagtaggattctacaagaaacaccaaactggcatgccctttcattccacagtaccagctaacagccctgttcattttaaagaattagtggagtaaaacagtcacccaatccaaaaaagagaaacaccaaacaggcagccacaaagaaggtcttgacgaaaccaggaaagggtcaagggcattgggaagctgccttacaaggccaggcaggaaagattaaagcaaaatagttggggaagattaaggatagaggg

SEQ ID NO: 177126 - DNA, 95 bp, Homo sapiens
caaatcactatcatgtttaattaagaaaagagaaaagagaaaaccccaaatacagaaaactaaaaaggaattgatatgatagaaaaagtgtaaca

SEQ ID NO: 177127 - DNA, 153 bp, Homo sapiens
cttgaatgtgacaaaatgggaaaattaaattaattaaaacttgagccttgaatgtgacaaaatggggcgtatgaacaaaatacttctgcataccaaaggatggtggttgtctcaaggaaaatcacttatttatgcaattgtttgagttgtaag

SEQ ID NO: 177128 - DNA, 367 bp, Homo sapiens
ccgctaaaggactctcatgccataaacaaagtggtcccaccaggcggccgctgttgggtgacagtcaagatggctagttagcggttcatttagcaactgctttaccttcccaaaattatgttcccgtattttgcttctgctaatttcactctggtttggcaaagtccatgtgctatctagaaacagcatgatgttttgatgccccctcttgagtgttttagtcatgatcctctcctctctctggggcttccctatctgactccgcaggctctgccccatggcgcctcaggcccgccctgctggccttttgcttgcactaactgggcagtgaggcagtgtgactttcatggacgttgtttggtttcag

SEQ ID NO: 177129 - DNA, 558 bp, Homo sapiens
ataaacaatccagcaccttccctagtccaggcctccatctccaactttcaggtcatttccacttactatttcactttttcccaattcagcacgtataaatcccaaatttaacatccattccccaaaacagccccatttacaacttctgttctcatgtatgatcctacaattatttccatgtattcaaccgaatatttttgtaacatctttcccaccaaaacctgtacggacaatcatggggctcttttttatttcaacagttctctcatgtagtttctttactatttccagtgcctagaacctggtcaaagccttcaagaccctcttctttaaaaatctttccaaaatttaggagtgattacaatgaccccatttaagacactaccaaaagttccctattgcctacccagcaaacctaaaacttttcagctgtactatgcaggcttccaatctactgacagcttccccccaaaattatcactttattcctctactatctcccaaacatatcatgcacatggtcccttcagtcaggcaacgacccaaaggggatgcagt

SEQ ID NO: 177130 - DNA, 381 bp, Homo sapiens
tgctgggattacaggcatgagccaccatgcccagccacctggcccgtagtttttttaagtattaaaatgatactagaacagacgtagtcagttggtgatctttattaaacatcgtagtcccatacacagcagtttattgcctactaatatttttgtattacccacttgttgaagaaattatcactaccattatagttttgcagtgtctttagctcagtcttttaaaatatgaagcagaaagtcatattttcagctttatcagtgaatgctaatgcactaacaagatggaattatgagcaattataaaaacttcttgttcttaaaatggttaccagtaagttatattctttaacttgacaagattttactgtgtttcatttc

SEQ ID NO: 177131 - DNA, 322 bp, Homo sapiens
cactttgattgttggtggcactttgtactgcctgtaggactgtgggcacatcgtttttaacttgtatgagtctcactcttctcatatgcacaatggaaaaaataatgatgaagatttaacaaaatgacatctgtaaggccctccagctgaagctcaacacatcctgtcctcttctcccccgatccctgctctttgcccctgagatggtgttgattccaccttctacaacacaaaagtgtgaaacacaagagtgttcccttggccccaggagaggcctctgaataccagaagacagccatgctggttcctgagtccctttctc

SEQ ID NO: 177132 - DNA, 432 bp, Homo sapiens
ccaacacatgaaatatttcaaaccatagcattccacccatggccccccaaatatatatacttgttcacagtgcaaaatacattcattccatcccagtggcccccaaagccttaactaattccagcagtaactcaaaaatctaaagtccaaagtctcatctaaatcagatatggatgagacttacagcatgattcaccttgaggcaaattccttccagatgtgggcctgtaaaatctatttccaaaatacaatggtgagacaggcattagacagaaattctcattccaaaagggataaataggcaagaagaaataagaggtcccaagtaagcccaaaacccaacagagagcattatgtcataaagccagagaacaatctcctttgactctatatcccacatcctgagcacactgatgtagggattgggccacc

SEQ ID NO: 177133 - DNA, 807 bp, Homo sapiens
gaacgtcttgggctccattgtgtctctaagatcaggtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcatagggtgtgctgtgactccaccccatgtctgcaggagccccgaggcattcgccccagtgagctgacagatgacaccatgactaagaccttcatctgggactttatggcctgctagtatgttcaaacctcttgagttcttggcctcctggatatgctataaaaatggcatctactctacttatctctctggggtgtgttcacagaaagctggagcaggagtttgaaaagggcggtgatggtgtggatgtaaagttatcgtctcggctccctattgcatgggattacacattattgatggtgcaagacagtcactcactctcagccacagagacctcttggcatcctgtgaaagggcagggttttctcttcgatgtcacattagaaagttagatgtgtatctaccccaagcataccttccttcctgaaacataatatgtaacttaatatcctagagtttaaaaggcccccaaggtgctttctaatgtatttactccaagttataaagtttcatgattttttaaattaatgaatttagtgtgaaaattaggaaaaaatgtttcaaataatcatgaattgagtgt

SEQ ID NO: 177134 - DNA, 678 bp, Homo sapiens
atcatgatcctacacagaaagatggggatgggagggtcagagcaaggaaagaacagcacttccaggtcacttcgcctcattctggactccccttttccagggtgtgctgtgactccaccccatgtctgcaggagccccgaggcattcgccccagtgagctgacagatgacaccatgactaagaccttcatctgggactttatggcctgctagtatgttcaaacctcttgagttcttggcctcctggatatgctataaaaatggcatctactctacttatctctctggggtgtgttcacagaaagctggagcaggagtttgaaaagggcggtgatggtgtggatgtaaagttatcgtctcggctccctattgcatgggattacacattattgatggtgcaagacagtcactcactctcagccacagagacctcttggcatcctgtgaaagggcagggttttctcttcgatgtcacattagaaagttagatgtgtatctaccccaagcataccttccttcctgaaacataatatgtaacttaatatcctagagtttaaaaggcccccaaggtgctttctaatgtatttactccaagttataaagtttcatgattttttaaattaatgaatttagtgtgaaaattaggaaaaaatgtttcaaataatcatgaattgagtgt

SEQ ID NO: 177135 - DNA, 303 bp, Homo sapiens
gcatcatcactcctgcctgcctgcccaaccgacctgtcggtggactgaatgggccaagtgttcagaagtccttgggaagaggatagtgtcctgaatcataatgtggtattttctggttttttgtttgtttgtttgtttttggtaaaatgttaattgcagaagtatacaggttattttatttatttatttatttttttttgaggtggagtcttgctctgttgcccaggccggagtgcagtggcatgatctcggctcactgcaacctccacctcccaggttcaagcaattcccctgcctcagcct

SEQ ID NO: 177136 - DNA, 277 bp, Homo sapiens
gagtggattgatagttcctttcaattttcatatgtagaactataattgtaaagctgtgtaacatttgatagtattaaatattaaaccactgtgtaattaaagcccaaaatgtcaaacactgcagcataaactacctgacaggcctccaaatgccctttcaccaaggtgtgatttctatttattttgctttgttgttatttttgtggttttgagatgaagcctcactctgttgcccaggctggagtgcagtggtacaatcatagctcactgcagcctc

SEQ ID NO: 177137 - DNA, 456 bp, Homo sapiens
agaccgatactgaggagagcagccagaaaagtagaagcaaaacaaggaaagtgtctttcttcagcacctagaacagcccaggcaatggtaggtcctaaaaaaagcacttgctgaatgattgagtaaacgaatgtgcaactgatgtcaaaaaagatgggaactgaaaaagaccatataatttagtaaaatgaagatttattgttatctttgataagtgtactttcagtgaaggcacagaagcaaaatcctgactgcagaagagataaggggatatgtttatttggaaacagtgagtataggtaactcttttaaggacatgaaacaggagggcatgaataaaaaggaagacataaatagctggaaggaaaagagactgtggttttaagatacaagaaataagagcgagtttgatctagtcgagaaagaaaaatcggtgaggcaagaagggttggaatc

SEQ ID NO: 177138 - DNA, 335 bp, Homo sapiens
atgctgtgaagagatttaaaacagggtaataatgtactagacaattcctagctgctcagtgaaggcctctctcagggtggcataaatagtggctcacgcctgtaatcccagcactttgggaggccgaggcgggcagatcatgagaccaggagatcgagaccatcctggctaacacgatgaaactccgtctccactaaaatacaaaaaattagccaggcgtgggggcaggcgcctgtaatcccagctaatcgggaggctgatgcagaagaatggcgtgagcccaggcggtggaggttgcagttagcagagattgcgccactgcactccagcctggg

SEQ ID NO: 177139 - DNA, 441 bp, Homo sapiens
taaaatatatacattaaaacagtctatatttaaatgagacaaactgatcaaattgtcaaaattcagtagcctgaagaagagcagatgcttcagagagactaaaatatgcagatcatgccaagaccacattccaagcaggtggcaaaagaaattacacagttctatagtcagcaaggaagagataccccaagaaaatatgctgaaaaatacattgcagctatgctatggccataggacaactaactttgacttcaagcagcaccactgcactcccaatctcaaggtcaatgccaaattaattttaccttcccaccatgctaacaattaaatacactatacacacgcacaaacatttcagtaatttcattttaagcagaatgaacttctagaacgggtttctgaaaatactataagctaatttaaaacaagcaaacttaagta

SEQ ID NO: 177140 - DNA, 406 bp, Homo sapiens
tggagaaacccctccacccacaccccccttcctggaaatagctgtggttggaagggaggctgggagcccggccgccgcggaggaggggtaaggcccagggaaggagcgagggagggcggcggctctgggggtgttcccagaagggtctggaggatgggggcagactgaagggggccgcagagcggggctggcgagtcgaatcagcctcatctgtgcccgcttacggcctctgtcccacatgtgaagcaggaaaggaaaacgttcgcccgcaccctgccaggccggggcccgagcgccgctgccagctgctgccgggtcccgggcctgcgtgtgtggcacggcgtgcggccccgtgcgccccgggtgctggaaggcgtggcggcctgatcgagtagggccgcggccg

SEQ ID NO: 177141 - DNA, 213 bp, Homo sapiens
gctggctttcaaccctcacctacctctttgagagcacggcatcgtcactcccacactaccaggctgtgccccctcttctggggctcctcacctgcaaatgctgaataacccaagtctctctcatctttaaaaaacaaccacccacccccagacctccaactctcctgaaaagtgactcagcagtaagtgtcaagagtcctataagtgcccata

SEQ ID NO: 177142 - DNA, 197 bp, Homo sapiens
tgctacccaggtctatcaagttgggctcatctcccagggcccagcacaggacctggcagctctgaaatgaaataggtgcctaataaaggagtgttaaataaatgaatggatgcacaaatatgtttatgaatcaagcaaatcactaaataacattcatggcagaggaagctgaagttcaaagagaaaacttattggag

SEQ ID NO: 177143 - DNA, 315 bp, Homo sapiens
gtctcccctttctaccagggaagtagcccctctgtcttccttccccttttttgagggaactgagatggaactatgagtgttgttgaatttcatcaaagtcttagttccagttggaagctgcagtccgctccgtctccttccagccagaggaaggatgacgaccagcagcacttgggtttttagttttgtcttgtaagcattttggtgggtggcggtgggtgactattagggacactgactccactgtctccagaaagtagggatgaaaaggatcactcctttcaagaccttgagcttcttcactttaggtgaaga

SEQ ID NO: 177144 - DNA, 1079 bp, Homo sapiens
  misc_feature (4)..(6): n is a, c, g, or t
ggcnnnaggggaaaacaccaagtccctggacaaggggaagacaccaaatccctggactcaggcctcacatgattgagtgagaggaactctgctgtcagaccctacaatgcactcttcagtggaagaggatcacacattccaaacatactccatcaggtcatatgttaaatgacagggctgagacctctccacagcacatctgatactgggatcgatgaagatcagatgtgcaaatcacactgggctccggaaagccctagactgtgtcattcaagatgtgtgacatggataaaaagctccccatagtggaaagaggtgccataaaacactagacaatgagagcaagatgggggacccaaaatggtgccctggcatcggcaagtggtgaaaccagccatctggccctgtgccctgtcctcagaagtgcccctgccgccccagcaggtacatttgcaggtgaagaatttctttcgctttagtgtcctgggaaccaagtattttctgttggtggtgtttctcttgcaccagatgaatttttgcctcgcttacctgagacttagactgtcccaattccagtctccactgatgcaaactaggttggttcacaacaggctgccataaaatttctcatttttttctgtttgaaatgtgtaacttttgatttacttcctaagtaagacttcctgagttgggagctctaaaaactttcattaaaaaacagtggatttgtcaaacttttgagcaaagtattggtggcacttctaaatctttgaatttaatttcttcttttaggggactcttagaaagggaaaatatgatcttactacattgaccatgcaaattctgaggttcatattgaatctaaagtcattggaaatataaatctcaataaaatccctaatactaaatactcatatatatgtatatattgcccatagacatgtagtatgtattcatgtatcatatatgtataggtatatatatgttcatatgtcatatattaaatatgtatgaatttataagataaaggtggaaattattgacatgttataactaaataaagaaaatctttaacaacc

SEQ ID NO: 177145 - DNA, 472 bp, Homo sapiens
  misc_feature (459)..(459): n is a, c, g, or t
gggaatgacccccactgtcttctcctcccaacacactgcagggggaatgacccccactgcctcctcctcccaacacactgcagggggaatgacccccactgcctcctcctcccaacacactgcagggggagtgacccccactgcctcctcctccccacacacactgcagggggagtgacccccactgcctcctcctccccacacacactgcagggagagtgacccccactgcctcctgctccccacacacacactgcagggggagtgacccccatattttaatgcagtggtttctctggtcactcacggtccagcactagcacgcagcagtcggggaaatgctgtgggtatgagacggcctggattttgaaggcgctgcatgaaaaagaatgtagagaatctgaatgcattttatgtatagattgcatgttgaaatgatgctgttggtaccgtctaagngatgtctagatca

SEQ ID NO: 177146 - DNA, 290 bp, Homo sapiens
aggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattctta

SEQ ID NO: 177147 - DNA, 320 bp, Homo sapiens
tcaaactaaggtcactaaccaataacaagacagtatgtaaccaccgtcacgattatttagatcgtaaataagacatctataaagaatagtaacaatatgtctggcactgtcataagcactttacatatattaactcataactttctgagtcaggaatcactattattcccaaggggagaaaaacaaagattcagaggtattggacaactcttgacaaaattacacaggcatgaaataatggagacagattgcagaattcatcaagactgggcctggaggcggccaccttcttcctcctccctttggtcaatattcagagg

SEQ ID NO: 177148 - DNA, 516 bp, Homo sapiens
ctgatcatcagtgagccaagcctggaagcctgagccatcaccagctgggtggtagccagctgtggctcagggccactctagaaacacttgccttgggctgcagctgccctgggctactaccctgatccctaggaaacggggcatggggcattttcctgaacagagcccttgccaatgcccagcaagaaaccagtgtggcactgggattggaaagcctggagtgtgaatatggactctgatgtgccaacttacagaagaagcataggcaagattcttagtctctacatcaagctgagtccttgaagtggtcggagggacaaaacagaattcctggagacagtgtcctaagggagtgccagaggcactcatttgtttgacaactaattttggaggcaggtgctcttccttgtcttaggatcttccagtcaacaaggctgaaaatctccctgcctcctggagcttgcttctgtggaagaaggcagtcagcaaacacatgaacaaagacaagttcaggga

SEQ ID NO: 177149 - DNA, 257 bp, Homo sapiens
caaaaagtttactacttttggtaggcttgatcattatattgttaaataatcagtataaagttcagggaaaagattagcagtagaaatgtagatttgagttattctctgataattgaagtaaggaagtttaaatcatgagaaaggaaggtaaaaaatcatgcttttaaagattacggtttattttggggtggaaacagggaaaatattgtcattgaggaagttaagcttttcaggactggagaaagagaaatacagtg

SEQ ID NO: 177150 - DNA, 433 bp, Homo sapiens
atggctggtaggagttaagagtgacagctctggagtactttagatcagggcaggattggctacataatttgcaaaatgaaaatgtgaggccccttgttccaaagttagtaaggctggagcaaaattgttaaggtggcactatcacagctcactgcagcctggacatcctgggctcaagccaacctaccccctcagcctcctgagtagctgggactaccggggcgtgccaccatgcctgggtcatttttttgtttttgtttttaaagaaatgagagtgtggctatgttgcccaggctggtctgcaacccctggtctcaagcaattcccatgccttggcctcaaagcagtcaactaagcgtgggtcccagcccctggaaaccagccctgcatctgaggtcacactgcttgcctgctggttaaccttaaatacctc

SEQ ID NO: 177151 - DNA, 673 bp, Homo sapiens
tctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtga

SEQ ID NO: 177152 - DNA, 1524 bp, Homo sapiens
agcgggggaggctcgcgcaggagccgtgagtggcctaaggtgaatgactcatatgattggctgtcccgaaaaatgaaacgtctttgtggtccggggctgagacccacgaggagactgggcgggatttctgacgttaggaggcggggcctttcggctttgggcgcgagtggttaaaagacagttggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcattaaatgtttggtgataaaagagttacaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatatctctttgtacttgttgatttttttttacagactttacttcagaaagggaaagactgtttagaaagaatgcatattttttccctatttatttctgtggtttactccttttgcagtttaacagtgtttggtatcgatattgtataatgtagattgctatcattaaagtggcttatcagatttatggttggtgttattactttgaggtttgcagttgtgttactaataatttaaaaattattgtctgaagggtcattta

SEQ ID NO: 177153 - DNA, 1898 bp, Homo sapiens
ttgaatgttaagtagagacggggtttcaccatgctggccaggctggtctcaaagtcttgacctcaagtagccagccaccatgcccagctgatttttgtattttcggtagacacggtgttgtaccgtattggccaggctggtcttgaacttctgaccttgtgatctgcctgcctcggcctcccaaagtgctgagattacaggcgtgagccaccgcgccctgccgtattttatttatttttgagacggagtctccctctgtcgcccagcctggagtgcagtggcgcgatctcggcttcctgcatcctctgactcctgggttcaagcgattctcttgtctcagtctccccagtagctgggattacaggcacccgccatcattcccgactaactttttttttgtacttttgcagagacggggttccgccatgttggccaggctggtcttaaactcctaacctcaggtgatccgcccacctcagcctcccaaagtcctcggattacagctgtgagccagaacgccaggcccctgctctctatttaaaataaataaatagggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatatctctttgtacttgttgatttttttttacagactttacttcagaaagggaaagactgtttagaaagaatgcatattttttccctatttatttctgtggtttactccttttgcagtttaacagtgtttggtatcgatattgtataatgtagattgctatcattaaagtggcttatcagatttatggttggtgttattactttgaggtttgcagttgtgttactaataatttaaaaattattgtctgaagggtcattta

SEQ ID NO: 177154 - DNA, 1293 bp, Homo sapiens
ggtctactcaatattaaagaatttcttaggttccgtgaaagagccagtgctgtagtttgaaaactgattactttgaaagaaaataacatgggcattggattcaaagccttaagctattttcagcctgcttataaaatgagatgagaattttaaaaataaaattatgtttgactttttttttttaggcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatatctctttgtacttgttgatttttttttacagactttacttcagaaagggaaagactgtttagaaagaatgcatattttttccctatttatttctgtggtttactccttttgcagtttaacagtgtttggtatcgatattgtataatgtagattgctatcattaaagtggcttatcagatttatggttggtgttattactttgaggtttgcagttgtgttactaataatttaaaaattattgtctgaagggtcattta

SEQ ID NO: 177155 - DNA, 862 bp, Homo sapiens
  misc_feature (692)..(692): n is a, c, g, or t
  misc_feature (733)..(733): n is a, c, g, or t
  misc_feature (735)..(735): n is a, c, g, or t
  misc_feature (740)..(740): n is a, c, g, or t
  misc_feature (857)..(857): n is a, c, g, or t
agcgggggaggctcgcgcaggagccgtgagtggcctaaggtgaatgactcatatgattggctgtcccgaaaaatgaaacgtctttgtggtccggggctgagacccacgaggagactgggcgggatttctgacgttaggaggcggggcctttcggctttgggcgcgagtggttaaaagacagttggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagggcgggagagacgcanaaggaaagggggcggggggggcggggggggggggaaaccanangaccnaggcgagggggggggcggaccaagacggggggggccggaaagacgggaggccgcggaacgggcagaaaagccgggaggaaaaggaacggcagcaagaaaccgggaagaggaagaganccaca

SEQ ID NO: 177156 - DNA, 1527 bp, Homo sapiens
agcgggggaggctcgcgcaggagccgtgagtggcctaaggtgaatgactcatatgattggctgtcccgaaaaatgaaacgtctttgtggtccggggctgagacccacgaggagactgggcgggatttctgacgttaggaggcggggcctttcggctttgggcgcgagtggttaaaagacagttggtgtcggttcggcttctcgggtcggattccgcggtcccaacccttccccatggccgaccctgaggagttgcaggtttcttcgccgcccccgccgcctccctcttctccctcctcttcagacgcctctgcagcatcttccccgggcggcccagtgagtttgggctggccagttccgagcaggagcagcggcccaacggtggaccagctggaggaagtggagctgcagatcggagacgcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatatctctttgtacttgttgatttttttttacagactttacttcagaaagggaaagactgtttagaaagaatgcatattttttccctatttatttctgtggtttactccttttgcagtttaacagtgtttggtatcgatattgtataatgtagattgctatcattaaagtggcttatcagatttatggttggtgttattactttgaggtttgcagttgtgttactaataatttaaaaattattgtctgaagggtcattta

SEQ ID NO: 177157 - DNA, 1311 bp, Homo sapiens
aagggactccaagtcccagccggggagcggtgaaacagccacagcgcggccagaggggtccgcgaatcccacagcacgacgcacgcgcagtgaaaggcagtagaaggcggggcgacgcacacggcttcctgggaggtgtagttttctctacgagtgcccttcgagatcgattggaggctcgcgcaggagccgtgagttgcctagcagccttttcattaaccaaacttcttgaagccacatctgcagtatcagctcaagtggaagaacttgccttcaaatgtacagaaaatgcacgtttccttaaaacgtggcgggacctcttgaaagaaggctatgattctttgaaacctgatgactgatttggcatacttcgttgtttaataatgactgcaataattcatacttcttatgtcatattttgtacatgtaccacacatataggatgacctctgtccagcagttctgtatatactcagaatgaaatttttcttggttttcttggtttttgtgaaagcagaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatatctctttgtacttgttgatttttttttacagactttacttcagaaagggaaagactgtttagaaagaatgcatattttttccctatttatttctgtggtttactccttttgcagtttaacagtgtttggtatcgatattgtataatgtagattgctatcattaaagtggcttatcagatttatggttggtgttattactttgaggtttgcagttgtgttactaataatttaaaaattattgtctgaagggtcattta

SEQ ID NO: 177158 - DNA, 197 bp, Homo sapiens
atctcagtgccctgggaccagccgtcctaccagcaccattgtacacccctctcctacaccacccagcatgcctctgccttccaggcctccctgctaatctctccatctggattaatttcgacgtggagggaggagagggaggcagagcagaccttcctggaggagccttcacccttgaccctgccctgccccgtgat

SEQ ID NO: 177159 - DNA, 252 bp, Homo sapiens
tggcatcactgcactctagcctgggcaacagagcaagagagaccctgtctctctcacaaaggcatttgtggtttagtttttacatccgcagatttatttttaacagttttattgagatgttattgacatatacagattttggtggctcacacctgtaatcccagtgacttgggaagccgagtcaggaggatcacatgagcccaggaattcaaaaccaggctgggcaaagtaggaagacgctgtctctatgaa

SEQ ID NO: 177160 - DNA, 417 bp, Homo sapiens
ccaggtctataggacagctctctgggggctccagttccgttattggaaataaagtaccagttaactcagagctcaactggcaactcctaaaatgaatagggaaagaggaatttctcctttcttatataagcctccttccttcaattaaaaactgttttaaagcgtgcttatcaaggttggctagtctccaaggagtgaggtaatgtgctgtaccctacagccacaggcatataccagccaatggtcagctgtcactatgaggtactgtcagccaattttaaaatggaaaaatgcatgccatgataatgacttatcttcttatctaaattttaaacagttaagatgcctggcttggaatagtaatgtatgcaatcaatcaataatcccttatttttaaacataaagaaggaggcatac

SEQ ID NO: 177161 - DNA, 445 bp, Homo sapiens
ggaaaggagaggaggaggatggctacatagaggactgctatgttccacaacggtctatatatgatacgatgaggataaatgagcaaattgaccaggggtcaaagcttaaccagacttcaaaaagcaccatggaaaagatggaaggaagtactatatccagcaatggtacattaggagcagcatctaatgtttttgaatctagagcaccagaaggtaagaagctggatgagaggataatatttgatgcactaaagctaagcagtgatgtgcagaagtcagcacctgtgccacccagaaggcggccaaatgcagaacgcaaagacaatgttaacaggagatcgtggaagtccttcatgccacccaacttcccagaatttgcagagaggatagaagcttctctcagtgaggtttcagaagctggtgcttcaaatccttccttgcaaga

SEQ ID NO: 177162 - DNA, 505 bp, Homo sapiens
atacatagggttgtgacaactacagataaagacagttttacttattcctttccaatttggatgccttttatttcttcttctttcctcaatgatctgactagaacttccaatacaatgttgagtggctgtggtagaaacaggcattcttgtcttattcttaatattagtgggaaagctttaagtctttcaccattgagtatattgttacctgtgggttttccataaaagctatttaccatgttgaggaagttcacttttatttctagttttctgagtgtttttatcatgaaaaggtgttggattttgtcaaatagttttttttttcatccttgattggttttgtgtgttgaaccactcttgcatttttggactaaattccatttggtcataatgtgaaatcctttaaaaatgttgttggatttggttagataggagtttgttgaggatttttgtgtctatacttgtaaaatatattggtctatagttttcttgtggtaattttatc

SEQ ID NO: 177163 - DNA, 281 bp, Homo sapiens
  misc_feature (263)..(264): n is a, c, g, or t
ttttcttgattctttgggatgatctgacaatgaaccaagaacgactttcattgaaacctttggtatttgaccaagtgccatctatacttcagttgctttcaaactattttcattttcctgcctccctgccacgaattaaaggaataggacatattaagacttcagcaaatttcctatacccaccagagagtaacacagagcatggcagccaattcacagaattctttaaaagaatttcaacacaacatacccccagcagggcnncgcttactgaggggatc

SEQ ID NO: 177164 - DNA, 373 bp, Homo sapiens
tataaaagaaaaccatagcaatgaagttaaaaactcaatggtcagattaaatatagtaatcagggtttcataggaaattagtcaattggatgaaaagataaaaagcaagacagaaaagatagcataggaagagatgaagatacgaaaagaggttaaaaaacatgttgacagaaagcatagacaatagaatgagaaggttgaacaaccgcctataataagtttcagaagtttcagaagcagcgaataaaactaatgatgggtcactttcaagaactgaaagatggctgtgaaacctcaaagaatcactctgggcctggcacgatggctcatgcctgtgatggctcatgcctggcacaatggctcatgcctgtaa

SEQ ID NO: 177165 - DNA, 572 bp, Homo sapiens
tcacaggcttttcccaggaatacctagcttcccttcctgggatctcagccagagcctcacagtcgactcctgcttacacctgtgtctctgtcccaggcagcctcaccgcaccccccgccacccccgccccaccacacctgctttcactaagcccactgcctctggacttgctagaagttaggcaggacagtggccttgcctgctttgacactaaaatcagtatcttcccaaactgacttccctctccccaaagccctaagaaacatgagcagtagcaagaagaaattatgtcttccccaacccaatctcccccaccccctctcccatcatttttctgaccacctcttcctctgttccaaacaggagaccaaccactcacccatcattcatccaaacaggagctagggtggggaaactgacagcgggtctgaagactcataaaaccttcaccagcctcccaggtgtcccccaccccaaggtccaacagagcctgggcaagctgaccccactcagtgctgggtaaagcagttgctttttcatttttgctcaagggtctagggaagagctcgtta

SEQ ID NO: 177166 - DNA, 460 bp, Homo sapiens
gacaaaatacacatcttttattattgggatctcaacctctgtttcaggctttctatttcctttgagaatgtgtagttttgtttacatctggagtggtattaaattgttatccttaacatatgcttgtttataagatgtaaacaatgtgatattgatgatggataaattggcttgaattcccccgctattacctttttctcttttggtttagaggtgcttatttgttcttctctaaagcttctagtgggttgaaacagaaagaagtcacatttctttcaaaatgagtcttaaatgcttgtgttttacaaaattttaaattaaggcatatttttagcttcgacagctggttgatatgtagcctgtgactaatgaaatgaaacacatttttgtttcatgatcatgtgttaatgtcaccctacaattttgttatttttgatgcaagaaagaatgattaaatctg

SEQ ID NO: 177167 - DNA, 764 bp, Homo sapiens
catgcaatcaaaaggaaggagatagaaaggggagggaaaaaatctgccaatacctatgatgggggaagttgcagctccacaggatatcccatggtactgatgagagtgtaaagtggtgtagtcactttggaagagagtttggcatgatctcctcataggtatatattcaaagactcttgcatgtgtacagtaggagacatgtagaagaatgttcgtagaacagttcacctcaccagaatcctgggaacaacccagatgccaatgcaacaagaaagtagatgataaaatgtggtaatagtcacagtgctatgttaaaaatagtgacccacaaatcagtatgaatgatcatagcagcacgaggtaaaaaagtaaatccaaaaagatgataatgtaggatattatttttatgttaaaaacaaaattttaaaatttgtaatacttagaaatacatatagataaaaccaaactataaaaagggaagcagggaagagaatgaagcacacaggattcaagatagtggtttcgtggggcagaggggcgagaacatggtatatataggcaggcctgcccctgtcgttagatgtggtttattgtccaggccttcacctgtatgtgggaagtgggttcataaatgcttgttacattattgacaatagttaattagattactgactaaataaaaggagggacatgcacagacaaatgatgacagtacatcgtcaatcaaggattgtgatgaattcaattcagtgtactgggaatta

SEQ ID NO: 177168 - DNA, 195 bp, Homo sapiens
tgcctgctgtcgctattgttggggaagtcctcatggaaacttgaattgggccttggagttgaatgggatttgggcacatccccctgagcgtggggagatcaccttatttggctttgtatttttagcaggtggtacagcataggttggaaataatttttttagatgaataaatgaggggaagggcacggaagatca

SEQ ID NO: 177169 - DNA, 297 bp, Homo sapiens
aaccactgtgcccaacctggactcataatttcttgatcttccctgtttctgcaacctgcatgttgtctcccatgcctctgcctcccgtctcaacctatcactcagaatccttctctgaaatgatgcatttggagaacctactgtttgattggagccttctgtttttccacttgtttaactcttattcccagtgaccctgtgttttgacctcaccaggacacccagccctggatgtcagtccccttcctggcctcactttcttccttgcccagctcagtcacttcagtgaggctctca

SEQ ID NO: 177170 - DNA, 670 bp, Homo sapiens
tcctagagaagctagttaggaggctcagttttcccatctgtaaaaggggggtgctaagaacctgtctcttgggggctgctgtgaagtataaatgggattgtgcctgtaacacccctggtacagtggtggcttataacccccttccatgtaagcaagagtgagctccacaggcccaaatcaatcctaaaacattacgatgaaccaagtgaaattgccatttttataggttaaatattgacaatttcatatggttcaacctaacagcatcccaggggctagaggatctcatttgtgtccactaaactagactaagagttagtactcttcacttcagtatcaggcacagcaatgaccctccttccccctcatttagagacgaagaagataccgaggttctgagaggttaagtaacgtggcccaaatcatataactggaaagtgacaaagccagggtttgtactcgggcctggctgcctccaaagcctgcagcttaaacacgatgacacactgactgctcggcctggggccagcagggcgttatcacatgtgattgtgtctcagcaccaaggacgtcagtggccgttgccttagaatcatgggaccttgggactgcgagggtacaagcagttaatggctttgttcaagaaacacacttgggctgggcatttatt

SEQ ID NO: 177171 - DNA, 735 bp, Homo sapiens
aagaagcagagaggtacaagtccaaagggatattaactttaacttcaaaagaaaaggtgcacaaggggagagaaattggcagaatcatcatttcccttacaaatgagatctttaaaatgcagccacagagatctcagggtcttcttaataactccaccccctggagtgtgtaacccaatagccacaaaggaacctgagagtccagggatacaaccaccataggctctaactcagaatatgattccttacctctcaggaatgagagggttgcaaagatctgtcctctgagggtaaaaagggcttaaatttcccagccagggacagtggctcacgcctgtaaatcccagcactttgggaggctgaggtgggtggactgcttgaggtcaggagttcgggaccaccctgaccaacatgctgaaacaccatctctactaaaaatacaaaaattagctgggcatggtggccggtgcctgtaatcccagctactagggaggctgaggcaggagaatcacttgaacccaggaggaggaggttgcagtgagccgagatcgtgccactgcactccagcctgggtgacaaagcgagacttcatctcaaaaacaacaacaagaaaggacttaaatttccctttggtagtgcaaggtcatgaaaaattctaaggtcacgcatggtggctcacacctgtaatcccagcactttgggaggctgaggtgggcagatcacctgaggtcagaa

SEQ ID NO: 177172 - DNA, 451 bp, Homo sapiens
acctgcatattagactctctccttcgccggtttctcagtgtgatgagtcacacatagtaatggaaaactctgtactgctctaggaaactatggagttgggatggagatcccatgtaccagaggcatttaggggcttgaacagtagatggtgcaaaataaatgtgactatacagttgccagtggaacttaccacagatattaatccttaaaaaaaagacaattgtgtccagttaggcagaagacataccagatcacccttgttgtttataagtcttcaaaatgttttctggtagaaaagcagtcagtgctctgagcccagcaaggtgcctgttgataaataattccatcaataagttaagacctgtgtcttactgagacctgtccttacttaactgaatgcctatgtatgataaattcccagctgggcgcagtggctcacacctgtaatccc

SEQ ID NO: 177173 - DNA, 217 bp, Homo sapiens
attcctctcacaaacaattgctgcctgcagcatttaaatatttaaagaacttcaggcagtaaaatgagtttgaaaaaaagaaaaatatctatttaaagaacttgaactaaaagggtttcaagaataaaagattattgtgtccagtaatcttccccaaccccggccctcctggaagggaacagagcagactgaaacagtgagtatgaaaggtagcaag

SEQ ID NO: 177174 - DNA, 401 bp, Homo sapiens
tcttcctgaacaaagatgaagcaccaagctctgggaaaagctaagccaagaggcccaacctggctggaagatcatacagttgcatttttcgtgtgtactagaaatacagagcactcattaaattaaccgagtgaaaaccactccttaggcaatgattaagctgagagtcagagggatgggtgggaggccagctgtcccatctgagctgcacttgatcactagggaatttatcatttctaatgcctttcacaaagtcccctgtgatgcccccattgcagcccccggggaacggtgaggcaacctgcttcttatggcagaaatatgggactcaggacagagcaggggttgtctggaaactgagggagaaaaaccaatatggggcatttatagcgtgagctcag

SEQ ID NO: 177175 - DNA, 505 bp, Homo sapiens
tgaaagcacagggctttcctttcctccctctctatctccccaacccagagaccgagattctgatttccctcaagatacacagaatgcacgtcacttgccccttaaacagaggaggaggaaggcaaacttgagcattcaactgttgccaaaacaaacccaagcctttcaaatgagttaagttctcatgatatgagtcgggttgagtaaatttatacaattctcatttacatacacacaaagagtaaaacaatctacttatttcttgtctgaattcctatcttcttcaataagatttggcttattaacgtagcagcagaagtttgggccaaatctatctagcaatgaacctcatctcacctatctctgtcactcttgcatacccttttcctacctatacccttccttttatcctggcaggtggggaatgcttaggcagaaagctcggccatttctattgatcatataggtaacatcttcagcactattattggtctgacgactgtga

SEQ ID NO: 177176 - DNA, 475 bp, Homo sapiens
actagttacttcagctcaacttcctcatgtataaaatggaaggaatatcagtacctattgtatggttttgagaagtcagtgaataatgcatagtaagtgcctggtggatagatataaatactcaataaaagtccactatcattttctcacttcaaccttccaacaatccctatgaggtaaacgctattattcatccatttgacagataaggaaattgagtcttagagacaatggtgtgctggagccagcttccatgggcttgtgaaagccaattgttaaattttcaaaagttttttgagttggccgacatcatgttgatagtttgaaagtagccatgatggggtatttctgccatgaaaatgagcgaacccatttcccccacagagctgcttgttaaacatttaccagcacaccactacttagagcagtaagataacttatctgaggccccatggctggtgagtggcagagccta

SEQ ID NO: 177177 - DNA, 306 bp, Homo sapiens
aagacttcttacatatgtgcattttaaaagtcaccctgacggttacaaattgtagcagaataggctcaggctctgacatcaacgtgtttagaatccagagggagagacagattgaacatgtgataaataataagaacaaaaaaatccaacgctttatgactatctgcaagcatcttccgtgagttagcaggtgtctccctgcctgatgtgatcctgtgttcttgtttatattggctagaattttcagtttcaagtagtagagactaactcaagctagcttaaagaggaaagaaaatggggacaaga

SEQ ID NO: 177178 - DNA, 140 bp, Homo sapiens
atgttaacatcaatgaacttaaaagaaggaaagatttaggtaggaagagacatgatgaattggttgttttccattattggagtgtttgctttatgtttctgagaatcagaatgtttaagtagttatagcagctgcagtga

SEQ ID NO: 177179 - DNA, 307 bp, Homo sapiens
ctgaatgtttttggttttaacagaattaaaaattctcaatatttctggtaggcataattatgaaattagtgcaataactgagacatctctgaatacatattatggaacacaaatttttgttttgatactccattctccaagttctaaatatattaaattttactagaaaaagatactatgtgattgattgcaggcattttatatgaaataatgaatataaatgaaaataaggtaactaaatgtaaagctttgggtctctagctcaaaaataatcacattttccaaatagcccccaacaggtttaatt

SEQ ID NO: 177180 - DNA, 152 bp, Homo sapiens
atacagaaagaaggtgtaaaataacgtaatgggagagcattaggctgagatagctcccatagccagggttcctacatagaaaaaatgaaacaagcttagcccatcaacaagtggcccgctgagtattagctgtgtaatgagagacctaccac

SEQ ID NO: 177181 - DNA, 382 bp, Homo sapiens
gtcctaacaagtgcaataaaggtaagtgggggaaaaacacataaaagttataaaagaagaatctctttattcacagatgacatgactgtgtagaaggataattctaagaaatatataaaactagaaaaactagtaagtgaactagtaaaacttaagtacaagatcataggatacaacgtcaacatacaattacatttctgtataccagcagcaaacaatttcaacataaaattaagacaatttcattaacagcagcatcaatacaaaatacattaacagcggcatcagtacaaagagattgaacaaaaatgtgatagatctctacagtgaaagctgtaaaacactgctgagaagaaaaccacatggagaacaatcatattta

SEQ ID NO: 177182 - DNA, 509 bp, Homo sapiens
aaaggctatttaggaactaatgctggcttaattattttctctgtctctcctctgcctcttcgaatgtacatgtgtaggtgtatgtgtgtgtatatgtacgtgtttccttttatacttggctttttgtagccatcattttttatcttttaaaaatgacaaacacaattcactttccagaaattaacttcacagttcagcagctggggagcgtctattcaataagacagaggttactgtttttgaatcttgccattagtaaaactctccagtaagcctcagaagtgggctaatggcaatatttaaacaacttgctctactgatactggttgtttagtgaaaaggactttggtgtgtcatttagctcatttcccccacttttaggtcaaatgtaactaaaacatcacacacatctgttcatctctttcttccaaatctccaggcagtgtagctgtttggggggatggggtagggaaggaaataaatgaacatctccaggcaagaaattctgc

SEQ ID NO: 177183 - DNA, 259 bp, Homo sapiens
gcctgatccccctcccaggcctcctcagtcacccgctgcctctttccatcattccctttgtcgcctgtgaccctgaggaggggtgggggcttaggacagggctttgcataggatctggactagttgtgggaatttgggcaggtaacttcccttctcaagcctcagtttcctaattcgaaaagaaaaaacatgggtaaggtcatgcagctcccacagaagatggcgagaaataagatcaggcgtagtccgagcaagggcc

SEQ ID NO: 177184 - DNA, 466 bp, Homo sapiens
ccgatctttggtttggagagcaattgtgaggaggcatgaaatgtatctggagatagctatgagctgcagcctgctgattttcatgtaattcttggctacttgccagtatggttggggttaaactgtttccagggtaggaaaaacacgaacctagcattttgatatgaaaacaaacaaggctactttgtacttgatgaagctcaagttgcagatccagtgagagcccattaactattggtgaaggcccactgacagtgttgagtttcagagacccctgcacattctggagatggcagcgaattgttgtgcagcctacgaaagtaataaatatttctgcagtgattgtcaacaacaaaatgattttcttgtttggggggtggggaggcaagaggcagaaaccttaggaagctgttgcaaaccagtttcagcttctgctacttttatttctttccatttaaagctgggt

SEQ ID NO: 177185 - DNA, 472 bp, Homo sapiens
aactcttcctcattttttggttgcttcatgcctttccttgctttctgaatgcagtgttttcccaaatctctctgaaggtactagttagacttcactgttgcttattgttccataccctaaatgatctctgtttcctttggggtcggttctgttttttcatcttttcatgcttttgattttccaaacatgttggaggatcctcaagaaagttaaaaccactttctctggaataataccatgtagatttaaatcctgcctctggctgaacacagtggcttactcctgtaatcccacttcgggaggccaaggcaggaggatcacttgaggccaagagttcaagaccagctttggcaacatagtgagaccctgtctctacaaaaacttaaaaaattagccaggcatggtggcatgagcctgtggtcccagctacttgggaggctgagatgggaagagcccaggaggttgatactgc

SEQ ID NO: 177186 - DNA, 351 bp, Homo sapiens
atgtctgaagaggtctgtggaaggcaagtcccaaggagaaaaggaaagagagataagaaggctgttctgcaaaactgcgaagccctcagaagaaacaaagggaacagagaagacagcctagcggggaggcggggattttgtactttcctaattctggcatgtgcattcctcacaaaattcatggctatcagctcattcaagagttcacttacaatatgttggttgggctagattcttcaagcatttaagtgtagacgctaagaggtaaatgcagatttctcaatttgaaaaggatggcaataaaatatgcagtcatctgtagaagagataagattatcttcctttttggga

SEQ ID NO: 177187 - DNA, 427 bp, Homo sapiens
accatacccagccaagttttctctaatagtaacaagctcctcactgccttcagatacaagtggaaagtttattgcttacaacttttcttatttctgcatcaatccgtgttcagttgcataacagagaatctggtcaagtttaagcataaagggatttaaagcaaggaattgaatgtgtacaaaactactgaaaggactagaggagcaaagctgtaggtccaactccttggaacaccttccaccacttacaactactcacaacttccaccactcacaactctttctaccatgattagaaaagctcccactggactagcacggtggcttatacctgtaatcccaaaactttgggaggctgaggcaggaggaccgcttgggcccaggagtttgagaccagcctgggcaacatagtgaaatcccatctcta

SEQ ID NO: 177188 - DNA, 271 bp, Homo sapiens
caaatttataggcatctaacactggagctcccagatttataaaacaattcttactacacctaagaactgagaaaaacagcaacacagtaataatggggaacttcaatactttactgacagcactacacaaatcatcaagacataaagtaaagaagaagcaatgaagttaaattacactctagaacaaatacacctaacagacattcacagaacattcttcccccaaactgcagaatatgcattcttctcttcagcacatggaaaattcttt

SEQ ID NO: 177189 - DNA, 297 bp, Homo sapiens
ccccgccgtgggttcctgtagtgttctattatttgtttgctcagggctgagctgagactctggacctgggaaaaaggaaagccagagtaggcccagggtccccaaccccagagtgcttcagccttgggggcagctccctaaggccccaggttgaccctggagctactctgcaccctctgcccccaggtctcttgtggggtcagcgctgccaagagtagaaacacttcccccagtagcggggagtactaggagctccgtggggattaaggcttgggcaaatgcctacagaactgacct

SEQ ID NO: 177190 - DNA, 336 bp, Homo sapiens
attctttaggattttagcacaattgctgccataaattctgataaattcaatcttcatgtaatttcactctcatccttctttaattctttagtaatgatcttatgctatgattgacctcttacatgagctcccaacttaatattaataagtgcattttattcccaatcttaactttaatccaactgaagttaatttttgcatgtggtgtaaggaaggagttcaatttctatcttctgcacgtggtagccagttatcccagcaccacttattgaatagggaatccttcccccattgcttgtttttgtcagctttgtcaaagctcggatagttgtacgt

SEQ ID NO: 177191 - DNA, 421 bp, Homo sapiens
ccacatcaggactgggacccaggaacccggcgctgagcagagtatctcagcaaggaagaggaccaaggcagaggctgccccaggcccccgtcccatcctgaccccaccgcgcctgcttctccaggctgctggaggagtgcaactggacccagggcacaacagaaacgcaccctctacccccacctcgccaactgcagtgctcccaacacagcgcaaaccagcctcccgtggctcccaccaccctcaagaagcaagcccaccctgcagggcaggacccctccccatggccggcgctccctcctgcctccctagaggaacaggcagaggtgaggcgtgtggggtcacgaccagcgtaacctgctctccttcatctatgctcagggtttccttctgagcctctcaagataattaaagctattta

SEQ ID NO: 177192 - DNA, 634 bp, Homo sapiens
attcaaatgttcaaagtgaaaaccacgtatcaacacggggagtagtccccctgcaaagagaaagccaaattgtgggctgtgggtgcgaactgctgccacagtgccgggggtaaaatattttggtttgggaacctcctcccagaacttctggaatgttcttgttttcccaacttgttttacagctgcgcagggagccagatagcattcattaattcccaacactggccagcatatagggcaaggggccacagacagatagaactatatgattagtgctaaatgagaaagagcacatacagattatccagaaagctccagtgagtcttcattttctatttcttctctcatcactttcataaaggaattctcaatgagcaacaagttataagagttccacatcttctcccttttcctgtcattatttggctattgctgataatagagaaactctaattagactggtccagcagcacattaggagggttcaaaagccagacctgcttgcaagaaggtattcagagaggctgaggcagggatacccccgggaagggggctgggccagccacgcttttgcgattcctcaaagctggctccaaattgggcagcagaggaggggcaaatgagcccccaggaa

SEQ ID NO: 177193 - DNA, 643 bp, Homo sapiens
ttctggaaagttgacacaggattctcttcatcgtattgataagatgcactcatcagactaacaagcttatactgctcatcaaaattgcacagatacttggaaagcatgagttaaaaagaaacaaaatccactgatgattatatctactttggcttatcatttagtaggaataaagacttcactcttccatagaatactatcacagagaaactctttcaaataataactgaatctttctctaatatttgagggaaagaacaacatttttcatttttaaaatctaaatcagtgaaattttaaattgcaaaatgtaagaattccaagtattaccatggcatcaattcacttttaagtcttcattttaatatatatttcatggccaaatcaaacatgagatgtatcatttttaacttatttttcagtaaaaagttttaaatgtaattttaaatatagaaataatttggtaacatccgcaactgccaagtgtgtgagaaaacagacatgtttacatactatgagtgcaaagataatagtccaacttttatagaagataattttattggaacaatagctatcaaagttttaatgtctcccctccccaactaaaatcccagagtttgactagcaaggagtttaatttagg

SEQ ID NO: 177194 - DNA, 691 bp, Homo sapiens
tgtatttttcatagagacagggtttcaccatgacggccaagctggttttgaactcctgacctcaagcgatccgcccgcctcggcctgccaaagtgctaggattacaggcatgagccacatattacatttttttaatatcatattcatttttccaagtctctgacatccaataatcctcctggtgttaataaaactttcctgttaccatacaccgattctttgtatcagcactgtccattgtaactttctgcaatgggaaatgtgctgtatttgcacagtcccataccacaagtactagcttgtcactcgtgactacttgaaatgtggcttgtacaactgaaactgagttttttgtttgttttgagatggagtctcactctgtcacctaggctggagtgcagtggcctgttatcagctcactgcaacctccatctcccaggttcaagtgattttcctgcctcagctacgattacaggtgtgtgccaccatgcctggctaatttttgtattttttactagagatggggtttcaccatgttggccaggctggtcttgaactcctgacctcaagtgatcggcctctcagtgctgggattccaggcgtgagccaccgtgccggcccgtcttgtcttcttttacagatggagtctcgctctgtcgcccaggctgaagtgcggcggcgcactctcagt

SEQ ID NO: 177195 - DNA, 662 bp, Homo sapiens
actgttaggcagttaaaacaataaagggacacacgctcctttatcactgagatcacctgcttcccaaataaggatgtctggtcattttaaaactttgtgggagtaaaaacattggtaggctgtttcaccaagcctcctgcttctaggaggcttacaggggaagcaaagagaaatcgggatccttttattttcctgtttggtatcaaaggtcactttcttcagaagagcagtatccatgagagtcttccaagaaatgacacccaagtagagagaacaaggatgtttctcttttaagtcaagtacagtctgaagaaggaattgtggaggtgaacctggactgactctggggtctgcagaggcagccgctggccgctaggaagaagagaggttgtggcctggccagggctgttgcgcctagcgccatcgagaacagaagaggcaatggcccaatccagtgcaagtccacggactggacagccacagccccctgcctacgtgggtgccaagggctcaagggagcatcagatgctttgaacaaaccatgggcaacaagaggggcaaagattggggatttgcctttattcataagaccctctttattgcctctaagaaaatgaaacaaggagactatataaaagttcttttttgagagagggtccagg

SEQ ID NO: 177196 - DNA, 199 bp, Homo sapiens
ccccaaacactggttcatacagtttccaattctataaacttaatgtgttatgcaaagttcaacattttcttagcataatttgattaaggatgtgcagaattgcatcagatgtaataaaagccaagccctgtaatttcaattattaaatacttgtaccaaagcctgtacctgagcagctcagtggctcatacttgaactg

SEQ ID NO: 177197 - DNA, 323 bp, Homo sapiens
tcgtctgtgactacccagaagataaaaataaatctacttcagacatgtcacagtggcccaccctgtaatcccagcactttgggaggccgaggcaggcagatcacttgaagccaggagttcaactccagcctgggaaacaaagtgagactctgtctcaaaaggaaaaaagaaaggatgtaaattcactcaattcatttttaatgttattgttggctccaagtgtttggtggatgaatgaataagtgaaagaatgaacaggctgggtgcagtggttaacccctgtaatccctgcactttgggagaccgaggcgggtagatcacaa

SEQ ID NO: 177198 - DNA, 151 bp, Homo sapiens
ggtgaacgttccaaattctaaggcaatcagatgccctggtcaaggttaacttgaaggacagagggggcaaagggagcaatttaatgatctttactttcccctcttttccgccagcatactttttttttttttttttttttttttttaaaaa

SEQ ID NO: 177199 - DNA, 443 bp, Homo sapiens
taccaactgcgggcagcacctttggtcggcctgggggtgaggcacagagctccacacccaggcaactcaagtgtgtgtgtggtaaggggacactgggagcggctggacgaccccctcctgccgaacagacaagagccccaggacaaactgggatggaggtgagggtgcagctgctgccagatgcgctgggtgctgcccaggaaggagagggttggggagccgggtgctcactcgccgcagcagctcactcctgctcgccagggagctcagggcagcccctgaagctgccagatccccccacgcaggcggcggcgctctgcactgcggagccgcgtcctgggggagcagtacccccagccccggcgccccgcagccagacagcccccctcagggtggcagcattccccggctagggtgcagggacccccggggcgaggcggccg

SEQ ID NO: 177200 - DNA, 424 bp, Homo sapiens
gaactaatacataactcagcaattccactactgagtatatatccaaaggaaatgaaatacatatgtcaaagagatatctgcacttccatgtttattgcaaaacttgtcataatagtctgtgaaatcaacctaaatgtccatcaatggataaatgaataaagaaaatgtatgtatatactctatttgagtacactttttaggatggtgtaggtgtcttgcaagttgtaagacaaagcagagttatgaggagggttgaattccttaggaactttcatgccatgcagaattggcggtgggtttgtactggggctaatttctgcaggcaccccttgtgatgttcaagatccatgttctttatctagtaattttttgtttgctcttttcttcccccgaataatccctctctgacattaagaaaggaaga

SEQ ID NO: 177201 - DNA, 164 bp, Homo sapiens
aaatgattctgatttttggttgttctatgcaaggtatatatgactcaagtctatcaaaactccaacaaaatgatctaaacacaaaattataaaatgaatctttaaaatgattttacatattagactctgcacatgcaggttggtatatacaatcttaatgcctc

SEQ ID NO: 177202 - DNA, 420 bp, Homo sapiens
gttgtcatacaccaaatttaaacatggaccccctcaagataggagtctttccctaagaacttcaattttgccctgtcaaccctacactttgaataaatatatattgggtgattctgaacctctataatacagttaatctttgttgtatttccaaggagttagaggttgagccagggaaagacagaagagatatgagggttacagggaaaggaaaaaaggaaagaaaagatgagtaggcttgaggcagagaggaaaaggacatccatatagacccgaaacacggaagaggctgaaagtctagatgtggtgaactttggggcaagtccatcttggtcctatccctccctcatccacagagggcacaacctacccaaacagacccacacctcactaggacagcagtattaccatcacaaccac

SEQ ID NO: 177203 - DNA, 200 bp, Homo sapiens
gggtcacgtgctacctgggcccctcccacatggggcctccacacttaaatcctcagtgcctggcacatgatgagctgccttggccaggcacagtggctccctccagtaatcctagcactttgggaggccaggtggaaggatagcttgagcccaggagtttaagactagcctgggcaaaatggcaaaatactgtctctaca

SEQ ID NO: 177204 - DNA, 192 bp, Homo sapiens
ggaggcagaaattgggcataagacaatatgaggggtggtctcctcccttaactcaagtgatccttccacctcaacctcctaagtagctgggactaaaggaatgcaacaccatgcccagataggtttttgtatttttttgtaaagacaaggtctcaccatgttgtccaacctggtctcaaactcctggctgta

SEQ ID NO: 177205 - DNA, 245 bp, Homo sapiens
taaatccctcgtcatgggagatatgcatacatcctcagagctcctcttctgacagagtccagttcctgaacactggttatgatactatgagcagactgtggggagccatcgttcaatgaagacagtgtggctaggaaatccctggaaggactcccaccactaagacttgtcaaaaattcttcaaacagtacttgcagaggccctgaaatttctgggacttctataaaatccctccctgggcttga

SEQ ID NO: 177206 - DNA, 615 bp, Homo sapiens
ctataaggaggctcaagcacatataactctgaaacactaactaaaaaactcacattaattaacattgcagagtagcagtagtttttgttacctttttccattggaatctttgtcttttatcttccagacacagtatgatcttattagcaccttccggatgcctaaagccttgaagtagtgccttattttccaaaattactactccttcctctagcttcactttcttttcaaaacttccactagccttcgctaggtgtttagaagaagaaaatctgatagtctccgtactaacagaaaaataacagtcctaaaccttctggtagtatttgaaaagatttttaaatgtctttttaaaaaacctattacaatagacaaatctcaaaactggtgaactacagacagtttaataaagcagtgaaggcttacaagaagaatggaagtatatttctgtgtgttacctgtgtatctggtggggggatgtagacaactgcctacttggcctatatgtacaggcaaccataaacaaatcatatatgacttaagcttgtgcatagacttgacattatggtatcagcaatttcaattgtactctatcatacaatccaaaaagcttgt

SEQ ID NO: 177207 - DNA, 245 bp, Homo sapiens
atctagaggattaggcatcgaaacctggtcttccggcacctgcatgagggagactgtgtaaggaacaggggcaggttttccagctctgccacagcttgaggacatctgtctccgacagtgacagattcccccgcctcatgcactcccttcagcgttggaaaatattttatggatgctttactggtgctaaagaaatgtattcttccatttgaataatattgcaagggacgattaacttctgtttc

SEQ ID NO: 177208 - DNA, 479 bp, Homo sapiens
gttggggctgaaacgcatctgcacctccacctgggtcctccgtccctcagggtgggtgtttattcccaagcaaggggtcacccagagagcagcccaaaacctcccttgagtcctgaggaaggggcagccagaggctgggctgggaggaggcgtggcaggcgttgggagcagctgctccaagtgcagtgaccatatttttctgagctgaaaaatgaggacacaggatgtagctgagggctttctcaggttggttcacttaatgaaggggaaaaaaccttccaaaggtatgaaagttaaagcttatttagttatgtggggaatagcttgtttttgtggaaggaacctgagtttccaaaatcaggggttttctggaaaggaataattccatttggctaatatttggggggcacctggaccaaccttgtctttagtgggaagcaaagcaggcatgatcctggcctcacagagtgacgtaggga

SEQ ID NO: 177209 - DNA, 848 bp, Homo sapiens
ggacgcgtgggctgctttgccataaggtgggtcatttggcttgtggcatctcctatgggattccacatcagtggatcacacattctgtaagttcttggatagtgatgctggccaaggccctgcaggtagaaaagaaaaatccaccccagcctacctgttagttcccctcaagatgatgtaaccccctggccaccaagtggctgcttggtcttattgagggatgctgctgtatccaggttcagcatcagtgtctgctgtggacagtttagacattcagcaggggcagtggctggatcagccttgccaagaggaggcctagctactgggcccatgcatggcctccctccctgccaccattctgggctgctctgtatatgaccccattgtgggagccctggagtggatggtgatgggccagctgtgtcaactgggtgagccactctcgctatggtgccccttctacagtggacggcttggaggctgttaacgtggtaaaagatcttcctccttgatgcccaataggtccatccacaagcctcttcctcagacttctctgtcctccctattccaaactctccccttccacccaagccattcaccaccatccatgagaccatgtatagtctaacctcagcctcaggtgatttctgtttccacaggaagtggatacacaggtgcgctgcctgtagctttgtcagcgaggaggttttctctcaccacaatctttcagggccacccattgcagtgtggcagccggccttctgtggattgcacccacagaggcctaccaaatgtggcccgtttcctccctggaaggctggccataagggtcacccctgtgtggccag

SEQ ID NO: 177210 - DNA, 363 bp, Homo sapiens
cacaagagccctgtcatccctcataacaaggtcaggaagcacatcctgacagggacctggcttctgctgcaggacgtgttgggacagcagggcttggcattcacatccatggtgttactgattaggaagctgggaatgaattgcctgatttggggagaacacatacatcgcaagaggtggagagaatcccgtcttgttcataagcttgagggtgtaaactccctcaaggagggagggagaagactgtttgttcccatcaaaatgatacagtggcaagtgctatttatgctattgcatttcttttaagtgatgcactttccctaaaaatatgcacttattcaatcctttctgtgatgggtaaaa

SEQ ID NO: 177211 - DNA, 785 bp, Homo sapiens
ctgagctgtaggattagaggtaatttattatatagagatattaggattggctcttctgtaaaaagctaatttactgacaacagatttgaatcaaagtaagggattcataggtaaaactatgaacttttctccctaatgcttcattccctgtgggtaattaatgaaagagaaactttgcttgagtgtttctgggcatcttgtctcctacaacaggtgtcaaatttctccaggtgaatgcttaccggtaagggattggataaggaatgttgcggtgaggatcgtgcaactggtggaacacttctgccagggctggttcctggcgcgcttcccccagcaaactggccaacagggaaaaaccgatatgaataattcaaaacagtactatgcttcagataaggagagtaaaagattaatacacaaacagatcttaattatatggcccctttaagttaacacatcttactctagagagaaaatgccacacaagtcaaattctgctaatttttaatgagatttttaagaaggagctccagcagaaatataccaagatataaagaaaacatggctagaaagctgaaggtatacatgattttgaaaggacatgagagaagaatgttttcccttcttgtctccaaatacacgaagcagaaatgcagtggtgcagtggatgttagtgtctttagtaaccactaacgatgggtcagggaactcactacatgttccactgtactaaagggaggaggacaaaagaagagtccaagtcattccacctcaatctttgtaag

SEQ ID NO: 177212 - DNA, 331 bp, Homo sapiens
ctggtctagaagatccatgaatttaatcattttgaacaaatgctgaaacttcctttccatgtgctttggtgtgcatcatatcttcttcttagtctaaaatttatatcaaaagaattaggaatactatggtttgttacagcttcttgttttgctactattgtgtacatttttagaagttactaaggaaaaaattttacgtttggtgtcagatgtttgtccatgtgacatttgaatgagtaagtgcaattcctttgggcagataaaaatgtcagtgtactttatttgtctaacaggaattctctgcttgtagatgtaatataatatagttctg

SEQ ID NO: 177213 - DNA, 179 bp, Homo sapiens
tacttaatatatttttttccgtaaatgaaaacatgttttaaatacctaccgcaaatataagtatcctaactggaaaggttagtgaggtttactcaattcacacttctttaatttgggactgtatgaaaatgtctaaacatatgttatggaattctctattgatctatctatccatctat

SEQ ID NO: 177214 - DNA, 204 bp, Homo sapiens
gaaaccctaatccccagcataatggtatttggagatggggccttgggagataattagatttagatgaggtcatgagggtggagccctcatgatggaattagtgcctttataagaagagacaccagagaacttgctcgctctctctcactctcttcactgtgtgaggacacagtgagaaggtagctgtttgcaagccaggaagaa

SEQ ID NO: 177215 - DNA, 392 bp, Homo sapiens
ctagagccaattaggtaagagtatagtaattgtaggatggcttccagatatgcgactggtctatttgggtagatcaaggcaccattaccaaggaataatctaaagaggaaaaaaggaacaattttgtggtacactgcatttaaaataatctgtgggacatcaaggttgatacagggaagactgcaaggcttaggagggaagtctgggcacaaaagtagctggctatgatcttgggaatatttctctaaaacacactgttcatttgtaaagtgaggaaaataccacctatctcatctatttcacaaaacagaaataggatgtacataaatactctctctgtatgtagttttttggggattttgtgtgtgtgtgtttttgttttttgtttctgt

SEQ ID NO: 177216 - DNA, 236 bp, Homo sapiens
tgttggtgtgcatgcgagttggtgtgtgtgagttggtgtgtgttagtgtgagttgtatatgtgtgagttggtgtgtgtgttggtatgagttgtgtatgtgagttggtgtgtgttagtgtgagttgtgtatgtgtgagttggtgtgttggtgtgagtgacttgtgtatgtgtgagttggtatgcgtgtgagttggtgtgtatgtgagatgtgtgagttggtgtgtatgcgagttgat

SEQ ID NO: 177217 - DNA, 606 bp, Homo sapiens
attcttgatataagttcgtgaacagatgtatagctttttttcattttcttgatggtgacctttacagagcaaatgttttcaatttgtatggcccagtttatgagtttttcttctgtggtcatgcttttggtatctgtgaacattgcctaacccctaagatttcttctgtgttttattttcgaagtttaatcattttgtctcttctattaaggcatatgaacctttaaaattgaatttttaattcaatttttgtagatgacgtgatataagggcagaagtctactttttgcatacaaattttcagttttcccagcaccatttaatgacaaagtatctttccccaattgaattaccatgccatctctcttgaagatgaattgaccataaacacaaggttttatttttggattttctgtctatccttacactgataccgcctgcattgagtatgctttagatgagcttttaaaattaggtagtgtaagttgtcttactttattcttcgttttcaaaaattttttgactggtacagattctttgcatttctgtataaatcttagggtcagcttgtcaatttttgaacaaaagcttctgaaattatcatag

SEQ ID NO: 177218 - DNA, 228 bp, Homo sapiens
tgtaaaggttaggtttggatctggtatattagcatcttaaattctcaagtctcctataaacctgttctcttaggccagctatggctgcagaagtcagttatagataaacattgagaggggagatcacatcatcctttgttttccatttcagaaataacggcagacacgtggcacatgtcctgagcctggggtggtgccgttccttttgttgctctatctgtatgggag

SEQ ID NO: 177219 - DNA, 431 bp, Homo sapiens
acagtaccaacttggtttaaagttttcagcttgtcctctgatgcatttgttcacctcattgtactaaaacacaaagaaactgtctcgtataaaaatcagaaggaagtttagaaatcagaaagaagtttagaaaagtttagaaatcagaaggaagtttagaaaaaaattatggaacacatgaaaaaaaaaacaagaataaactaaagggcactgctgaatagacagacaacagcaacagtaagggggctctggtcccccttactaactctgccaagatgacagttgtttgaattctccaacccttcttctgctcctctgtcaaaggaggatttcgcatagggttcgcaggctagcgatctaataggtaaagcacctggcacgcagctggaaggctatctggggtctgtctgcttctgctagcatcaatactc

SEQ ID NO: 177220 - DNA, 532 bp, Homo sapiens
atcagtaagcctagaaatagtgaggcaaggaccctgttccctgatttgaaataaactattgattgccttaacaactggtgggggatggtataatcagagtccgggtaggacccaggacaggacccaggaaaaggatactttaaaatcaaggagctaggtcattctgcggggtagatacagtcatgttgaaaagtataaaagtttgaaatacataaatgaaaatgggatctagaatgttaaaaaaaaattgaccaggcgcagtggctcacacctgtaatcccagcactttgggaggccaaggcgggcggatcacgaggtcaggagatcgagaccatcctggctaatacagtgaaatcccgtctctactaaaaatacaaaagaaattagccaggtgtggtggcgggcacctatagtcccagctacttgggaggctgaggcaggagaatgccgtgaacctgggaggtagagcttgcagtgagccgaaatagcgccactgctctccagcatgggcgacagagcgagactccacctc

SEQ ID NO: 177221 - DNA, 458 bp, Homo sapiens
ttcccttaggctcaaaaggctcggaaactgggggccaacgtttacaccctgggtgtggctgattataatctggatcagataacagcaattgcagacagccctggccacgtgtttgcagtggagaatggcttcaaggccctgagaagcaccattgatgccctcacgtcaaaggtctgtcttgatgtgacatcggtggagccttcctctgagtgtgtaggagaaccctaccatgtggttattcatggaaatggctttcagaatctaaagaaacgggatgaagttatttgcagatttatcttcaatgaaagcactatcattgggagtactctattgaagtcagcttgaacaaaggcaaaacattcttcaagagcaatgtcagcatcaccagcaccacatgtactgtcaaggagccaccacctgtgcagaagccagccaagaaccaccggggtacggagtgc

SEQ ID NO: 177222 - DNA, 179 bp, Homo sapiens
cattctcactaatgactgaattcccaccaagatttccatattatcacagtatgcttttaatcttctaagatattaaatatttgttctcatcacagctaaaatgcaatgcaaatcccatctcagatgtgggtcagatacctatgaatctcctgaggtagtcattgaaatgactttttttt

SEQ ID NO: 177223 - DNA, 478 bp, Homo sapiens
tgatggaactacaggcacgagccaccacacccagctagcttttctctttaacacacctcctgcttttcttacttgttctctggggtggctcctcagtgagttctgccagctcagcagttcagtgagcaattccatcctgtttagtttaaaatccttttaactagggatgtggccttcaattgcatattgacgagtatgcttttagccttaatgctatgtcagtgatgctccactgcccacccagttcccctttaccaatatgatgcctccttccctcagccactgtgaatgttggctcctccaatgatgtgaatgtctgtgtctccccaaaattcatatgttgaagtcctaacccccaaggtgatggtattaggaagtgcggacctttggaaggtgactaggtcatgagggcttagtgatcttataaaataggccctatggtgctcatttgcccttccaccacgtgaggacacagtga

SEQ ID NO: 177224 - DNA, 340 bp, Homo sapiens
agactccatctcaaaaaaaaaaaaaaaaggaaaaaaggaaaggccatgcaaggctcggttagggtggtctgcagtgctgggcctgctggaattggtacagtccagagggatctgtgggaatatggaaggcttggttctgccacacaccaaaaaagtgacctcacttctctgggcctcagtttcctcatctggaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtt

SEQ ID NO: 177225 - DNA, 343 bp, Homo sapiens
tgacatgatacgactcgagctggtacccgataagggccaagcagggtggatcacctgaggttgggagtttgagaccagcctggccaacatagtgaatcccgatctctactaaaaatacaaaaattagccaggcttggttctgccacacaccaaaaaagtgacctcacttctctgggcctcagtttcctcatctggaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtt

SEQ ID NO: 177226 - DNA, 793 bp, Homo sapiens
gtcactatggaagaagggttggagagatgcaacattgttgactttgaagatggaggaaggaagccaaggagtatggctgacctctgagaatggcaagaaagttgattctccctcagaggctccaggctgaaacctaagcccttgtgaagcctgtatcagacttcttccctacagactgcaaggccctaacttggtgttggctaagccgctaggttggtgataatttgttatggcagcaatagcaaatcaatacatgtttgctgcttaatttaaattaatgtgtaccattatccacctatcatttacttttgaatgtattagcaagtagggcaacaaccgttctagatgtaccctccattctgttgtactgatcaatttgtttactcctttgccaatatccagttgttttgatatagtcacttctacacattcaagtacctggtaaaagacaagttagcctctgttcttgttttgttttttaaatagtttccctgggtttttatagattttgttttatgtcctctaaataatcatttcttgttgtatcttattaagtcttttaaaatttatgttgttatggtgaaaattccatctccatttgtaattgataattcttgtaaataaagtataccacatacaaccgtgtctcaaggcctttgaacttgctgttcactcttcctgaactggaatgtgcttgtcacagttgtctgcacagcagaatttgtcacaaacctcaagtttctgctcaaatgccaacttattgtaagtgaagccctccctaatcacctcatag

SEQ ID NO: 177227 - DNA, 2439 bp, Homo sapiens
  misc_feature (1914)..(1914): n is a, c, g, or t
  misc_feature (2235)..(2235): n is a, c, g, or t
atggggtgacatacatgaaagtgctatataagccaaggattatcagcaactcttcttcagatgagaaaactaaagcctacagagcttaaaacacttgcccaaggacgcatggctagtaaatggtgaccacaggccagtctgctcccaaccacatgccatatcccaagtgcctcaatgggagtgcagaggatggacctaatctagcctgactagggtgggctgcagtgcagggcagcaagatatgaaggcctcaccaagttcagaaggggcagcaaaatcaaccagatgaagaagtgctttcctggtggcacctggtttgattctggacagctcatttcacatctagcatggcatataatccagccagacctgggtttgaatcctgccactacagctcactagttagctgtgtgcccttgggcaagcccctgaatgagtcattccatggctgctgttttctcctctgtaaagcagggaagatagcgcccactttccagggctgtgctaaggagggaagcctgtgaagagcacctgtcacaacaggaaatgcagacgtgggagtcactattgttaccaccctcttgttctagcaggagacagtggctgttaccagaccctcccttcagggacagcccgatgactcctctgggccaccagagtgggttctccaaaagggtgcaggagaacggggagccatttcccagagctgcaaacctcccagggagtgctcaggctccatctccctcagcccccagctgcccgccagccataactgtaggatatggtgcccaggggagccatgaaaggcgaagcttttacctccatctcctgcacttcaggcccccaggccccaccctaggacttgctgtgggatgggctggaggaagggctctggagtctgcagaaaggactgccatgttcctggctctggcatccttctctgtgctcttggtgccaggcacagccatcctgatgtctcatgctcagacaccacagactggaaatggtggcatctcctcctcatcagttcccccaagtcccatcagtcaggtgtccccagcgtctcctccaccaccgctgccttcatcttgcctgcccatgtgcagccttgttccctctcctctgggcacgggcccctccctctggctgctcctctgcaactaccagaagactctgtggtagcccttccatagcgctttatctctagggagaacatctggcttggcctggcatccaaggcctctggtgagcagcctcacctgtccttttccaggttgctctcatgtggtcccttccccctcctacccattccatcctcttcctgacaccaaacttctccctgttcccaaaccctgcctagctcactgctgttcctctgcttgcactgttgtcccaccaccctcctcctgacattccttcctttttttcccctttaagtggtttaacaactgacttcatgtcagggagataatcaaaaattccctgctcacattctctggaagtgggccagttttgtagctcagcgttgaaactacccctaaaaacagctctcctcttccacgacaaacagaagagttgatttggtatacttactcttttaaaatcgcctttaaatgtttcctccattgtgaggccttcagatgtccccaggcaagtaagtagcttccttcatctgtgtgtactgtcttacgctgtgactgttgtggactctggacttggggaccacctgttatctctgtccccagcctctatctgtgaggcagttccaacacaacatgaaggcaacaacaagtgctcagcagggtctcaccttacagcaacttgtaaataccccaagaaatccgcttttaaatgtggagttctggccgggcccagtggctcatgcctgtaatcccaacactttgggagactgangtgggcagatcatttgagcccaggagttccagaccagcctaggcagcttggcaagaccccatctctacaaaaaacacaaaatttagccaggcatggcaacgtgcacctgtagtcctagctacttgggaggctgagatgggaggatcatctgagcctgggagggtgaggatgcatgagccatgattacgccactgcattgtagcctgggcaacagagcaagaccctgtctcaaaaaaaaaaaaaatggctgggcacggtggctcacacttgtaatcccagcattttgggaggccaaggcaggtggatcacctgaggtcaggngttcgagaccagcctggccaacatggtgaaactccgtctctactaaaaatagaaaaattagctggccatggtggtgctcgcctgtaatcccagctacttgggaggctgaggcaggagaatcgcttgaacctgggaggtggaggttacagtgagccgagatcacaccactgcactccagcctgggcgacagtgagactttgtctc

SEQ ID NO: 177228 - DNA, 586 bp, Homo sapiens
atggggtgacatacatgaaagtgctatataagccaaggattatcagcaactcttcttcagatgagaaaactaaagcctacagagcttaaaacacttgcccaaggacgcatggctagtaaatggtgaccacaggccagtctgctcccaaccacatgccatatcccaagtgcctcaatgggagtgcagaggatggacctaatctagcctgactagggtgggctgcagtgcagggcagcaagatatgaaggcctcaccaagttcagaaggggcagcaaaatcaaccagatgaagaagtgcattccaggcagaaggccagcatggacaaagaacaggattacccaggaacatgacacactgagctgctttctctggaaaatgcaaggtctagactctgatgcatgagtccccttctagccggacactcctccattctgaaccactctttgctcagggaagcaggggtctttgtactgcaatctggatccagtctgctcattggccttttgtggtatttagcacggtgcaggtcccagaaccccctatcgcttctttaatcagtggaggcggaggtgagcatacctagtta

SEQ ID NO: 177229 - DNA, 3294 bp, Homo sapiens
  misc_feature (2769)..(2769): n is a, c, g, or t
  misc_feature (3090)..(3090): n is a, c, g, or t
ggaaggaagataaggtgcctcctgtctgggggataacagtgctctcttacctcactcagagtgaatacaggcatggaacaaatgagtatgtgcgagcagggatgcactcaggagaggagcaggcagtggctggactggctgttatgactaggggcggggctcactgccaccctcccacaccagactatcagcagcagcaagagcgtctcctgggcagctgaccccaaaagtgctgagcatgtgctggcagtaaaacaccccaggcttctcattaataaggatgctttctgtttgtgtctcccctgaaacattctcaaagggttttcccttctgttacatcattagctatcccagcagccttcagggtgggaggcacaagatcattcctgttgtacatggggaggaagcaggtctaaggatttgcttggagcctcatagcaaaccagaaacagggctgggctgagaatccagtctctgccacatcccgtgcataggtacagtggcacctgaggtaggaggcatgggagagagtgggatgaacagacctctctccagccctgagatgtccatggtttggctgtttcagcccccagagttgttgggggtccttgtgaagcaactccacacaggtgttgagtggggcacagggtactgtcagcttgttagtaagagggattccttgggcccagataatttgtcagcagctccaagagtgggaccccaactctgtcttctctctttagaggtaactgaatagcaccagggaggagcgtggcggcagcaccaaggcggaagccatgctcttttgactctggcttccgtcaagagctgtcttggaaggagaaaggagctcctgagttgaatttcaggtggacacccaccatgctaaatagaattccaagccactagcctctagccacacaggttccatcccaacactcctgtctgtgggacttgatctgaaaagccacactttggttgggaaccttgcccagggctggctggagaggggcctgttgtgccactcagggaaggccttatggttccctcatcctgggtgggcttcaggctggggctgcagactctggcccagctccctggtgggccagtcaccagcactgctggctctgagtcctgatttcttactttggctttcctggtggcacctggtttgattctggacagctcatttcacatctagcatggcatataatccagccagacctgggtttgaatcctgccactacagctcactagttagctgtgtgcccttgggcaagcccctgaatgagtcattccatggctgctgttttctcctctgtaaagcagggaagatagcgcccactttccagggctgtgctaaggagggaagcctgtgaagagcacctgtcacaacaggaaatgcagacgtgggagtcactattgttaccaccctcttgttctagcaggagacagtggctgttaccagaccctcccttcagggacagcccgatgactcctctgggccaccagagtgggttctccaaaagggtgcaggagaacggggagccatttcccagagctgcaaacctcccagggagtgctcaggctccatctccctcagcccccagctgcccgccagccataactgtaggatatggtgcccaggggagccatgaaaggcgaagcttttacctccatctcctgcacttcaggcccccaggccccaccctaggacttgctgtgggatgggctggaggaagggctctggagtctgcagaaaggactgccatgttcctggctctggcatccttctctgtgctcttggtgccaggcacagccatcctgatgtctcatgctcagacaccacagactggaaatggtggcatctcctcctcatcagttcccccaagtcccatcagtcaggtgtccccagcgtctcctccaccaccgctgccttcatcttgcctgcccatgtgcagccttgttccctctcctctgggcacgggcccctccctctggctgctcctctgcaactaccagaagactctgtggtagcccttccatagcgctttatctctagggagaacatctggcttggcctggcatccaaggcctctggtgagcagcctcacctgtccttttccaggttgctctcatgtggtcccttccccctcctacccattccatcctcttcctgacaccaaacttctccctgttcccaaaccctgcctagctcactgctgttcctctgcttgcactgttgtcccaccaccctcctcctgacattccttcctttttttcccctttaagtggtttaacaactgacttcatgtcagggagataatcaaaaattccctgctcacattctctggaagtgggccagttttgtagctcagcgttgaaactacccctaaaaacagctctcctcttccacgacaaacagaagagttgatttggtatacttactcttttaaaatcgcctttaaatgtttcctccattgtgaggccttcagatgtccccaggcaagtaagtagcttccttcatctgtgtgtactgtcttacgctgtgactgttgtggactctggacttggggaccacctgttatctctgtccccagcctctatctgtgaggcagttccaacacaacatgaaggcaacaacaagtgctcagcagggtctcaccttacagcaacttgtaaataccccaagaaatccgcttttaaatgtggagttctggccgggcccagtggctcatgcctgtaatcccaacactttgggagactgangtgggcagatcatttgagcccaggagttccagaccagcctaggcagcttggcaagaccccatctctacaaaaaacacaaaatttagccaggcatggcaacgtgcacctgtagtcctagctacttgggaggctgagatgggaggatcatctgagcctgggagggtgaggatgcatgagccatgattacgccactgcattgtagcctgggcaacagagcaagaccctgtctcaaaaaaaaaaaaaatggctgggcacggtggctcacacttgtaatcccagcattttgggaggccaaggcaggtggatcacctgaggtcaggngttcgagaccagcctggccaacatggtgaaactccgtctctactaaaaatagaaaaattagctggccatggtggtgctcgcctgtaatcccagctacttgggaggctgaggcaggagaatcgcttgaacctgggaggtggaggttacagtgagccgagatcacaccactgcactccagcctgggcgacagtgagactttgtctc

SEQ ID NO: 177230 - DNA, 509 bp, Homo sapiens
ggaatctcctggtctgcgggttgcaaagactgtgggaaaagcgtagtatctgggctggaatgcaccattcctcacagcacagtccctcatgccttcccttggctaggggagagagttcctgaccccttgtgcttcctggatagggtgatgccccgtcctgcttctgctcgctctctgtgggctgcacccactgtctaactagccccagtgagatgagccgggtacctcagttagaaatgctgaaatcacctgccttctgcattgatctcactgggagctgcagactggagctgttcctattcagccatcttgccagctgcccccttattgggttttaagagttctttatatattttggataatggtcttttatcagatgtgtcatttgcaaatattttctcacagtctgatttgttttctcattcttttgaatttgtctttcaaagaacaaaagtatttaattttaagaaagtccaacatatccattatttattttatggattttgggt

SEQ ID NO: 177231 - DNA, 354 bp, Homo sapiens
ctatgtcagactaggaaagttagtgacacttatcattattgaataggttataaaactcaagaacaggacaggtgtggtggttcatgcctgtaatctcagcactctggcaggccaagggaggaagatgacttgagcccaggggtttgatactagcctgggcaacataattttaaaaaataaattaatttttaacaataaaataaataaaatacataacctcaaggacaaccttataaaattaatcctgataattgctcctagatgaatgctgatgaaggtaagtgaattctaaaaacagtactaatctcccttctacctcaccaaatatgtttcttttcctgaattctttatcct

SEQ ID NO: 177232 - DNA, 955 bp, Homo sapiens
agcacatagaaacacattctggctgctcagaggcaaaggctctccaagcccactgatccttgctagtgtcattgatatatctcgagcaagctccacctgcttaattgcttcttcactctgaaatccctcctgaaaaacctagcgcttttatgaagttcttccttggcttcataccctcagtatcaatttacaagagggaaaaagtccaaagagaaacagaagaaacattgggaaaagtatgcctcaaaaagcctttgtaggtaagcagatcaaggacctctgtaccagctttcactccattgagtgttgctcagcaaggggcttgacctgtctcttcacctgccaccacaaaggcagatggcaggctacaaaggacacattcattgtaaagaattataaagtctcattctgttcacagtggccaagaatgccttgagcattcaaaacctgagatgtgtggaagaaaaagtgtgacaaggactacttgatttgcatgtgacaaatttaactcaaaccagcttaagcacaaagagaatgccaagaattcctgtccagattcagaattaaggaattaatttgaaaaatatcattagatctctatctctctctctctctctctctctctctctctctctctctcgtcgatttgagagaggagatttattcacagcacactttccgcgcgcatgatagaaaatagcgttgggggacgatctggtggggtgtgccccaccaaatccatcttgatgtgagacacaataatcccagggtaggagaagcacgggggggaagaatgaaacacggcaggaggtccccaggagtcacgaacagagttatcccagggacatggggtaaacaagccccaggaagaaacgcagcgcaagacgggtctgtcccaccccaaagagagggcccatggaaagagaccaatcttacacacaccgttcgacaaagg

SEQ ID NO: 177233 - DNA, 215 bp, Homo sapiens
caatctttttggtttaataatttaaaaatttaaaggcatgactcatcccctgactatggctttggctgcatcccataagtttggtaagcagtgttcttatagttagttgtttctcaaatatctataatttcagttttgatgatctgtctctttgatgtaacagtgttttctaaaattttcaagtagtttatttctattcaagtttgttttgcttt

SEQ ID NO: 177234 - DNA, 564 bp, Homo sapiens
atacatcctactacctaataaatatgagacatcaggaaagtcacgtaaaccctagtcagtccttagaaattaaatgtccaattatgagctattcagaagtttgagtctatatttcaatatgtttttactatacttgaaagagccctttaaatataacaaagagaaagagagaagcccactccacgtgatgtaagtctgatgatcaaatatggttccacatttttcttacatgcattggcctagggtgttttcacacatggtgttttagaagtgcctgactttaaaaataatgttatggaaatcctcatggtgagaagagcaaggctacttataagctatgaatagcatctgaggcgagaattctaacagtcatttctgggctgtatgttcttagaaagttacttcttcggtattatttatttcaggattatcttaatctcataatggtctagagactagttagtccttaaccttcttaaaaactaggaaccattagttgggttctttaacacagagctgtgacaactggctcaagatgtactcatgggaaacctgtattccaca

SEQ ID NO: 177235 - DNA, 487 bp, Homo sapiens
agcccacggtagatttagcataatttttatggggcttaagatttttggaatggtaaatgagtactggcttcagcttaaagtcacaagctgcattagccctaacaagaaagtcaacttgtcctttgaagccaggcactgaatgctcttctctagctgtgaaagtcttaagatggcatcttcagccgatggaagaaggctgttttgtctccattgaaaatttacttagcatagccattttcatcaatgatcttagcttctacataagcacttgctgtttcaatgtgcctttttttttttaacccgcccccaagaggcagggtctggctctgtaaaccaggcttgagtgcagtggcgtgatcacagctcactgtagcctcaaactccggggctcaagtgatcctcccatctcagcctcccgagtaagcggggacagcaggcttatatcaccacgctgggcaaatctaccgtgggcaaatctaccgggggc

SEQ ID NO: 177236 - DNA, 466 bp, Homo sapiens
ccagtgtgaccacatgcatagttgccagtggggcccacttaagccatgctgcctgtaccactgctacaaacgcccacactgaggctgacactctggcatctgctagcacactgccacagctgacaagtgtgcacccctctgtgctgccactggcacatgggaatgagggtagatcccactgccactgccttacaaaactctttggcaccacccgctggagtgtagtgacaagtagtccaggggcaccttgacaccctcctacccccagtgcagtgggttcctaacattgaggagccagagaacaaaatagggtcccaataccagtcccccagatttagagcatgtaatctgggagttaggagctgaaccttggccacctaaaatcttccagaaatgaagccagttgactgaacccaccttatataccacaatcaaaccctcaaggtcatcaaatagggtgaaagga

SEQ ID NO: 177237 - DNA, 143 bp, Homo sapiens
tcctcgctacactggcctttccacgtttctcctggtgaactgaactgacgcatcattcctcctcgctcacttcttcagtgtcccaggcgggagcttctccaagccgtttcctgcagggttggactctcccacaccggctttcc

SEQ ID NO: 177238 - DNA, 423 bp, Homo sapiens
ttaagacccccaacacagactgaaccaaactactcttacttcttaccgtatatcctgatcacaatacaaactggactgtttactattttcttatatcttagtttgtatccttccttcagtttgccagtctggcttgctcattctttcaaccttagttcaggtgggtttttttgtttgtttgtttgtttgtttgttttgagatggagcctcgctctgtggctggagtgcagtggtgtgatctcagctaactgcaacctctacctcccaggttcaagcgattcccctgtctcagcctcccaagtagttgggattacaggcacacaccaccacgcctggctagttgtttttgtatttttagtagagacagggtttcaccatgttggccagctggtctcgaactcctcacctcaggtgatccacctg

SEQ ID NO: 177239 - DNA, 378 bp, Homo sapiens
ttcatttctccacaaagttataaaaatataagaagtagaaggatatctaaatataaaatatacttgctatttacataaattcttggcctacatgttcaagccttgacatctatcaaaaagagaagtccataaattaaagctgagatgtctagcaagccaataggtctgtaattggaaatgatgggaagcaataaaaagaatttcccttatataaacaagatgaactatctactagttccaaattgaaatggactacgtggaaattaaacacaaacttacaaattccttcatagtgcaccacaaaagatctaatagtctccaagctagagactaaagtaaatagatggcagaggggttaaagtgtgctttgtgattttc

SEQ ID NO: 177240 - DNA, 223 bp, Homo sapiens
tggttcagtggtgacagcaagagcaggctgagaatttcagttcccaaatgacatgtgccaaagacaggactgaaagatgggtcatgcaagcggtagaaaatgctctctgatggccaaggataaacaactcaggcggcaagaaggtgaacttctgctgcagcccaaagcaacacatcagaatgccataagccactgcagtttatttttctgccagatgatctct

SEQ ID NO: 177241 - DNA, 436 bp, Homo sapiens
ggtgaaaggtggcaacaaggcactggaatcctgtagtctcacatctgcagggctgcccctctttgcaggcagatggggaatgagaaactgcttggtatccttagtgaggtcagtccccaaaactctaatggggtagaggttctggcaagtcagattggcacacacggctcagaaccagagcctatgggaggccagtgtcccaccctggaggccgatcgcaaagagaaggattgtatagtctccagacagccacatggtacaggagaccgaagaagagcatatcctacgcacacaggaaaaaagagactagaaagacagatacttaccagttcttttctgacaaaagtgaacactggctcagttaacaccttggctctgggagataaggagaaactaaaagggccacatggtcctgcttgctaataagatcactatc

SEQ ID NO: 177242 - DNA, 783 bp, Homo sapiens
gagatggaggttgcagtgagccgagattgtgccactgcactccagcctgggcgacagagagatactcggtctcaaaaaaaaataaataaataaataaataaaataataataatgataatatgatagcagctattattttatcgagggctctgccaagtgctttatatgcgctaggctctataatcttcacaacaacctttaagaaagactctgttaccatcttcaatttacagatgcagaaacgaagcacaaagatgtcatcaaagtgtctgaaggtcacagggccagtaaggccatgggaaatgtgcatgttaatctgggctctttccattctgctcattgcttctcaccttcccttcctttctaggtaccaggggaacagagtaggtagagactggtctcaggctgcctgaaggctgacacagacccagccctgaccctctcacaacgtcacactgcatttgcccccagctcctctcagtctagaaacctgcaaaccccaggatcctagtgtctaagcacaggccccagtgtctgttaggtcaccccattccaggcttggatctagccccaccccctccctcaccatctcccacctcctcagtcaaaagcaaagtcaagacaggcagccaagccagtcccagcagaactccttgagaaaggtgacatagcagcagcaacccagcctgagaaagtgccctgaagccacagcagcccaacctgtccaaccagatcaccctcctcctcacccagaaggagtgtagcctggagggtggctttcaa

SEQ ID NO: 177243 - DNA, 590 bp, Homo sapiens
ggatttagaaccaaaatttgctggggggaaagaattaccagcatcaaagtcctaggatgtgtcagggcaccagaagagaagttttgtcactgtaaaataactctcttggcagaacatgatggagactgtaaacagcaggttacttcaatggttatgtgcggttcagtgaagttctctacattaactgaagcacaactcactgcgtcccaggctctcctggttcacgtgtgatacactgcacttggggtggaggtgtgctgacagttgtaaagggctgagcctttctttcccgtggctctgatgcacggtttccagataccagtcatgaaggaagttcttgagattatggactttgtcctagtcacatagggctgctaggacaaagtgccatagacttgggggtggtggcacatattaaaaaaagaaatgtatttgtcacagtctggaggctggaagtccgaggttagcatcccagtgggcaaggttctggtgagggctctctctctggcttgcagatggccgccttctcactgtgtccttgtgtcaggtgcgagataatagtagggtcggggttttggctttagggtcgg

SEQ ID NO: 177244 - DNA, 535 bp, Homo sapiens
aggagaatccgttgaaactgggaggcagaggctgcggtgagccgagattgcgccatttcactccagcctgggcaacaagagcgaaactccgtctcaaaaaatatatacatacatttttaaatcgtgcataaaatacaggcatccccaattaaaacaggtgattgttttatcttgttatcaaatagttgagctgctctatgtagtcctgggttctgtgtaaatagacactacaattgtgggcaagtggcatagaaatctaactaggatttggaactgcttcactgttaaccagcttctttgcaaacgtaaacaagaatgccgtgtaattataccaccatcatatgtgaaattttattctgatttcataggaaccttgggaaacagctgaacctattagcagttttagggaatgttagttctgttgtatagggtgtctatctgattattcagtttgccacagctgccttttgggcttgtgccttgttttgaaatttgttccattgatcatatctgctgtgcgatttaggaggccttt

SEQ ID NO: 177245 - DNA, 544 bp, Homo sapiens
acgagataaagatgtgcaaactgacttccaaatttcagcccccaaatgaataaacacaggtaaaataactttaaatatttgggatggagagacaacactagtgcagagaataattcattttgatgtgaattgctatgaattatcccacaataattccccagctttatcatgagtatgttaacagagtaggaacaaattattatccatatcctccccaaattaaaatccatttaaaaattgccttaggtctcagcaggagttttaaaacctaactgaacagaatttataacatgctttgaaatcaaccactaaaaggtgttttcttttctaatttccatgatctataaatcactgtggtctagattttaaattgtcacatgcaaggagaggcaataaatccttagtgtataacactatgtatctgggcattataatacaaatctccaccatctatgatttgtaaaaagtaaaaaacatgcttattataatgttcagtgttgatcagtggaaaatgtggaatgactgatgggatcccctttggaat

SEQ ID NO: 177246 - DNA, 514 bp, Homo sapiens
agaggatcccgtggaactagaactgcatgagtaagccctgctaacaatggtctggccatctgcaggctcactgacttgccagataaactgcttctagttcccaggctaagcttgaaagtcatccgacccagcagcgaagccatttgatcgtaggaccagcactgttctgtctccttgttccccccagtctccacctttgccaaggtgtacttgggcgccagccccagggtcaggttgccagataatgtatccattgctaatgagttcagagacctctctgctcagggccaagcgacgggacagatccttctgctctgagactggctggctggcacaaatgagctgctaggatctcactggagaaatctccactgggctgaatcagctgagacctaagcctctcagccctgttgagctgctccttgtttgacaaaggctttaacccccaaattctcacccaagcagagaacttgcctcttctctgcccacttcaaaaccagatgacttacagaat

SEQ ID NO: 177247 - DNA, 652 bp, Homo sapiens
agaaggtcttgacgttcagagtaattcaggatttgatgttgtaaacagtgaaaaggggaactctcaggtagggtgtattttgacgaggtaatgttttagcagcagctctgtgtatgaaatacgtggagagaaaagagcagcaggtacagttgtccaaatgggggccagggaagccttggcctgggctggtggctgttgtactaggagggcccacacggtgcaaaggtgtgggatgcacagaaggttgcccatttcttagcatttctgttagattgtagggtccagtgctacatgatcactgtagtagtatatctgtctaccaagtaaagtcctacgtgccttgtgatttttacatgtagatttaaaaagttgacgtgtaacttacccatagtaaatgaacaagtgtgaagtgtgaattctggtggacttttacatatgcatccaccgccatataaactccagccacagcaagatgcagagttgaatcagcaccccaaaaggctcccatgccccctcctcctcctagaaagttcaccagtgttgcatcttccagaaaggtgatgaccgttttgcctttgtcggcaaagatgaattttgcccgatttttaccttcatgtaagtgattcccgcaacagagagacccatttaagtt

SEQ ID NO: 177248 - DNA, 568 bp, Homo sapiens
aggaggggttcaggagctgagatgctgagcctggggtagggaagacttgagtggggcaggccctacaaaaaggggttccatcaatccaaataaggaaaagtcacaaaggaaaggtctggtctcaatagtgaagggcattgttccctgagagatcagtgtgttgtcacaggagacaggaagctctgaacacttcaagacatgcttagaaggccccccgatgtcagcagaaaaggggctgctaatgtcatctcagaaaccaagttatccccatgcaacaaaatcaatcacgtatcaaaacatgatggagagacagcctgcagaagtcagatggttcccggagcactacaggataaaaaggaccttgaaatacagaagacaaagtacaggctcatgaatgtctggacacaccagcaaattgagcctgaccaactgcactgacatcctgatgagtcagcttgaatcaagaagatgggtcccaaataactcagggtcacgcagcagagagagatggggattagtcaagtgtgttcactctctcaccgactcttcctgattgaattcccacact

SEQ ID NO: 177249 - DNA, 264 bp, Homo sapiens
agtgccctacacagatgcaccatttttcatcttttatcccctagttttactgtaccttttctatgtttagatacacaaactcactatcgtgttacaactgtacacgtcacaagccatgcaggtttacagcccaggagccaggggccgcaccacacagcctaagagtgtagcaggctgtgccatccaggtttgtgttagtatattccacgatgctcgcacaacgatgacattgcctaatgatgcgtttctagaatgtatccccat

SEQ ID NO: 177250 - DNA, 351 bp, Homo sapiens
cttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcct

SEQ ID NO: 177251 - DNA, 307 bp, Homo sapiens
ggctattgtccactaaaccaaacctaattcccagaaacaattcacagccctccagcagctgtccgctgtacacctccagcttcagagccactgtgtttgggcccagcctgtctgtttgctgccagcctcccaccatgaaaactgtgcctcttcactgccaaccagacttgcccttcattcaagaccaagctagaaatccatcacttttaaaatacctctctgaaattttatacacatactctctctctctctcttattccaccaaagatttttaaaagtttttatttaggctgggagtggtggctca

SEQ ID NO: 177252 - DNA, 864 bp, Homo sapiens
ccaggctggtaccgccccggagttatgggatccactagggaggagagcaaagtaatcagaacctcccaaggatggataacaaaatttcgccggaggcccaagtggcggagctggaacttgacgccgtgatcggcttcaatggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggattaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagtaagttccagttacaaggcggcatcacttctatacaaacttccgaggcagcaagtgacaccaggttaactccgtacagaccagaagaatcggccaattaaccgtgtcagcttcacggactctcacccgagacgctcaa

SEQ ID NO: 177253 - DNA, 1064 bp, Homo sapiens
ccaggctggtaccgccccggagttatgggatccactagggaggagagcaaagtaatcagaacctcccaaggatggataacaaaatttcgccggaggcccaagtggcggagctggaacttgacgccgtgatcggcttcaatggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaaggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaatgggacaattcgagtatgggaattggatcttccaaatagaaaaatctggccaactgagtgccaaacaggacagttgaaaagaatagtcatgagtattggagtggatgatgatgatagctttttctaccttggcaccacgactggagatattctaaaaatgaaccccaggattaaactgctgacagatgttgggcctgcgaaggacaaattcagtttgggagtgtcagctatcaggtgcctgaagatggggggtttgttggtgggctctggagccggactgctggtcttctgtaaaagccctggctacaaacccatcaagtaagttccagttacaaggcggcatcacttctatacaaacttccgaggcagcaagtgacaccaggttaactccgtacagaccagaagaatcggccaattaaccgtgtcagcttcacggactctcacccgagacgctcaa

SEQ ID NO: 177254 - DNA, 770 bp, Homo sapiens
ccaggctggtaccgccccggagttatgggatccactagggaggagagcaaagtaatcagaacctcccaaggatggataacaaaatttcgccggaggcccaagtggcggagctggaacttgacgccgtgatcggcttcaatggacatgtgcccactggtctcaaatgccatcctgaccaggagcatatgatttatcctcttggttgcacagtcctcattcaggcaataaatactaaagagcagaacttcctacagggtcatggcaacaacgtctcctgcttggccatctccaggtctggagagtacatcgcctccggacaagtcacattcatggggttcaaggcagacatcattttgtgggattataagaacagagagctgcttgctcggctgtcccttcacaaaggcaaaattgaagctctggccttttctccaaatgatttgtacttggtatcactaggaggcccagatgacggaagtgtggtggtgtggagcatagccaagagagatgccatctgtggcagccctgcagccggcctcaatgttggcaatgccaccaatgtgatcttctccaggtgccgggatgagatgtttatgactgctggaaagtatgtgtctgcgttcggagttttcagaactcataaattgctatattttcttgcacagaaaacatggtcattctgatctgggggaacacgtctttagtcctggataaataccttacatcatagtttttgtgattttgtactcattaaaagttctcttcactgg

SEQ ID NO: 177255 - DNA, 619 bp, Homo sapiens
caagcgattttcctgccttagcctcccaagtaggtgggattacgggcgtgtgccatcatgcctagctgatttttgtatttttagtggggacagcgtttcaccatgttggtcaggttgttcttgatctcctgacctccggtgatccacctgcctcagcctcttaatgtgctggaattacaggtgtgaaccaccgcgcctggtcccaacacatttgttttattcaatacgtgttgattaagtactttttatgagaaagccctaatttaaggtcatggcaaatataacggtgagactaacatgacccatctctggctgagtaactttgaaattcacagatttggccaggcacggtggctcacgcctgtattcccagcactttgggaggccgaggagggtggaacacgaggtcaggagtttgagaccagcctgaccaacatggtgaaatcctgtctctactaaaaattcaaaaattagctggtcgtggtggcgggcgcctgtaatcccagctactcaggaggctgaggccggagaattgtttgaaccctggaggtggagctttcagttagccgagattgcgccaatgtactccagactgggtgacagagcgagactctatctc

SEQ ID NO: 177256 - DNA, 822 bp, Homo sapiens
gttctccactcccacccttgtctcctttatttttcttcccgtttttcccataatgccttgttcatctctctctcattgcctgtcacatttgggagcctgagaatcaagatgggtttcttggttgcctgagggcaggcctagtgctggaatcaccagtgacttcatacctggcttcagttggtcaccagttggtgacagagctgcctgatacttgtctcttactgacagcatctatcaaatctcttccaattttttctcaatgaaatgtttcctttcactgtggataccataactcagatatgttagcataacaaaatagtatctgttttcagtaaactactttacttttactgagggctttggaaataagctggtgttttgagttcaggtgtaatgtagccaaaaaggagaaataattaattctttatacttcacctgactagaatttagaaatcagtttttctttacacatcccagacatctagagcttcagtccagctgaagtctcatgaatttttcaggctagtcattatgcatcttcttgcttcctgccttcgtttttgcacttttccagtccatccctgcttggtgaaattcctgctactctccctttaaaactgcctttggattcttccttctcttcttcagacagaattaaccattgcctgttaatcccgttgtgctttgttcattcttcagaataattataaggtgatacagtggtggagcgagctgcaatgagaggccatatgatacagtgactaagactgtggtctctctgtagccagacagtctgggttcaggttctctccccaacttaac

SEQ ID NO: 177257 - DNA, 214 bp, Homo sapiens
gctgccacaagtggaggacatttgaactaaggccctgacaatgagaagaaatcagctatgcaaagatctggggaagaggcattcctggcagagagaacagcaagtacaaaggcccaatggcaggagtgtgcttggcgtgattgaaggattgtcaaaaggccagtgtggctgggcgttgtggctcacgcctgttatcccagcacttcgtgggcag

SEQ ID NO: 177258 - DNA, 256 bp, Homo sapiens
tggacctaacagctggatgccgtgtggtgatatcactatcagcagaagatgcaacaagaccggggccactgctcaaggccagagaaacaggtttgtaggggccagtgggtcagcggtgaccatagaagacagtcttctctactttgatagcaaaacaatgcgtaaggcacctgaggaactcagattacaaccagggagaagaaaatcagaggtacaaggtgggatgcatcctgaattggtagaggagataccccag

SEQ ID NO: 177259 - DNA, 214 bp, Homo sapiens
cagctcaacaaagcccctaaaaatgatgactgcatccatttccacccaacgccacattctgaaagtgatctttttgaaacgaggattgcaaatagctgcagcttctcaaaactgcaattgcttttcatggtgtggcattgctgtcttcatgctgacacagctctcagcactgacaccagcctgcctatgagccgttaaagatatttcacttcca

SEQ ID NO: 177260 - DNA, 133 bp, Homo sapiens
attgtgagtgttcagtcggcttggtgagggatggcagtgggcatcttctgcctgtggtgggcatgcttgtgggggttgagagacctgccatccattagactcttgtgtactgaagagctacctcagtttcctt

SEQ ID NO: 177261 - DNA, 593 bp, Homo sapiens
tagtggaaaactcagtgaaacacaaccattaaaatgtgaccacacaaaaacgtatttatcagtataaaaacttttaccacatggcctaaatgttttaatgtgaaggttattgtaacagttatacaaaagagtgtatactattatctatgtttggagaaataccgttatacacataaaatcaaatgttttataccaactcagtgggaagtaaaaaggaatataaacacaacaaaccaaaatgttaacagtaactatctctgaattgtagtacattgagtgattttagtatccctttgtatttattttctaatcttgatccaatgaatatgtatgtcttccataataataaataacaacaataaagggagaaatctggtaaataaattgggaactgcccaataactaaatgtcactggcagccatgttgctgtggccatggcagaccatgcaaatgtctgacaacactctgggaaggaagggactctctcaatcagctgtcatcctatggcataaattccacttttattccctaagtgctttgagggctctatttggcaaatattacaacagatgctgaaatacaggagttgtga

SEQ ID NO: 177262 - DNA, 306 bp, Homo sapiens
ccaggtgctgggtcaggtgctgaggccccatgtctgaacagtcaggcttcctgccctggaggagctcatggtctcatggagagaatagatgagaaccatccatgccaacaagtaaatataaaaaagcagtgatgacttccatgaaggaagcaaaaaagaggttgagagatgatgtcagagaaatcctacttactatagggtgatcagggaagccttcctggaggcaacagtcaagttgaaactcagaagatacaaggaacagccatgagaagagtgaagaggaagatgttccaggcagagggaaca

SEQ ID NO: 177263 - DNA, 289 bp, Homo sapiens
acatctgaagcaggagttgagttccctggtaggagcctccatgttcctgacacaaagcggggtagctcagcgcctctgtgtacaggcctgagtgtcctggctctgtactgcctctatcctgcagcaggacccctcagggctcactggccattgttaagtaggacatggggcattcttccagcaggaccctgagccaaaggggtacctgcccaacccttgactcacattcaaggtatagcccctgccggacacctgcactgggtatggggggcagagatggctaggacat

SEQ ID NO: 177264 - DNA, 181 bp, Homo sapiens
gcctttcttcattgctgttcttaattgggctacgggtttgactagtctagtagagacccaaaataatagtgattagatgcaccgtatgatggtatgccctctgggccatgtgtttgacggtaacagctaaggggtggcttattatcacatctacattccagccagtggaagagggaagtgg

SEQ ID NO: 177265 - DNA, 188 bp, Homo sapiens
aagattaggtaaggattatactgaaatatatcagggttatggaatatgcaatctaccaatacttctaaaacaaaatagcagcatgataagtaaaggggatgagctgtatttatatttacatggcttgcctgggaagctcaacaaaaaagaactatgttctcaggggcaggcgtggtggctcctgcctg

SEQ ID NO: 177266 - DNA, 323 bp, Homo sapiens
cttgtgctgggcaccgtaggggctatggaaggagtaagacacagtcatgctctcaaggaactcgctgtccagcagagtgataggacatgaatacatacttctagcaaaggctgagtagcattaggcaggtggccagatgaggtcagagctctggccctagtgccctgtagtaagttgcgagggagtaggaaatgaagacaaaacagcaagagcacaggtccagcacaagaaggtgaaggacatggaaagaggagcagagcatgataaagctacaaaagtagggggcaagtcatgaggtccgggtcactggggagccctggaca

SEQ ID NO: 177267 - DNA, 869 bp, Homo sapiens
aggtcttgaaaagtgcaagaggctcttccatggctccaagcacatttgacactcttccttttttgatccccaagcagacagtgatgaaaccccaatagctgggcgaatactcatccaacaggaagaatcagttttaagagctgggttctcagggtcaaatactgtggtgtggccttttggttgtaatgagttgaatggaggtctcaaaaaagatatatccatgttctaatccccagaacttgtgaatgtgaccttatttggaaaaagagtccttttggatgtaattaagttaaggattttgagataaggagatcatcctgggttatctgggtggaccctaaatctgttgacaatgtccttatgagagaccccagagggcacagacaggaaaggaagaggcaatgtggccccagaggctgagatcagagctctgtggccacaattcgaggaacacctggagccaccagaagctggaggaggcaaggaacagattctccctgatcctctggatacagagggagaatagcctggccgacaccttgattttggacttctggcccccagaactgagaaaattaacttctgttgtgttaagcagccacgtttgtagcagttcatcatagcagccctgggaaagaaatacagtgggcttccagttcaaggaggatccacgaggcctgagctccatctgtcgattggaatcaccaaaatcaaggttgtgtgcgggtaacgccagcacaagcagctcatgctggcaaaagcagaccaaaccggctcacgcaacgtcaagtcatcttgaagtggttcacgcaccacagtgagtggtattgattgtggttaagagccaggttcaaggaggtttatcactc

SEQ ID NO: 177268 - DNA, 566 bp, Homo sapiens
catctgaaaactgttgcttttggcctgaggttattacaaaataagactgtatccacgtgttaccggttggaagggcatggacaccgctccccgctccttgaaacactttctgctctcagctgcgtgaccgctctgctctgattttcctcacgccttactggctcctctttgtctcctctgctgatgtctcctccaatccagttcccttctctactctttctagtccctttccctgggttttcaaggtcatcttacataggccagatactcccaatccacaccctcagcttcctcttccttactccatgtggctgtagacaaatgcctacttgggatcttcacctggatggttaatcagcatttcaaacccatcatggccaaaggactctgtgttctgcactccaccctcatcttcccattctcagtaagagacaggattatccagccaattgttaaagccaaagttttatccctgatttttctcttttcctcacacactctgacaaccctacctctaacattgattcccaaatccacggacttccatcatcttcagccttcttacg

SEQ ID NO: 177269 - DNA, 119 bp, Homo sapiens
tgatactgatactgctggtcttaggaacatactttgagaaacactgaactaaataatacgtgaatgcctgaaaagaaaaataagcaaactagcatgtaaaaacatgatacaattttata

SEQ ID NO: 177270 - DNA, 591 bp, Homo sapiens
atagctggtcccaacccattggttttctcagtgacttgtgatggacggaactgggaactgaatctccagcaatcagcagattctgggcagttgtttgtggtctttctcttttcctctctggcttgcctttagagtcccagaactaagcctgccctgcatgtctgtatctatctatatcctgctttctaatctcctttcctggtctgggaacaggttgcttggggccagactgctttgtgatgagtgggttcagaacaaagcctgtctggagaccctgaaagcccctttgaaggataggagctaattgggacgggcgatggagagaactatgacttgatggaggataccagtgaagagggcttgctgccatccactttgcaagtagggactccatcattgcagaaagtgttcaaactttctgagctggttttggattttttgttttctatatcttttgttagatttctaatttgtctgaactattgactagattgtaaataaagttagtccaaggaaacagtttgtttcctgttcagagttataaaacattacagttgtgttctctgttaagtactgtctatccctaatatt

SEQ ID NO: 177271 - DNA, 501 bp, Homo sapiens
ggggcatctggtgacacgggatgctcccagagagccctgctccttccaggtaggaaggtgtgcccatgctgccctgcaggcaagagcaaaatgccctgtgctgggaagggatggagctcagggcagctccacccgcagactccgtgcaggtgccctaggctgcttcccggctgaccaccaacccagagagacagagaaatgctctactcagatctgcttttcacctggagcctgattaagaaacctaaagctccagaggtcaatacacacggaaaacaaaacaaagctacctggatcagtttagagtcctagcagggacagaattgccttggtggctggacgcccaactcccaagccaagcatctgccgtggccccctgacctgctcaccaggagaggggacaagctggctcctgtggtctgcagccacctgcacacattacactgagaattcaaattaaatgcagagtcctaggcccaccctggcataccaccccatgca

SEQ ID NO: 177272 - DNA, 264 bp, Homo sapiens
gcaaaccaagtattgctaataccttggtgtagcatgagaaacattggtactatatgagaaaacttgaataacatttttgaaaggccttttgtaatatatgagattctatttcaaagcctacctgggtttatgcttagtctagaaatactttttaagaagccataagaaaacaaatccttccttatacattactgtgaatggacttgatatgaaaaggatggcatgttttttatgaagacaacttaaaaagtgtgtagtttacaa

SEQ ID NO: 177273 - DNA, 522 bp, Homo sapiens
ccccatgtaaccacagtacaactatcaagtgataagtagcattactatttaatccacagaccctattccagtgtgcatggttatactcattatgtccttcatgaatctgggatctgatcaagaatcttaagctaaactttggccatcatatctctttagtcccctccagtttggaacaatttctcagtctgtctttgtcttccaagatctcatttttgaagagtgcagctctgatgatttctcatgattaaatttaggttataccttttgggcaaagatatggtggaaataatgctgtagagccttataatgatgatgactttttatcacttggctaagatagtgcctgccacatttctccagtgaaaagctaggaagtgtttttatttattactaagtagatatcctgtttatcaaacaatcactctccagttttgccattcattggatcttgcctgactcagtttttactgtgatcgttaccaaatcatgaattttaaataaaattcatccttcttctgt

SEQ ID NO: 177274 - DNA, 330 bp, Homo sapiens
ctcggcttcccaaagtgctgggatgacaggcgtgagccaccacgcccgactgatttttgtatttttatttttttgggcgggggggacagtgtgaacacagtccctccactaccacaaattacgcagtcaagtttcccacatttggggaaaacgcagggctcagcacatccggagtgcaatggctaagccttgccctgggaaaaccaccttcgcgatcatggtatctcccctgccgggtaagtatgatttttgtatttttaatagagatgggggggtttcaccatgttggccaggctggtctcgaactccagacttcaagtgatccgcctg

SEQ ID NO: 177275 - DNA, 350 bp, Homo sapiens
cagtcttttcatctcagaggttacttagacaatacgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcggt

SEQ ID NO: 177276 - DNA, 371 bp, Homo sapiens
cctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcggt

SEQ ID NO: 177277 - DNA, 1468 bp, Homo sapiens
ctcagactggcacttggctccaaggcttaaaaacaaacctggagcagacactgaatgctagaatgtgtaagctagtcaggaaagaaagccaagcctggtctagcagattaaggaggattttaagagatcaatgatgtaagaacatgatttcctaaaaaccatgtaggggaactgtcatctctgcagtgaataggtgcatataggtcctaaaaaaaaagtgaatttggggcctgatagcctaagacctttcattcctgggttgcaaaggcagagtaacaagctagaatagatatgcctcacctctccagagagactggttgggagtgaccaaaagggattcctgccaatattaagcctggagaagatgacaccccatctgctgagcctggagactcaagccagggaccagaggagtggccccggctaagagaagcttaccttttattgccaagacttgcactggcttctgtcactatggaaaccacgtatgatctctgacctccaccagggccaacttcagcctttaaaaccacctttccaaatgaaacaagaaagtgctgagttctagaaaatgtgactttttaggtcaaactgtggaccctaaacatgtgctactttcttaaagctgtgtgagtaaacacatggtctccaaaccacccccgattctgtaatcataagagggcaccagtatctgggcatcagtgagtatcctggcagatggatctggctggatgaggtaagggagttgtacaggtgtgctgagtctatctctactcctgagcctgggagatgtgagaaaacaggaaaatgagagtctccccgccagtgacttgataggggattgagaaccaccatttttgtcccttctgagaaggcacctcagctgctggccctgagcccagagagcagacaaaagaaaacattacccttatacttagggggcacagcaatgctcttagaagaggctcacatgaaaccaagccactagggaacagtaatacatttaaaatattaacgttaggacataaacattccagtagagcacaaaaagactttctggaaccaaatgacaagatctgcagacaaattcagtagctgaaggaaagaaaagtagtagttaataggaagtaaatttcccaagttaagaaagggcctgagtctgcctattggaaggttttggcaagttatgggcaagacaaatgattcataggttgagaaattccagaagtctaaggatgaaaagaaaatcttacagtcttccagaaagaaagtacaagtgacttataggggaagaaggatcatgggggcatcaactttctcttctatgacacctgaagtagggatgattgaggccaatcgtgtgaagattactgagagaaaaacactgcacaccaagaatcctgtagcaagaccccactcctctgtcagggtcaaggaaacatagttgagaatatgcaaggaaaagacc

SEQ ID NO: 177278 - DNA, 329 bp, Homo sapiens
atatgctaccactctttagagatctatgactaaaaagtcatattgaaaatattgcctgtactcagaaggtaaccaccattcattgcctctagtaagtataggacatttggtagctaatgattgtaggtgaaaaatggcattgtgattaaaaaacaaacttggatagcattaaaagaaaaaaaaggagaagagaataaggaactaaaaggagaatcactaaaatcaatgtattattaagttatcatgttcatcatttccacctaaatctaaacctaaaaccttttccaggaagtatttcccatttagtttaattccatatcattctaatt

SEQ ID NO: 177279 - DNA, 369 bp, Homo sapiens
  misc_feature (357)..(357): n is a, c, g, or t
cgtgtaaaggttagggaggaaggaggtcctttgatatctgggaaggggatatctagggctcttgggtgtttttcaggagatggtgaccggtaactgtaaatgcctgtggagaggccacttcttaagagttgaagaccaccagggtctccacattaaagggcctggccatgggaagaacagtgataggcccaaatttccagactgataaagagtagtggaggtgggaggctactaaagacccaggaacttcatgtggaatttcagctttgcttcattccagtttcatttatttagtggatatttatccttcctggactaggctttgggattacaacccagaactaacctttacacggngtaccgagctcg

SEQ ID NO: 177280 - DNA, 404 bp, Homo sapiens
tagatcatcatgtaaataaaaactaaatacctcaattgtggaacttgagatcaatcataattttttttcatattatgaacagaacatgaacatacaatcataatatcttaattcaagagaatattagatttttttattgttgtttgtttgtatttgtttgaaatggagttttgctcttgtcacccaggctggagtacagtggtgtgatcttggctcactgtaacctctgcctcctgggttcaagcgattctcctgcctcagcctcccaagtagctgagattacaggcatgagccattgtacccagccatttccagcacatttttatcaaagaagtatgtcacacagttttagagtccaatatcaatcctttgcctcatctctcccattcccaattcctactccc

SEQ ID NO: 177281 - DNA, 602 bp, Homo sapiens
ggcagctgcccgcccacccatgtctgtctccgtcgcacactctggggccttggcctctgcagtctctgtctccttccgtcactctccctgttccccctctccccatggagggaggacggacagcagtttggtggggggacagggttggccctcgggtctgggagggcccggctctgggtgcagggctgagaggggcgcctggtccgcacgacagcctcaggccagggctcgcctcactctgcagggccgtccctctccgggcagtggcctccagccacactttcggggacccagccagcggagatgcaggccagaggctgtcgtctgagagggccctgacctctgagagggccacctgggggcagctgacccccgtggggccctgggcaaggaacaaaaggctgatgaggccatcaggccccttccctgaccctccctgtccggccctcagtgggaaacagccacagagaagagcaggcctggtagtgaccaggtcacctgctcctcccagggccagtgacctgtgcctcttctgcaccttcctgggctgggactgtggagcctctgctcgctggggggcggtctgcagagctgtgggtgtg

SEQ ID NO: 177282 - DNA, 151 bp, Homo sapiens
ctacttggtttttttaaaagtacagttgcatctagtatgcctgcctttctgcctgtctgtccttccacctcttctacctctcccacccctcagacagcaaaaccaacttctcctcagccttgtgaagaggatgaggaccttcaggatgatt

SEQ ID NO: 177283 - DNA, 211 bp, Homo sapiens
  misc_feature (6)..(6): n is a, c, g, or t
ccggtngagcggtctgctctggctggtacaatgggtttgcctttacagtgatgcatcctcttgaactttgcaagaatctagtgtggtaattgccagatgtttgcaattttagctataaaaagatggctgctttccattcctgtgtatgttggatcttttttctttctacccaagctattgtggttcactaaaataggccactgcactgatg

SEQ ID NO: 177284 - DNA, 376 bp, Homo sapiens
atgcaaggaagtgagtgttgtgggtatggagtggacacaagaagggagggaggctgcagagatggtgaggccagatcagagagggcttttatacctggtaaagagggatgttaaggggagtgggggtgaccgcaggtccccatatgctctgggtaaggccacacatacacaccccttcagcaggattgcagagcccctaattagctttgtgatttttaagagccacttccccttctggccaccacttttcttatctgtaagatacggaagttggactaatatgacatttaaacttccttccaattctaaccatctctggatctggataagccttcgctcctttttgtgtaatgaatgcagcgagtcctgttgccta

SEQ ID NO: 177285 - DNA, 530 bp, Homo sapiens
tactgatacccttgaactaagtttatagaaatatgtatgggtgaacgtgtcatatttaacaggaaagttaatagaaatatccacaacctcacagcattttttttaatttgagttggtatccaaccaaataccataaaaacacaataatgaagaccatctcatatacaaaagatgcaaaatttaatggggggaaaaaaaaaccccttcaaataaccatgcagaagccctagcaaagcagttattattcccagagcatcgccactatcccatcctccagaactatgtttattatgacttattagattttggacccatctaaaattagtatcttctaaatgatggtaaatggaatataaagaacaaagcctccagtgtggccctccatttcaaagagctctgaagacggcaaaaagggacatcagtatgtgtgcaaatacgagtcaccaaaagggtttgtaaaagcatctaaaaatcaattaattaatcctcccaaaccactgcataaagacagtcttcccacccagtgaacc

SEQ ID NO: 177286 - DNA, 672 bp, Homo sapiens
  misc_feature (27)..(27): n is a, c, g, or t
gtccatctagatggggtgttaggttangaggatgaggactccaggtgctgtggctcacgcctgtaatcccagcactttgggaggccaaggcaggtggatcaggagtttgaggtcaggagtttgagaccagcctggccaacatggtgaaaccctgtctctactaaaaatacaaaaattagctgggcgtggtggtgggtaactataatcccagctactcgggaggctgaggttgcctgaacccaggaggcggaggttgcagtgagccaagatcatgccattgcacttcagcctgggcaacaagagaggaactccgtctctaataaaaatatgaaaattagtctgatgttcctgtgctggcctccctgtctatggggatgcctttctgaacttctttgtacaccatgttaggctgtccttctctgtggatgcccttctcaccccatttgggcttcagcaccctgtgactagccactactttctgtgtggtcactgccttccttgttccaggtgggctctgacactgtgctctgggccatgtgactcccacccagagtagacgtctgttttgcctgaccccacttaatggacttggatttattgcttaggaaggggagggggagataaaaagcttgaagattactttttttttcaatttttaaaattgtaaaatac

SEQ ID NO: 177287 - DNA, 582 bp, Homo sapiens
ccctcacggttacctcaagtgttggacaactgggaaccttccagggcccgagcacctaaaattctgtttaaaaaattgtcagcctgggtgacagagcgagactccatctcaagaataaaaataaaaacaaaaataaacataaaaataaacactttatgtacacaatctcacatcactttcacagtcttggaaggcagatatttctgttatcctcattttacagctgacgcctatctaaggcttgtataaaagtcagtcactgtccaggctcacacagccaatgctggagggctgtgtggcacccagagagcacagttgctgcttggaataaaccttcacttatagtccggagcagggtggttctaaagctcccttagctttcccactagtaagcttccaggttctggtacagtttctcagcctcggcactactgacgtttggagtctgatgagtctttgttgtgagcgctgtcctgtgcattgcaggatgttaggagcatacttggcctctatccactagatgccagtagcacccccctcccaactctgcccagttgtgacagccaaaatgtctgcagacat

SEQ ID NO: 177288 - DNA, 776 bp, Homo sapiens
gtgtttgtagtgtgctggccacgggagcactctaaacacattatgggccgggcgcagtggctccggcctgtaatctcagcactttgggaggctgaggcgggcagatcacttgagcccaggagttcgacaccagcctggccaacacggcgaaaccccgtctctactaaaaatacaaaaattaaccgggtgtgatggcgcgtgcctgtattcccagctactagggaggctgaggcaggagaatctcctgaacctgggaggcagggactgcagtgagccaagattgtgccactgcactcagcctgggtgacagagcgagactccatctcaagaataaaaataaaaacaaaaataaacataaaaataaacactttatgtacacaatctcacatcactttcacagtcttggaaggcagatatttctgttatcctcattttacagctgacgcctatctaaggcttgtataaaagtcagtcactgtccaggctcacacagccaatgctggagggctgtgtggcacccagagagcacagttgctgcttggaataaaccttcacttatagtccggagcagggtggttctaaagctcccttagctttcccactagtaagcttccaggttctggtacagtttctcagcctcggcactactgacgtttggagtctgatgagtctttgttgtgagcgctgtcctgtgcattgcaggatgttaggagcatacttggcctctatccactagatgccagtagcacccccctcccaactctgcccagttgtga

SEQ ID NO: 177289 - DNA, 250 bp, Homo sapiens
gactttgtgaatgagtgtgtgtgtgtgtgtgtgtgtgtgtgcgtgtgtgtgtactcacggtagtgtgactgaccatattttatgtttacctgttgattcatttaacaaactattattaaacatcactctctaccaagtagcatcacagaagctaggaagagagagagaaatgcaacagacagccaggcaaaaacattctcgtcaacaaaggacatgtcttaatgtgaagtgtctggtaagaaggcacaga

SEQ ID NO: 177290 - DNA, 615 bp, Homo sapiens
tcactggatcaagccccttccttaccttccacctctgaatactgagtcattacaactgtatgctcaccagggctctgtttaacttcatgcctgatttgggggatgttattccttggtatcggattcagctggccctcctactcccagtggcccagggtggcatctgcttgcctgtctagtctgggactttctttgtgaagttttattatctttctttacttaaatgtcatcttttctgcattgctctcccttctttctgacaaggggcagacctgctgacaaatagggtttacagccacattcctttgttgatggagtcacaccaggtctgatagcctttgtattaaataatgaatctttgttagcttcattaaggttgggaaaaacactatagatcaaaaagataaagagatattttcagggcttcatcttcatttcctcaaagagatgatcacattagtatacagtgactcaggcactcctacttcaaagcagctcctacttcaaagctcctaagcagtcttaataataaatggtggctttgcccaccctgcagacttttcaggatgatggagctagagatcaacatattgagcagcctggaatccatcccgc

SEQ ID NO: 177291 - DNA, 418 bp, Homo sapiens
cctatgccctcactgtaaggaaatgaagctactgttgtatatcttgggaagcacttggattaattgttatacagttttgttgaagaagacccctagggtaagtagccataactgcacactaaatttaaaattgttaatgagtttctcaaaaaaaatgttaaggttgttagctggtatagtatatatcttgcctgttttccaaggacttctttgggcagtaccttgtctgtgctggcaagcaactgagacttaatgaaagagtattggagatatgaatgaattgatgctgtatactctcagagtgccaaacatataccaatggacaagaaggtgaggcagagagcagacaggcattagtgacaagcaaagatatgcagaatttcattctcagcaaatcaaaagtcctcaacctggttgg

SEQ ID NO: 177292 - DNA, 625 bp, Homo sapiens
gattcggcatgaggaaaaaaaaaaaaaggtaatccagaaaagtacaaaaaagtgaagattacccgtaatcccaccaccctgaatttatcatatgtagcattttacatatgatatatatacatgtttataattaagtacatgtttactctgtaaagctttctaaaagttaatctaatatagtaatcaaccacataaagcacatttcatattacaacacatgttgatctaagttgtgtaggtgtatgtgcaagtacttacaggaggtttatgtttaaaggttttttccccccttttcaacaactaaaatagattcacaccatacatggtgttttgttgaaggtagatagaacttaaatatttctgtagtctggagaatcaaaaaacaataaccttccgtctatattcttctcaacagcttctgtaaatagattcacttgtcttagtggctcatgatctgcactctgcgttagtcatttgaattttaaaaaatacagatagcaggctttcactccccatagagttggtttgggttgttatgttgggggcccaggcatcagtatgtattttctaaaagctccccaggtgattcttacatacacctgaagttaagaactaactaatctaa

SEQ ID NO: 177293 - DNA, 472 bp, Homo sapiens
caaggagggctggtgtgtagtttgtgatgttacccatagtgatgagaagcacaggtcactgcaaaagtgttcatggagaggaccctcctaccaaagaaatgacaagaatcttcctgcccagtccctgagtgttcataacttcctgaacttgcattcgaatgttccctacttcttgcccctagaatccattctccacacaacagccagattatgtctctccctgcttaaaacctttcttggcttccattcctattcaaataaggttcttatcatggccaataaggcactacagggcttgttttctgcctacttcttctactttttccccttccactcagtgactatggtctagctattatgaccttctctctgtcacccaaagatggcaagctcatttctctctccaacacttggcactcttcccataggaaagttttcattttttgggtctcctcctcagttaagatcggca

SEQ ID NO: 177294 - DNA, 248 bp, Homo sapiens
cgttatattaggaggtgactcagccatgaataaggtgaagaggttacacatctacctacggaatataataacatacatttctagatgaagcccacagagacccaatgctcaggaagtaaacctgtcaagaagccaacacagtatttgctcctccaaatgttcttgtttctctgtgtttcatgtcttggttactggtactatcatccacccatgtggaaccatctagaagcctaagaatcaccttcaga

SEQ ID NO: 177295 - DNA, 382 bp, Homo sapiens
ccacttaccgcaaatcaaggtaaaccgacctctgagaacacaacctctgagcagcgacatggtctttatggaagtgcaaggtcagcaatttgacaggtgtctccaagaggcggcagggttacatgcagaatgggcttcttccttggagggcagtgttggcaaacactgtggccggcacattttatcagacagagccctgggtactgcctggcccgccccctcgctgtggctgtgcctgttgagggcgcctcggccctttttctgaatggtgatgcactgaattgccaccaggtggtgccaaacggcaactaaaactcccgcactgaaattcccggaagcattgcctttgaggaaaaccctggatcagccatccaggtcctca

SEQ ID NO: 177296 - DNA, 766 bp, Homo sapiens
ttccttaagggttagcaactcagtaggaatgtaagtaaacaaatatcctgagtatttcacctacaggagtgaacatggcaggtgacaatttgtcttctgatataatattatttgttgaattagtcccggattagttctgaaagaaaaatgaaattgaccattaggaagtgcaacccagtgaaaagttgcatagtcaacttctgtgacatcttgtcagatttacatgtgtgaattctcactcatcatggctcttgctgtctcctcaagggccaaagaaactttttcccatagacgagtgtgtaaccagttggtgggcagcagtttttaggaagctgaatctcaaaggtccgtagcaggccagatctcgcatgaccacccctgtgttcttctcccgtaactgtacattcagcttcccctgcactttcccaagagcaacagaaaaaaagcaaatgccaggtgagttgtttattcatttctcatgtttccattgcataaaatgataaaagattaacatgataaaaattatcaaggaatttatagttaacagatctaaaatagggaaaagtcaacatattaattataaagatatcaagataattataatagttttagtgtgtatatattatacattgtgttgtataactgtaattattagtaacgtgcagacttatctctgatactctgtgccaaaggacagtgctttgttttgaccgtaagaataaacaaaagaggccaggtgtggtggctcatgcctgaaatcccagca

SEQ ID NO: 177297 - DNA, 445 bp, Homo sapiens
tacaccgtctgtgactagccatcttgtcccatagcgactggccgtcgtgtcaagttgtcacagtcttcactacttccttgacctgcaagtaggaaacaagaaaaagaaaaactaattaaggaagtgagcaattaaattctttttttttttggaaatggattcttgcactggttgcgccctggttagaagtgcaatgggcgtgatctacggctcacctggcaacctacggcctcccggggtccaatgtgattctcgtgcctcagcctcccaagtagctgtgattacaggtgtgtgccaccacgcctggctaattttttttatttttagtagagatggggtttcaccatgttgaccaggctggtctcaaactcctggcctcaagtgatccgctcacctcggcctcccaaagtgctggaattacaggcttgagccaccatgcccggcc

SEQ ID NO: 177298 - DNA, 135 bp, Homo sapiens
tggtacttgcagggtgagatgggggatggtacttgcagggtgaaatgggatggtacttgcagggtgagatgggatggtactcacttgagggttgagatgtgggggatggtacttgctgggtgagatgggatggta

SEQ ID NO: 177299 - DNA, 238 bp, Homo sapiens
ctcacagccaatcactggcctccattctcccctttcctctgtacagtttgctctggttcctcagagcagatttccgagtatactgcttcagccacgcccccactgtgccgttccctgaaccaagagccattcgtctcaagagccattcgtccaaagtactctatcacctagccattgtagccataccaagccgggcttcctacttccctctgctccccttggtttcctcctgtgaagt

SEQ ID NO: 177300 - DNA, 796 bp, Homo sapiens
gtgccagccaccccatcacctgtttacctggccagctctcctcacctttcagggttctgggccacacctcctccaggaagccccccttgatctcctttccttccacatcccccggagctaccctgatttcttctacagctgagcctcttttctgccctgccggaatgtgaatggcatgagggcagggaccatgtctgttgtcttctctgctgcatttccaaggcccaggcgagggcagacaccaacacatggtgcttgcaggggtctccctgactgttgttgctcccagatcatactgcttgctccaccggagcatgtgcctgatgccttcctctcccgcttgacctgaaagttcgaacctcctgataacttcagcattaacagcgtgcttgagttaagttcacactctagccactctatggaatccacaccataactcatggtgtcctatggggcaggaactgtccgatctcaaggtggtttgttttttttattgtttgcttttgagacaagatctcgctctgttgcccaggctgtagtgcagtggtgcaatcatagctcactgcagccttgagctcctgggctcaagtgatcctccatcctcagcctcccaaaatgctggtgtgagccaccttcgccagccctgtctcagagtgtgacagctgggaaaactgaagcccagtgaagcaaagtcactggtcccatgttgtccctgatccagcctcccctgaggccccaccctctctgccttgttcctggcagcgccccctctctcgtcaccccatgccagccactg

SEQ ID NO: 177301 - DNA, 525 bp, Homo sapiens
gttgctccctaagtcaactacttaataattaatggaaaggagatgtgacaggaatagccaatttccctgtcctgtttggtatgactgttggcaatttgatgattccttccttaaccttgaagcaatctcagtttgactgactcatactatggggaagatagtggcctttgaactcttgactcaatacagtcttgaccttggttagatactaccttgacctctggataaaactgtactgggcattactattttattgattgttctctcaacaaaacaaccgtatctttaaaaaatttttttatcttacatgtctgaagtagaaggtcacctcttttgtagtgaaaaaataactattttccccatggtgtgctgaatgcatgggttaaagcaggtagaccagctgtcctgggttttatccctatgtgttttttgctgattcacaaaggcatttaatttctctctaccacgctttctaggtctgcaaaatagaaaggggagttcatgaccatctatgcgttactgggg

SEQ ID NO: 177302 - DNA, 318 bp, Homo sapiens
aggtgcacaccaccatgcccagctaattttcttgtgttttttagtagagaggggttttcgccatattgcccaggttggtattgaactactggcctcaagtgatctgcccacctcggcctcccaaagtgctgggattacaggcttgagccaccatgcctggccaattttttaaaatttcaaaccccaagaagaaggttcctttccccttgaccccaactccccgcatataaacagttcataaaaactcctcagagtcagctgggtgagaatcgcgcagccatgctgtctgccgtttgtgttgggttttatagccagcat

SEQ ID NO: 177303 - DNA, 348 bp, Homo sapiens
tcttgagtatcctgatgtacggcctgctctcagaatctctcatgggctggctcatgtgaaaaaaaccaacgttgaataaagtaccagagcccacatctcaagagctgccactgtttgcctgaaagaccacctcccagggccttgatttcctcatctatacaaatgagagatgaatctgcttgacttctaaggacctgtagcttctagcattctatgaaaagaagggaggctatctggaatgttattggatgccctctatctgccagttactttgcaggggtcagcttttactagtttgccttttttttttttcagatgaggaaactcatgcctacagagtggttaaat

SEQ ID NO: 177304 - DNA, 177 bp, Homo sapiens
gtactttgttatggctgccccagcaaactaatacaagcaaactaatacagaaaactaatacaagcagtaaagccaacatctgttctgattggtaaatgcacatcctgtaagggatttaaatattttgcatatcagtcacatttaggcattatattattcaagaaattcactattcat

SEQ ID NO: 177305 - DNA, 464 bp, Homo sapiens
gtctaaatatgatgtctgtccacatgtcagattttatctggtcaccttgtgtgtgtgtgcatatgtgtgtgtacgtgtatgccatccttatttgcaaaggactccctttattctgaggtttgtctcttctcatttttggtgttaaaatgcctctcttttataaaatgattgtgatagtagatgatagttgtgggcaggtgtttggcaaaatacaagttagcaacccaatgtcgatttcgcctagcaaattgtttgaaattttgtgggtccatgaaattaacaagtactgtatacagcaaactctgccctagaataatgctccatgtgagaaattgatctcagctcttataagtaggaataacattgtctcttgtaaggaactagtatgtttccttctgttggtagtgaaagctacataatgttttcagtttcccttttcatttggctctaggcatttcggaggt

SEQ ID NO: 177306 - DNA, 464 bp, Homo sapiens
tatatccctatcaacattaaattgaattttttttttgttagctattgaggtttgggaggagggttgttgctacatagaattattacagcagaaatctgctgatacactgagtatccatctgtctaccagtgcagtatgagacatgagacataaggaaaaggctacatggttgtgctctttcccaggacacaatgctcccagttctctgatggttgtagacatttagttaaaaaaaaaaaataaagccaatacaatgagctcagtggttttttccgtatgatgtgaaacttaaaaattcagatgtggcaagaaataaacatggggttccctaaaaaatctgacgtagctgagcccagaagctcatgcctgtaatcctaacattttgggtggccaatatgggaggatcatatgaggccaggagttcaagaccagcctaggcaacatagtgagaccctgtctctaca

SEQ ID NO: 177307 - DNA, 179 bp, Homo sapiens
tgtggtgtttcactgtgcctgtaacctctctcacctagcatttggttaaccagaaacagatgtggaaactgatctatctgtagataatggccctgctcagggagggggtccctgctgagagcgagacattgaaagcctgctacacagaaactgctggaaggccaagccatttctttttt

SEQ ID NO: 177308 - DNA, 218 bp, Homo sapiens
agccccaggaaagcagaatgtgtgtcctcaatcatcagcatcaagaagagatgcaataaatgttttagtgaaggaaagatgcacattatagttcctattttgctaggtgattttaagagttactgcaaagctcatttttttaacatacagaaaatttcaacagctttttcagttggtaaagattttactgtttttattttttgtggggaggagaaaaa

SEQ ID NO: 177309 - DNA, 728 bp, Homo sapiens
ttagttgctgtcattcactttaattgcttgttgtcatttgaattccttaattaggagtagattatggaatttactagtctttttgccttgtcaacgcttagtctactgaatatgtgcaggaaaaacattttggggatttgtggaggggatgacagaaatcttcaaagtgatgaccctgtgcttgcttgaaatgatagttaggagggatggatgtgggggaagagaagctgaaatcctgattcttcaacaattttaaggaaaaaagtgatgaaaactgacattaatatgtcacagtaaagactcatataaggtgtgggaattgagcatgggatggcataattaatttgtgccaaataaacaaaatcagatcctttcttgagaataaatgttcacacagatgtgcctttatagaatatgtacttttaaaaaactccatatatgacatgttgtatgagaaggcctctcttagatcactggtgacctctagtactttggactaaaactaatgaaatattatttaggcagtttatgtatcatttctggagttcttgacttagagctaagggcgtgtgtagatactgatatccagcaagctgagccattttcaactataataacctaatgggtaaagcttctatagtagtctccttcaaacctgtcagtagcaatcactggggttatttgtttacaatgtaggtttttagacctctccccttgagattctggat

SEQ ID NO: 177310 - DNA, 523 bp, Homo sapiens
taacctggccaattatttttttattcttctattttatttattatttatttatttttaattacttagttggttatttagttattggactgactgtagagatgggaggatctcactatgttgaccaggctggtcttgaacgcctgacctcaagagatcctaccacctcggcctctgaaattgttgggttataggcatgagccacttcgcccagtcaaaactattttttaaataactaatgcctctatgtactaagaactttcatgaccactaccttatttgatatttcaatattttatctttatattggtatcatatttaagatattcatctgatttgatagcccccattattctagtccataaagaaatagaaaaaagatcagtggttgctaggggttagggagagaatgtggcagtaaagggatagcacaaggagttttctagagtgacagagctgttctgtatcttgactacagttgggggttacacaactacacacatattaacatttactgatgtatgcc

SEQ ID NO: 177311 - DNA, 648 bp, Homo sapiens
aaatggtgagacgtgttatctcgagctgttggcttttcctgtcatagatacagggtcacaaagacagaaaatgaaactgttagaaaatatctacaggcatcttcttttcccgtgtaaatattaggaagacagaatgaagatgctcctccgctctcatccacacccatggtcatatctctgaagaggggaataccagggagtgatcacattgtcagatgcagaaattaaaaaagcttttttccccagccaaactttatgcttgtggagcaacttggggaggagacccgctggtatgcatttgggcagattgtcacctgttggccacctctgtgatcgagacctttgccttagaggagttcctatgtagaccctgtctggtgggccgacagaccgacagtggacggaggcattctgtatgcgttagcctctgcaaacaaacacctgtctcatgccggaaatctgggcgccccattaaccctgagcacgggcctgccagctgacagaaccctagccaggtgttggtttggggttcagttgcatgctcaggtgttccccttccttcccccgttagcttgtccccacctaagcctgcaacccttgccactgggatgctaacccgttagcagagctcagtctccttgcttggaa

SEQ ID NO: 177312 - DNA, 415 bp, Homo sapiens
ttccaagactaattagtaatactaagtaacagagacagtgttggtatggtacaaaaataaacaaatatatcaagtggaacagaacagagagcccagaaatattcacccatatatggccaaccaatacagggcaattcaacggggaaaaaaatagattttcagcagatggtgcagggaaaggtagatatcaatatgtcaaaaggaacctaaatccatacccaacactctataaaaaattaactcaaaaagaattatagacctaaacgtaaaacctgaaactgtaagacttacagaatatatgagacaatttgtgacattgggtgaggcaaagatttcttacatgcactatgaaaagcacagtccataagagaaaattttgggcagggcacagtggctcatgcctgtaatcccagca

SEQ ID NO: 177313 - DNA, 466 bp, Homo sapiens
agccagtgcagtcatctgggcaagagagaatggagctggagtgtggactagggtgagagtgaagaaaaagagatctaagaaggctgcagagaaatgtaggagcaaaatcaataggacttggtgatgagttggatgtgaaggggcgatgaagcagcttcaaggatgatgccactgttcagccttggataaatggatggatggtgcagggattcacagatatggagaacactggaagaggagataagattgatcttgagctccatcttagacaagttgaatttgaggcacctttgagacttggttaggattttgcgatgattagttttagatgtcaacctgactaggttaagggatactcaggtagctgggggaacattacttctgggtatgtctatgagggtgttcccagaagatattggcatttaagtcaatggactgagtaaggaagatctgtcctcatctaata

SEQ ID NO: 177314 - DNA, 318 bp, Homo sapiens
tccatctagcagaaccgtgtagggatgcgtcacgggtcaaggcttgctgttaataggagacacattccgtttgtctccctctgtgtaacaatcatcaaaagcaacagttactgcaccgctgctgctctgccaccattccatttttatgatagtcttgtaaagtgggtggcactgaccccatcttattgatgaggaagctgaggctgggtgagattaaatgacttgcccgaggctgctctgctggcaggagcagggtgaggctggcctgtgtcaggctcttctgcatgtggagtgactcccatcgtgtggatgcttgtc

SEQ ID NO: 177315 - DNA, 397 bp, Homo sapiens
agtgtgtcaggcaatctggactttccagtgatagcactgagatggtgctccttaaaagagcagtggttccatttgtaggttgtggatctttggataaattctgccattttcattttacttcctgaaagccagggttggctcatgaaaaggtgttgaacaacatgctaaatgtgaaatgttaaccctcactctaaactttctctgttcagagcatcagatgaagacttaattgagttttatagtggctttctgattttgggtagtcaactgaagaagggagtttgaaagttgttgtgtactgttaatgattgtctgcccaagttctgcttgaaataccatgattgtttatggaaagtacctttactaaagctggataaagtttgaaataacaaaaaaa

SEQ ID NO: 177316 - DNA, 299 bp, Homo sapiens
gtaaaacgagccggtaccggcagtgctgtaggccagcggagacaatccaaagctgatgcagctgctcaaggatttcatccaggaaccagtatcctcctttcttcctagcttaaggtttttgtcttcatggtcagaagatggctgttgtatctctgaacactgcatcagaattttagtaaggaagaaaagggaaggataaaaggaaatgtctttttacaaggttttgcatttttgttctcatagatggtggccccttagaaactgatgtctatatttcgctggcctacagcacatgtcat

SEQ ID NO: 177317 - DNA, 432 bp, Homo sapiens
tttggaaatactgaaagaatgggtgtggggtatgtgcctgtagtgccaaccactaaggaggcggagtcagggggatcgcctgagcccagaagttggaggccacattgagctatgataatgcccggcactcctgcatgggtgacagattgagaccctgtctctttaaaaaaaaaagaaaggtaaataaagaaagctagaatgaatggaatactgaaagttgaccaaagagcagtacaagatgagactagagagttgggcaaggaacaatacagcgttacactaaggatttggggttttatgctaataatgaaacaagttttaaacatggtgtgatatgtttaagtttgtctttttaaattatctggaataacctagaggagatgtgttaagtactaatttcttattaaatacattattatttgtgttatgtaa

SEQ ID NO: 177318 - DNA, 308 bp, Homo sapiens
tgggaagatgaacattaaggcaaaacaaccaattgctcctgtgctttctctaatggaagctgcctcacccacctatgagctttctggcttggccatcgctgcagttttaggagagggctgctgttcttggccagggcactgtacttgtcttcctgaattgagagcccattaattgttttcctctcctttagggactgatgctttttaaccacctctgtgatggttgcacacagtcatcacagacggttgggaatggtgggctggtattttctgccagctttaattaaggtcctaccagggtttgcttc

SEQ ID NO: 177319 - DNA, 747 bp, Homo sapiens
gaaaagtctgacatgattgggcccagcagttgcttggttaattgagaaaactggttaaaacaggaatcacgaagaaatggatgtatgtttttaacttaaaacatgaaagtatacattcacttgccaattttttttttacaccacttacctcaagttctatacttgccaatcttttgatgtaagcccagggccttttctttaggctgtgtctgttttggcctaatcttagcagacttaacattttccaatatcagtttatttaaagttaaacaaggatataggcatttaagaaccaatttgatacgattatctttagaattttcttaatcttttacaatttttcccccatacctaattatttttttaacaaactcaagtgagccttttaaaaacatacaacttagcttatagagaaacaactgtttccttttgcattcatatttcattgatgagcttaaaagtacataactaccataacaggttcgggtagcaaaaatagatttgagaacaaacacatctggatatgagaacacatacaacttagctggcaaaagcttgcgatgtattagagtgaagcctacttgctgaaagtcgtcatcataccttgggcatcagctcgtgtatttcagggagggattggagagagtcatttttccaattcaagtcagttaaagtgagactgataagcgagcttctactctatgtgtgtaaactgaagtttaaacagacagatttgggttaaagata

SEQ ID NO: 177320 - DNA, 728 bp, Homo sapiens
tgtgggccttgcttgtgggacctggtgtcagctgatgacgtggccctgtctgggtgcccgtgagtcagatggcagggatggcctgacatcatgaacactagctccacctacgtcacattggacttgactctttacagagcacctaggaagagatattgatgagtgaaccattgcccagtcatcgagttaattatttccccccagaaaggttaacatactgaggacagagagggcatgtgtaggcggcagggcgcacttttcatttagtctggttcgcaggtgcggtcaagacgattccttattgtcttggagccagcccttttaagccttcctgcacagctctgtgacagtctcgcggggagacctgtgaggccactttccttttttccagacccacccccacctttgagattatcactcttcctgctttgtcttctgaggctttttggctttttagtttatttgtaattagagcagaaaaggtacagtaatcggatagaagggttgggagtgatagaatgagccaggatgcggtggagaaatggggtggagaacccccagaccttagggtggcgtgtttgtcagggagtagaccagggtgcagttctaggcagaccactagatggcactcacacattggtgttcagtcgggtccacggcactttccactttgggcttctgtaaaatctccccatgaactagccaaagctttgtatctgtcatcccgc

SEQ ID NO: 177321 - DNA, 253 bp, Homo sapiens
gactagaactctaagtggcatgtcgaggggctgctctcagaagaaaacagcttctttggtctgtgcattccttttgggaccaggtaaatattgtttaagatgagtttgggaatttccaggttgcctgagacactgtctgagaaccttcttagtacttggttctgacagcaagtgctgaagcggaaaaaatatttccatccatctgcactaatctcttgtttctctagcagttagaaagtggggaggggaaatg

SEQ ID NO: 177322 - DNA, 314 bp, Homo sapiens
cgctctgagccgattctgtccctgggaggtgggaacagtggtcaatgccccttaacaaagtcccagagaacctcttcaggctggagtatattgcagtgcttggatgctctagcccctcctagggatgggatgaaaatgccaagtgtccctgtccacagcttcatgtcttaaaaatgtagattcttcaaagagttttggaggatgcgccacctgccaagtctccaggggaaacagtactgtcatccttcccagcaggtcacccccagtgtgtggatggtgtgggtgtccaggctgtattcccaggccctatctca

SEQ ID NO: 177323 - DNA, 476 bp, Homo sapiens
tgtaaactcatttcagacgtttgaaacaatacccaatcactgcatccaccctcgaggagcgccccagaggaaatggcatcattactttcattttactccgtttgtgaacgactaaaggaaaacaacacgtcctaggactctcgggaacgttattaagtgacccctaagaaattaatcatcaagagctaaaataaccctctgctgcacatacaccgccgtttctctaagtggagaaacaaatttcactttccacagttggaacagaaactcttatgcatccccgtttcttcaaaaaaaagtctataaataacctaggatcagcaaaattatgcaaaacatcctgctagaagaagaaatgtaaactaaaaccacttacagagagactcaggctgccaacttaatctgatgctacgacgactgtaaacatgttgtacttttggaacctgaagcgatccacattagcacggatgtcagta

SEQ ID NO: 177324 - DNA, 691 bp, Homo sapiens
agtggtggttcaggcctgtaatcccagcactttgggaggttgaggctggtggatcgcttgagcctaggagttcaagaccagcctgggcaacatggcaaaaccctgtctctactcaaaataaaaaaattagccaggtatggtggtgcacacctgtagtcaggaggctgaggtggaaggatcacttgagcccaggaggcagaggttgcagtgagccaagattgcaccactgcaccctggcctgggcgacaaagaccttgtctcaaaaagaaaaaacaaaaagaaagaaatgatgttaatgactatcacttaacttagtgcctactgtttgcaaagcactatgttaaaccttcaaatttttgtatcttttcctcatggagaccttcaaattaggtggtatcatccttattgacagaagaagaaattaaagttcactatgcattctctacgacgcagaaattccattcttaggtacatacccaacagaaatgaagtcagaagtgcactaaaaatgtccgaaaatgttcataacagcattgtttgtaatagtcccagactggaaacaacccaaatgtccattaacagtgaaatgaataaataaactgtggtatattcacatagtaaaatgctgcatagcaatgaaggtttaaaaatgctacagatggtgtggtggctcacgcttgtaatcccagca

SEQ ID NO: 177325 - DNA, 645 bp, Homo sapiens
catacagaatacttcaaatccccaccccagacagtcactgatctgactatcatctctttggttgtgctttattccagaatgttatatgaatggagtcatataatgtatagcatcttcatactgccaccctttacttagcaacatagatgcaagattcattcatttgttttcatggattgacagttcattcctttctgttggtgaatggtattccattgcatggttgtacttcaaattgattatgcattcagctattgaagaacgttctgattacttcaagttttggccattatgagtagagtggctcgtatataattacatgctagttttggtttgaacataatttttcaaagcagctgtctaaacatacacaatttaggggtgcattggttggattgtaaggtaagacttgtttatctttgggaaaaactgtcaaactatttcccaaagtggctgtacccattcatgcattctgccagtaatgaatggccgtacctattgttcttcaacctccaatttttactgttgagcttttttaagagtcccacagttgtactaggtgtgcagtgatatctcagcattattttaatttgcagtctcctaatgagatatatcgagcatcctttgagtgtgattatgtgctat

SEQ ID NO: 177326 - DNA, 109 bp, Homo sapiens
gttgtctggagaatgcctaattaaaacagaaaattatttgtattcattacacttgaaatatcatctctataaggaacttttagttatttccttataacttttgttttga

SEQ ID NO: 177327 - DNA, 490 bp, Homo sapiens
atgttgtatgtatacatgaatagtgtctgttaaacactggagataataaaacaataatttttctgttaactataaaaatctgaacatttttgtgattatatttcacaaatgacacaccattttatttgcagatttttcttatctccaaagtttttgttaatttattaccaacacagcacacaattctagtggcaatgcattacctctgcagttgattttgaagtaagaaggcctatttattgcattcattcctgcttagatggcatcttaaattcgttaattggattattatgctctattctatacatttattgatttatagattttgtggacagaaatttcaaaacatattagaaaatttagtgatagctttttagaatctattcttcaacatagttattgaaagtgaacaaggaggacctcctctagagattaggttgagaaccacttgtttgatttgttaaatatgtatacatggataccatgtggc

SEQ ID NO: 177328 - DNA, 185 bp, Homo sapiens
ccacccccagtatggcatatatctctgccgtgctatcatctttattctttcctttttcattgtctcttcctgactgtcctcctttgttcattatgtctgacacatattgtggattgaaagtagaacagaaagatatactttctctaccagactaaaaagttttgagatggccctccatttctccc

SEQ ID NO: 177329 - DNA, 503 bp, Homo sapiens
caggttggtctcaagctactgacctcaaacaatcctcctgcctcaggctcagaagcagctaagactacaggcacaagccattgtgtccaactctccagtcaaattctatagccttagcttttaattactatgtaggctgggcgtggtggctcatgcctataatcccagcactttgggaggccgaggcaggcagatcacctgaggttaagagttcaagaccagcctgaccaacatggtgaagccctatctctactaaaaatacaaaaattagccaggcatgggggtgtgcacgtgtaatcccagctactcaggagtctgagacaggagaatcacttgaacccaggaggcagaggttgcagtgagctgagattgcgccactgccctccagcctgggtgacagtgagactctgactcaaaaaaaagtaagtaaataaaaagaatttgatcagaaacttgaatgtaacaaatagagtatagtaaatatagagtaggtgtggatttta

SEQ ID NO: 177330 - DNA, 379 bp, Homo sapiens
catctacacgtatatgaaaaagttaatttctgtcattgggattattgtgagaattaaataacaaagagcagcaaaaaataagcatcagattttgaggctaaatcccagttaggttgtgcctgttgaaatctgagttcctttcacctttgtatttgtaagctttcctttttctctgaactcttccttggcatccttccctacctttcctttcttccccccacatgccccgcctttttggataggtctcacagaagataaacagggtgaaaagtttcatgccgtagctcttctctcacagccaaccaaatgctttaaatccctcctctccctccatttgtcagtcaacatgtacttagtaagggctcacaggacatcgaat

SEQ ID NO: 177331 - DNA, 846 bp, Homo sapiens
ttcctttccacagtgttctttcgtccgagaccgaaaagcgcaaatgacctttggacagggaagggaggcagtaaacactcagacttccttaccagcccctggtgggcactgcagcagaacaattgtctgccccccaggttcaagcacctaggcctccgccccgcatcacctggccaggggcggacccgggagtcctccgaaggctccactccccacttttactactcttctttcctctccattctcccctcagattagcggccggacactgtccctgcctcgattttgtttgctgtgggagggaaaaaaaaagtttgctgctcctcccaagacactggccactttctactcactgaagttcccaccgcagcgctggctcccggctccctagctcccgccccctgtctgcaggaaagccctcccccggagcttccgaaactgctggaggttccagagttttgtagctccgaatgggcgacctgagccgaaccgctctctggctgggtggtcggcgggatccttcaggctcctttcgggtccgggacggggcggcggcagaggtggggcgtgcgtgcttggggctgccgagtgagtgcggctccctggtgcgcgcccgagcatctccccgccctctcctgggaccagcagtctgcccgtggagggctaggagcccgcgaccaggcctgccccggccgtcgccaacctgtccttggaagcgtggcggagactggtgcgctctcagcctcgtcgcgccagccgcctcgcgccaccctccactttcagcttcagagcagaggattccgccgacctccacctgtacctgtactcggccgttaggaaatccac

SEQ ID NO: 177332 - DNA, 254 bp, Homo sapiens
gctcagacttttgttttgtctcagcctgtgcttccttggattcttctcagccctttgctttctgactccacccctttcctttcctttaatctcctaccattagcttctttctctgatttccattctcccggctaggtttccctctctgtctgattctaacaggctttacttctccccttctttccgccatcctttccccctgtttccttctcccttagcctccgcctgagtactcagcatagcgatggggtaga

SEQ ID NO: 177333 - DNA, 1642 bp, Homo sapiens
  misc_feature (2)..(2): n is a, c, g, or t
  misc_feature (7)..(7): n is a, c, g, or t
  misc_feature (969)..(969): n is a, c, g, or t
gncacanggggagttggaaaaagcacatttttttcctccacatttaaaaatgactagaaggtgagagagaaagagagaaagctcacctgcagccggtgaagtcacgcttttgcattccgtttgtaggacaagttgtcagtgtgcgatgatttccataggctttgaaatggggtagcagtttaaacatatcaaatgcttaatgaagtgaggccccatctcatcggtattcagtgtggcactaacattacatacgctaatcctgaaacaataagctataaggagagcctcgctttctgggtttgaaatgaatggagcagtctgaattcttccagttttatctcctgctttaacctggaatgatgccagcatgttgggttttaccctggagaattcatatcatgtgaaaaacttaaatcaggtctgtctgctggtacacgcagtcctaatccgttaaatatttctagctaacaatgcacgtggggctcttcagctctgcatacagtcatgttctgctaagtccatgcaaatataaccacttctgcctgcttttttgagggagggatcagtaatgcctacatggttttacccaaatccctcatgcgacatacaaggctcttggcatatcttaaccctggtggtagctccctatccattctctaggacctggctctcttactgtgagcttgggaaggtttcaaatgagagattgcttctctttcattggtcatttaaaaggaaccacaactcttgactttatcaagttatagaaacttgagcccagagtcccggctgtagaatgtctaaagagaatgccactgaaccccatcattccctacgcccttctgcattcagaaaaattaaaaacattaggacttgtgtgaaccatgtatggggcatttttcttcagagtcaagcactgctgtctgaaaaagaacacttctttccagaaaactctgttttttcagaacnacctctttcattctgctgcctcattcccagaggagtgattttgtatttcccctcatccaaacacggagatgactttttcaggattgtaaaaaggaatgtgtgatcaatcttttatttaatacatatttatgaggtgcctctgtgtgtgaagttaagtgctgggtaaaagggcagtgtagcatcacagtcgcaagcatggattcgagagtccaactgcccgggttgataactgtgtgaggttgtgctgggtacacagtctttctgtgctgtggtttccccttcaggaaaatggggctgttgaccatactgacctcataacgaagtccttggggtctgacacctagcaggtactaagcaagtgttagctgccactgctgccatttctgctcctgctgctctgctgttgatctcattactgttaccttcatctttactattattaggtgctgggaacaaagttgtccaccaaaacaaagcgaaactatacccaccatggttcctgtccttatggagcaccaagtttcctgagggaggcatacactgaataaaagactatagaccaggtatagtggctcatgcttgtaatcccaacgcttttggaagctaagcaggaggatggcttgaggcagctgttcaagaccagcctgggcaacagagcaagtccccatgtctt

SEQ ID NO: 177334 - DNA, 302 bp, Homo sapiens
agccaccatacccagctggcccataacactcttaaagcatctcctacattgttctagtatttaggctgaaagttagggactttgactatgtgtggaaccacttgaattcatgtcagttcctggactgtactgtcacttgttatgacattattgttacctttagtttttatttttacaaccttatcaggtaggtatttaatgtttacattgaagaagtaaagatcctgaataacttctcaaggttatagtcacacagctagtaagaagcaaagtggcattgttaatacctcccaccattaaaa

SEQ ID NO: 177335 - DNA, 369 bp, Homo sapiens
ctacacaggcagggtcagtacccattagcatcaccagtctttttgttctctgagtacatcttagtaacttcactggaatgcccttgccccagatttctacaaggttagttctctgtcatcagttctcaactaaaatgttacctcctaaaaaaatacttccttgactatccaagctatacaaacacccaagtttaatcctctacatatcagttagcactacctgaaaattttatcatttatttacctgttgtattgtctccctgacctcctgaaccaaaatataagtttcatatgaacaggatccttgtctgccttgttcagcagaccagcacatagaatagtgcttgacgtccctattagaactggctt

SEQ ID NO: 177336 - DNA, 608 bp, Homo sapiens
ggaagattaataatagagcaaggaaggggtagatcaggacttcaattgtggacatgctgagttattcatttcagagaagagaggaaggtaagtggatatatgtgtctagaactcaaagggagaggtctgggctggagaaaaacatttggtagtcttcaacatatagaaggtctttcaaactgtaagcaggatgagatcacttcagggagtgagtacagagaggcacgagtaaaggaccaaggattgagccctggagaactccagcattaagtgttcagagagaagaggaggagccagcacaggaaactgagaaggcacaaccagtgaggtagaggaaaatccaggagtgtgtggtgctctagaagtcaagtgaagatagtatgtatatcaaaggagacggagtgatccacctgtgtcatttgttgttcatgggtacaagtaaggtgaaaactgagaattcatggttggatttagcaacatgatgttcatcaactttgaaaagagcactttctttagagctgtgaggccaaaaacctaactgggttgttttaagagaggaaaggagggagaggaattagcaacagtgagtatagtattgacaactcttt

SEQ ID NO: 177337 - DNA, 443 bp, Homo sapiens
aaagtgctgggattacaggcgtgagccaacgcgcctgggcacttctgtatatctttttcaagaaaacatgatttcctggtgggatgatagttttaaatatctggcaatctctaacaattcattggaatcacagggtagcagtgggcagaatgatcctgatgtcatgtaagaaacaggattttagtggagcactgattatactggtattaagtatcatttattacaataggaatgagtcacttttgtgttcctcaagatggacagattccttgagtggaattaaatagtttctgcaaagcaggctcagatgtctctgaagaaagcaaacaaccgtggtagccagaatagacccaatattagtcctgatttattggccttgtaatggcctcagcagaagcagtttgttggcacgaagtctaagcacaattgttgcaagactgaag

SEQ ID NO: 177338 - DNA, 108 bp, Homo sapiens
atcctgtctttatgtttcctatgcagagtaccattgggctgctttcctggagtatgtcttcccttatactcacctgcttgccagctacctaggcctgccacaacaaag

SEQ ID NO: 177339 - DNA, 351 bp, Homo sapiens
gggaaagaaccctgtgactttccacatctcagcgagctcggcgggctctgcttaagaagggctctaagacgggaagggaggagccatccccactgcgacctttcccctcctttcctggctggctggctgtggtctgtcgggaatgagggggtggggaagccgggaaagcagaaggttggggctggaggtctgctggcaggcaggcagacatttggagccaactttcctgctcagcccgcagaacttttggtccttcgctataccagagtttcgtctgtttttttgcttgactgtgtgacccttctctcacactgttattaaataggtctcaagctgcgaaatcactgccag

SEQ ID NO: 177340 - DNA, 347 bp, Homo sapiens
atcgcttgaacccagaaggcgaatgttgcagtgagctgagattgcaccactgtaccccaatctgggtgaaagagcaagactccacctcaaaaaaaaaatttgttagagatgaggtcttgctatgttgtgcaggctgggcttgaactcctggcctcaagcaatccatttcacttggcttcccaaagtgttgggattataggcgtgagccaccaagcctggccaaagacatggatttctgtgtccttaaaggaagaaagctccgctcagtgctttgcttgtgttcatgattcaatatttatttatttgtggaatgattgcaccaagttctgcctaacatacacagcatt

SEQ ID NO: 177341 - DNA, 601 bp, Homo sapiens
cacggtggttcacgcttgtaatcccagcacttttggaggccgaggcgggcagatcacaaggtcagcagattgagactgaaatggtgaattttatgttatatatactttaccaccaaaaaaaccaggaatatttaggacattggaggggacaaaagttttaaaataggacacaaaaagtaatatccataaaagaaaacattgataattctgattttattaaaaccaagaacttctgtttcatcgaaaaaatcattaaaacagggaacaagcaagccacagagtggaagaagttattcacaatacatgtatgtggattcacatacacaatccaacaaatgatttaatatgcacagtatataaagaactcctatgaataaagagtatgactctattatgaaattcaagaataagcaaaattaattcatactgttagaaattaggatagggattatcctgggagatgggaagatggttctgtaagagaacacaagaaagggcttcttgtagtactggcaattttcttttttcatgatctgaagactagatatacagatgccccagtgtgtgaaaatccaccaactgctatatttatgacacatac

SEQ ID NO: 177342 - DNA, 340 bp, Homo sapiens
attgaaactcttagcatttgtgaactggaaaatttggtggtgacagaactgtgtttctgtattagataagagatgttctaatagaatcctgctgctccttttgatggaataccgttctgaaattgcatccaaggatgaaaaagttggtaccgtggcaccctgtcaagtagctcctgttgctgtgaggtgtgattaaaagacacataagccagcagaaaatgtgacacaaagggcatctatataaaaaattaacagactacgtgatatcatttaggccagatttagaatcacaataaagaccttgttttagtctgttttgtgctactatcacagaatacca

SEQ ID NO: 177343 - DNA, 462 bp, Homo sapiens
ccaaataccacatcttgtctttgctatattttatttgtcttcgacagtggtagatttccttacaaattggaaaaaaaaggacagaaagaaaatgttagcaggtttaccacaaaatgacaataacatatactgttatttaagtttttactttctaggcctaaagaaaatgctgccataagaaatagaaacattactaagaatttagagattattttcccctacacaaagttgtatttttccaaagtctcactatgttaaaagattactacgggagaaatagaaactatacaatggctggtttgtgtcaacacttgcaacatttctatccaaagaaatcctaaaagatttaaatgaaagtatctttaaaacatttagctgattaaaagaacaaaagaaaaagtacaagaaaacgttcattattaatgaggagaaaaatggcaaaatggacaagtgttttcatgt

SEQ ID NO: 177344 - DNA, 406 bp, Homo sapiens
gcccgcctcaccctcccaaagtgctaggattacaagtgtgagccaccaagcccggcctgattagtttcttaacttcttcgagccccagtgtcctttaagtagcatagggatggtaatatctttctcataatagtattgtgatgataaaatgagttgttgcatgtcaatcactggcatagagtaagcacttaataaatggtggttgccatggtaatgataataatgataataccaatgacaactacaataatgataatggagaaaagtagctcaaggggctcttctaattcttttatggtaaactagagcatttctctagcaaatattacttgaaataaatgtgccttgtctggattttggaaatctgttattatagggagattttcagttagaaatttatccaggg

SEQ ID NO: 177345 - DNA, 257 bp, Homo sapiens
cttgacatggcgcagctggccaggccggtgccagccagagcctgccctcgtgggcccctgaactgtgcatgtggcgtgtgtgcgtggacacgcctgcgggggtgacaggctcctgtggtgatgactggtaccctccacagtgcctgcctgctccctgtgaggccaggcctggcaccagcagtgtgtaaaaccacggtgccgcccatctgccaggcccgtgctgactgtcatggcctcccacccagcgggacagtttt

SEQ ID NO: 177346 - DNA, 261 bp, Homo sapiens
aaaatatttcagctataatttgaatgcgcacctatactgagcatttacatgccctgtttcatttaatcctcaagaaagccctgtaaggttggcattgttatccccacattacagatgaggaactaaggtttaaaaggtgaagtaacttgagctcagaaagattaagcagctcgccctaggggaatcataagctagcatggataaagcccatatatattagaaccctgatcagaccagcttcagactctgctcctaaccact

SEQ ID NO: 177347 - DNA, 253 bp, Homo sapiens
gactgtggaagctgaagaaatacccatgggtgcgggggccattagacaagaacgaaccaagtgcacctttatctcacacaaacttgacaacttgttcttggccaaattaaagggaaaatatgtagcagtttaaggagtgccattccatcacaccaagcctctgccctcgagctaggggaagtgccacttccccatttgcccactatctgcgcccctctttgtctccacccctttctgccctctctgtgctcag

SEQ ID NO: 177348 - DNA, 225 bp, Homo sapiens
gagggtgttctggccattcagcatgtttccaagctagaggtgaacaattgtcatttccggtaacttcccctctacagggtttctaggtattatgcttcttgttcttcttcttctttttttttttaaaaaagagacaggatcttgctctgtcacccaggctggagtgcagtggtgcgatcatagctcactacagcctccaactcctgggctcaagtgatcctcctg

SEQ ID NO: 177349 - DNA, 517 bp, Homo sapiens
ctactcctcccattcctatctcccaccctcatctcagtgacacgtctacccatccagttgcttcagccagaaacctgggagtcattcttgacactttcctcagattcctcaacccccacactcaatctataattaaatgaattctttctttaacatacttctcaaatccatccacttctctccatctcttctgccactaagtcccacctgcagagattcttacttaagtggtatgggtgcagcccaggcaccaggagtagaaaaagttccccaggtgattctaacaaacagctaagagtgagaaccactgctctacaacatttggacttccaccaacctctctgacctcatttctactactttctctcttgttcacttaactccagtcatgctggcctccttgctggttccttgagtatggcaggcacatacatacctcatggtttttgctatttcttttgtctagagtgctagttctctcctgcatcttctacagatatttactcaagcattacct

SEQ ID NO: 177350 - DNA, 340 bp, Homo sapiens
ctactcctcccattcctatctcccaccctcatctcagtgacacgtctacccatccagttgcttcagccagaaacctgggagtcattcttgacactttcctcagattcctcaacccccacactcaatctataattaaatgaattctttctttaacatacttctcaaatccatccacttctctccatctcttctgccactaagtcccacctgcagagattcttacttaagtggtatgggtgcagcccaggcaccaggagtagaaaaagttccccaggtgattctaacaaacagctaagagtgagaaccactgctctgtgtagcggataccatgttactcaag

SEQ ID NO: 177351 - DNA, 321 bp, Homo sapiens
agggcccagggctggctcaatcagtgctgtgtccccagcatagcccagccctgggctgagttcagagtaagaacccaaacagctgtaaagcagtgaacccagccaggctcagggaccgggctgcctcctgccctgagccccccgactgagctccagaacgtgctgcagtcaatggctcctggtggcctcaccaggtccaaagaggaccaacagcaaaagggcctgagagcagacttggggaaatctcccagacatgaagcgggggccttcgagggccctccttgagaagtgagttaagagcagatcccatccctccacccc

SEQ ID NO: 177352 - DNA, 750 bp, Homo sapiens
gttattttatctttatggctgtcaaaaacgttaattcagtgctgagggaaccaatactgctttaatttttttcttcctggtggaaaagaaaagctgatttgctttcagtgatctaattcagtaagagttctttaatacagcaaagacatctggcatgaatgtaagcagaacatttggaggacttctttttcatagccaatcacttggtattagaaatggaccattatactggataagaaggttttagaatggttgaaactatcatttagttttacaaattaaatgtagtattttttgtaaacattaaacttattaaactaaaaagtaatatattagacacgatgttcctctaaagtttgtttcctatgagtgtagttttgcagatggctttccttgtctctgaaactttccttatgcattaagaaagtttgctaacatattcacattcatatgtttaaaaggtatattatgataaaaaaaatcaatgtggaattgtgaaaacccttagtacaaataaaagcactcaaaagagcttgattgcagaattaataacgtgatagttctaggaaaagagctgcaatggtaaattaaattcactgtcaatagatgaaaatgaaatagcttttttgcattatacatgaggtggtatcagatgtgcagggatgttacagaaaattggtgtttatcaaggatattccaaatagtaaattaaatgccttttcatttgaatatagtttattttcagtgggt

SEQ ID NO: 177353 - DNA, 545 bp, Homo sapiens
ggtcggtacctgacttacttaacccaggtgtgtgcttacttaaccagtgtggaaacagacaatgagcacacacgaattatcgcgtgtgtgataataagtgtaccttcgtgtataagtatgtaaggtgatggtaagtggagataaagaaaaaattaagcaaggttgagccaggtgtggtggcaggcacctgtaatcccagctacttgggaggctgagacaggagaattgcttgaacctgggaggcggaggttacattgagctgagatcacaccattgcactccagcctgggtgacaagagtgaaactgtctcaaaaaacaaaacaaaaactgctgaatgaatggaatctcccagagagcttaagagtatgatggacaggccaaaatagacaggaaattgaataggaataacagcatttgacaaattagcagttttcctttttccgccttccaaaaaaccctttcctcactcttaaataatgtaacttcagtatgagtattcctgtagcactggattcagtgtgtgcacaattaaacttcagcagcc

SEQ ID NO: 177354 - DNA, 196 bp, Homo sapiens
tgcaacccttatgtcacctgcacaatacacatattaatacgagctaaaccagggtccaccattctttcagcttttcccttatttcattcattactttctccttctaatcctcctaagtgaccaagctaaaagatttcataattttattaatatataaagcagacaagtacaatattctttaaaaagttttaactta

SEQ ID NO: 177355 - DNA, 482 bp, Homo sapiens
gaagatctgaaatagattttcaggtttactttggaaagccttttgccaagggctggtgggggagggtggtccatcagtcagttgcggggcttagaattttatttttggtttataccagggataagggaatgggcagttctgacctttcatccttacgttgtgtgtccaaagaggaaataaagccccttttttcagcgtgatttgcagaaatccaggtaggtcctccagttggtgcagcgtgggtcctgcacacatccagaccatcgccatctccagggggcagctatagcagctgacccaagtcacagtgatgtggccagtctcagggccatgacaggttaaggaggctgagccccccagcttcagtgagtgagtgtatcccacaaaaggggatgccattgtaggctgaacaaaacaaatgccccgcacagcaccccatccctcccactgtaattctgaaggacatgaccaccctcctctga

SEQ ID NO: 177356 - DNA, 888 bp, Homo sapiens
aggagctctctcccaccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgcgtcactggggtggcaatgtcctgggtcctaagtctgtggctcgtatcgccaagctcgaaaaggcaaaggctaaagaacttgccactaaactgggttaaatgtacactgttgagttttctgtacattaaatattgacatattcaaattttccttcaaaaaaaa

SEQ ID NO: 177357 - DNA, 992 bp, Homo sapiens
  misc_feature (902)..(902): n is a, c, g, or t
  misc_feature (992)..(992): n is a, c, g, or t
aggagctctctcccaccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgcgtcactggggtggcaatgtcctgggtcctaagtctgtggctcgtatcgccaagctcgaaaaggcaaaggctaaagaacttgccactaaactgggttaaatgtacactgttgagttttctgtacattaaatattgacatattcaaattttccttcaaaaaaaacaacaacaccgggncatttcggtgcccaaacatgctgcatggcacggcactgttcttgacccccctttgtcaacgggaaaaccggccataagggtaatcactgn

SEQ ID NO: 177358 - DNA, 413 bp, Homo sapiens
acgttgacacttcaggtgtgttcagaacagaaagagagagagagagaagaagacagagagagagagacagagacagagagatagagagacagagatagagaaaggaaaaaaaggaaaaaggaaggaaagaaaggtgaaaatgcattaatcattaattctccagactattttctctaccttccagtatgttggagatcaaaagaaaagtgctttgaagaacagttacggtttacatctaaacctcagacatatcatacaaagaagtaaaacaaacaaacaaacaacatcaaaaaaagccccacaattataaaataatatgtcagcctaccaaatcagttcatgcgaaaatgcggtaaccaaataggctgcaaaggctcaccagtcttccaactgcctgggccaattgttatctt

SEQ ID NO: 177359 - DNA, 312 bp, Homo sapiens
gtatttttcaaataagagggaatttttaaaaatatttgaactcattaacaaacattaatcaagcaaatagtgttgatgaagcactatattaggcgttgggtaattttctactcctcatggcaggttgtttttaaaagattacattcagaggagtggaagctaggaagcttttgacacctaagtagtggcattgagggagggaagaagtgaatgtacttaaaatactctttggagacaactgacagatgtgggtcattggctagaggtaagagagagggacgaatcgaatgattctctcagttcataatggta

SEQ ID NO: 177360 - DNA, 413 bp, Homo sapiens
tgattgcacaacagtgtgaacgtaattaataccaggtactgatttgtacgtttcaagatagctaaaggggaaaattatatgttatatgtttcagcacaatctaaaaaaaaataaaggacttgaatcactggaaacaactcaaatgtccttcaacaagtgaacgaataaacaaatggtggtacatccatatgttgaaataaaatggaaccaactattgatatacacaacaacttggattgatcccaaaggcattttggtgagtcacagacgcccatctcaaaaaaaaaaaaaaaaaagggaagtgtggaacttcctggtgggtagggcccttcttaaccctgttatcccgggagaatggtgccccggaaggaatatgtgtcacttgactctaagtccccagggcccaaattaca

SEQ ID NO: 177361 - DNA, 435 bp, Homo sapiens
aagcgttaccccgggggtggggggggcagaggcaacggggaagcaggaaggggctgaggctggttttggactctgcaccgtagcctctggcctacaagacagagcatcctctagattctggtctggcccctccagatccgcagccctgaccttaccccactggcgggatctagtcccctgggggtctctctgattataggagcccttcccccatctatcccagttcccaggggcccctggggctcacctgtctccaggtgctgagaaaaaggagacccctgcctccccccacattgaagagaagccccagggacaaagaggagtttgcaccagcgacgtctcagaagacaggggatccagcctcagcctccgtgggctggagggtgacaggggctcttagtggtcacccccaggctccagtgcctccagcggccg

SEQ ID NO: 177362 - DNA, 432 bp, Homo sapiens
tctaccaaagtgcctgccaaagtcatcaatagtctctatactgcaaattccaaaggtcaatcctcagtcctcattttctgagacccactccagcagcgtgtgacacaggtgcttattcctgcctttctgaggccgtttcttcatttggttttcaggacaggactctgctttgctttcctcctctgatcacactggtggtttctttgctcattcttcttcccaatctccccgacctctaacacgctggggtgtccccacctcagtctctggttcttttccatctctactcgttccctctagttacttattcaagtctcatggctttaattactacctgtatgctgatgatgtaataatttccaaacttctatctcctgcccagatctccccactggactctagttgatctatccaccaattgcctacttgaca

SEQ ID NO: 177363 - DNA, 966 bp, Homo sapiens
ccggcccacacaagcctctgggggcagggctggccctagagaaggggcagggggtggcgaggtggcgggcgtgggtggaacagagcggccaggagtcagagcggccacccccacctcatcttcccctcctggctggaggctggcgaacccaggccacccctcccggagacaagcgtgtttggcagtgccaggcctcttgcccctttgcttggactccaagtctcctctctgggcagccaggacccacccatggggacagccctatttagcttctgctctgggaacagcaaaaatcaggatggtgggaggggccgagtcttgtcttgtcctttcatcatcatgactgttgagttcttggctgtgcccatcacgccacagcacgacgcctgccaaaatgcccccaacctactgcctgatgcaggtgccattgccattagcggtcatcgacagcttagggcagcactttccaacgggtgcccatgggacaccagcctgcgagatgcttttgtgggaaaggggttttgtggttcaataactttcggaagtgctgcacactctgtccccaagttggacattcacaaaggccgttattgccgtaaaggctctgacaagccctatagaaaagcttcttgctaaaccttctttaacccatgttttctaaacttatttgaccacagaacccttttcttggggaacagctattaacccccaaggaattattggttcctcaagtgcgttttgggagctgctgccagagagctaaagggcctggggtgtgagctgactctccgctggggaggccgggtgcacacgccacagcccgaggaaagtgctggccaccgcccgtgggcatcgatgaggctttggcccccaggggccggactccgtgtgacctaataggtcgtttccaagtcacccgttttggatgtgcatttcatgtgacaatacagatgacatgcaaatggc

SEQ ID NO: 177364 - DNA, 206 bp, Homo sapiens
tttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggcca

SEQ ID NO: 177365 - DNA, 571 bp, Homo sapiens
tcatcttgagcatcattcactgcagaaataagagtaagttagtttctttgagagaaggcctaacgttgtactcctgggaactatttagcaatcatcagattgttgttattatcctactgagtgtaaaattctgggagccaactggctgactaccactcactctcacccttcactagaatagatgatgggtccattctgggccaatgcccagaggccttgagttgaggctggggcactgcctttgcccagaagagctcccaggggactgggggccagtgcccttccagaggcctcccagagagtaacttggaggttccatttgctattgactggattgtgtttgcttgaggagcctgtgaccacccgcagggacaggcagcctaggataaactggaccacccctgagtaaagcactccactcagtcccttggtccccacccctcagttagaactgctaggctttgggggatgggagggtggcaattattcttaacctcccgaaattcctgatgacccgataacaaggaggtatttagacatagaatgaggagctaatctttttcctataatg

SEQ ID NO: 177366 - DNA, 295 bp, Homo sapiens
  misc_feature (282)..(282): n is a, c, g, or t
gtcgtctagaggatcccattcggaatcaccactatcccattggattcctcaagttctgctgagaattctagtctctttttttccccactctagaataaggatcttaattatttatttgtgttgtccattgggaaaaatgattggggatgtgcttactgtcaacaaggggatagtggtgggttccgaatgtaaactggccgtaatcccaaagttctgggattacaggcgtgagtcaccgtgcctggccagtggtgtagttttaatgccagagtttctagagtnggtgacctagaca

SEQ ID NO: 177367 - DNA, 281 bp, Homo sapiens
tacaattttatacacatcagattagcaaaaatcagaaaatatcaagtgctactgaaaatgaagagaaaatgaaaccctcaggtcttgcttgtggaaaggaaaactgtgacaaccattcctgagaacgatccagcatgacttaaattaaatatgcatatacctcaaactccagcctttctactctaggacatatatagcaaagaaatgaaagggcaggtttcctgaaagggcattcttccttcataggaagacatgtataagcttgcagaagtggaaatagc

SEQ ID NO: 177368 - DNA, 515 bp, Homo sapiens
agcaattcagcccctttaacctgagcctgggaagatacggaattagactatagtgtgatagctttaaagaacaaagtgaggggcagtgtggggagggagagcatcaagaagaatagttaatagatactgggcttaatacctcggtgatgggatgacctgggcagcaaaccaccatggcacatgtttacctacgtaacaaacctgcacatcctgcacatgtacccctgaacttaaaagttgaagaaaagaaaaagagcaaagtggaaattgcaagattttagtattcagtgatggttctattgattcattatccctgcctttctctctgacattagttagttcagcacaccttcatatctatcctagatgttgaagctatgtctactcgctggtatctctagctgcagccttgtgccccctcgattttatatttcttattgtagcctttatccttctggattactaatcttggatcacagtagcttaaaatcttaccatgaatcctcattgcctcc

SEQ ID NO: 177369 - DNA, 373 bp, Homo sapiens
ttctcatcctaactcgctctgtgaagaatatttgccacccttcttcttctccaaagggttttggatttccttgttatgctgagtgttacacttgcaaagactgacagtcctggaaggaaactgtagacgtcgagtgctggagcactaaattaggagtccaaagacctgggctcgggccccagacttaccacttgtgagtatggatttgccctcagtttacatatttataaaatagaggcacctcccagactacctcccagagcggctggaggctcaaatgagataacatacatgacagttgtttggaaactgtaccaacacataaatatgaatgacttggtgaactggctaattaattaggtcaaggtagacc

SEQ ID NO: 177370 - DNA, 389 bp, Homo sapiens
tgggcaacaaagcgagaccctgtttcaaaaacaatacgagctgcagccaaggggacaggaggcatggccacgattgatcagagacctttatcctctcagggtttcaaagcttgcagaggtggaattaggactccaaagtcttgggtctcctttccctttgaagactccccttcctacccccactcacgagagaaagggaatcattctccttttcctgagtaaaaaaatgaggtctcagacagtggagagcactcagtgtgagagcccaagatttaggcagatgacctggcctctgaactgagcccctaagaccaccaaacagcttagcattgacattctgctgttatacaagaaggagctagagagaattcagagagtttacctgccac

SEQ ID NO: 177371 - DNA, 265 bp, Homo sapiens
tgtagatggggcacttttctctagaaaggcctgtgaataagatgaacaatacatttgacatgataaagcataatttttctattatgtgttgtttagattgtttgcttttttattgctttacataatggtgcaataaacatcttaatactaattgtgatctttgtttgcatgtctggatgttttcttagggtcgagtcctaaaaagagatttactgaatcaaagtactctatttaattctctttatagtctcttaattcataatat

SEQ ID NO: 177372 - DNA, 532 bp, Homo sapiens
cacatacgatcgtgtgtgttgcaccaattctttcgatggtggtatgaccttcttggctgccctgtctcacgctctttagatcgcccgtgcggcgcaatgtgccggcgttttacataaggttttgtaggtggtatagctcagctataccacctgaccaccactgccatctagtttaagtgtccttttctttttctttcaaatctctggcaggttgtgatatttatgggtctatctcttgtgactttaggttcgtcttggcaccagacataaggcagttccacaacaagctcttgccctaaacagctcctgatgccaagaactgccgaattactactttgatttcagtagatgtcaaaaaggatcatcagggtaaactttgtagatttctttcaataaccacactctcctttcaacattgaaattctagaccgtagacagaagtattgaaatgggttatagggaggagatgtgagaggcctcctgccattgataagtggacatgtctgaattggcctgctacctaaattaataa

SEQ ID NO: 177373 - DNA, 167 bp, Homo sapiens
tgaactgcaggcatgttgtagtggtttatttcttctcgtgtagctttgtggggtatgaatatgatgccctttatttaacccgttttctcttaaggctcctagaggttagggtgtccagcgtggggctcctgggcatcaagctgctgtgaacgtccacatacgtacac

SEQ ID NO: 177374 - DNA, 101 bp, Homo sapiens
ctagagatgacctgcagagaaacgactgacatctaacttcttatcactctcaataccagcaatggaaaaagaagatgaaagtgctgtcaaagtgctaaggg

SEQ ID NO: 177375 - DNA, 593 bp, Homo sapiens
attctaatacagtgtcttcgccacggtagattttagtgtcatttgatggaggaggactgagcaaggaggggtaatatagacctaagatgagctgcttattgtgaaattcccttcaggccgacccagaaaccacaggcctccccacacacaggaatgggagcggttgccaaggatgggcataataccaacagcccttttgtcttctatctaagcctgcagaagggggtatttctgaacagcacccttctgtgggcatgctacatcctgtctccgaggctgcttctgctggctagattagtctctaggtggctctcctgctggaagaaacggaaacctaaacctgcctctccccacccattagttaggtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttcggcaacaactggtactgctccagctcctg

SEQ ID NO: 177376 - DNA, 725 bp, Homo sapiens
attctaatacagtgtcttcgccacggtagattttagtgtcatttgatggaggaggactgagcaaggaggggtaatatagacctaagatgagctgcttattgtgaaattcccttcaggccgacccagaaaccacaggcctccccacacacaggaatgggagcggttgccaaggatgggcataataccaacagcccttttgtcttctatctaagcctgcagaagggggtatttctgaacagcacccttctgtgggcatgctacatcctgtctccgaggctgcttctgctggctagattagtctctaggtggctctcctgctggaagaaacggaaacctaaacctgcctctccccacccattagttaggtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctccatgagtgagagggccaagtgttatctgcaagttgaatcttctatattcaaaaatctacccgtgtttctgccagcgca

SEQ ID NO: 177377 - DNA, 214 bp, Homo sapiens
cgtataaaattacctactaccaccatctttcttgtttctcctgctcttcacatcaatattttaatagaacagcaaaatatggtcacattcagaatcaattaacacaaaaaaaaatcaaacaagttacaaggaacaaggcaaacagggtatgtttcaatgaaaaaagaactcaaaggtcccagaaatggaaaaaaaaagaaaaaaggaaagaata

SEQ ID NO: 177378 - DNA, 301 bp, Homo sapiens
gaactcctgaatatggaatctgcccgcctaggcctcccaaagtgctgggattacaggcgtgagccaccacgcccggcatgcctggggacatttttagaaaactataagatgtcaacatttaaccagtgctaaaaaattaaattatttacaagtaaacttacgatgaaaaactttaaacttcaactttaacatgtgaaggggatacaaggtgttcttacaattcattcacagaatacctgagtaagagagtttaaagactctttgctcaaatctaactttctctataaggactatcttacga

SEQ ID NO: 177379 - DNA, 397 bp, Homo sapiens
gcaggtggatgtgatgttaaagggggagcacaagcgacatcttcgtggtgatggaatagtcctggatgctgattgcagtggtggttactcaaatctacatacatgatgaaatggcagagaactatacgcaggcatggtaccaatgtacacgaaagatctggaataaaagcccctgacatcgggaagctggcttggcattcacggctataccacgttattctccttttagacataatcgcaaaagacacaacctcagacaaggttactctgaggccatgatgaagtgagacaaaacaaggtcactacctaatttttgttgaagtaacccataaagacaaggtcactgtgccacccacaaaataccaatcatcaccctctcttggctgaaagcagtgac

SEQ ID NO: 177380 - DNA, 542 bp, Homo sapiens
cctgcaatgggcacgagggccagacacctctaagagtgggtgtaggcctccaaaagtgtccacatgatacttccagaaaaacttcacatgcggaggtgtgcaggaatgtgcgtgctgctagaaaagaggcctaaggggtctgcccaacgtcctgagaacccgagagagcagggcccgctgggacaggcaggggaaggcctcgggagggacacgacggtccggcagcagagcctgcggggctggaggaggcgccctcctctcagctgctcttcctgcccctttcggtggcgaagatggatggggcccggggctttcggcggggcccgaggggccggcgaggctgcggccctggagccccctgcctggcagccatttgggccccagggaaatatcggcgctttggctaaccgaattattctttcggtttgagccagctcccctttttgagtcagatccggcggcagggccagaaaagcgctttctgaaaccccagcgcggtcctcggtgggggtggaatggggtggggtggggggcgcggccgc

SEQ ID NO: 177381 - DNA, 519 bp, Homo sapiens
catttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactacaggtttcactgccaattttttctagcctgtatgtttcataaataaataaatgaaacagcaaaaaaaaaaa

SEQ ID NO: 177382 - DNA, 788 bp, Homo sapiens
ctgaggatcccgtgcttacttaccagtgtgcagaacagtgtctgtgttatgaataggattcttcacctcgttcacaggaagagtaatgcacatttcgaggagttcctcttctcagtccttgatacttgctatggcctggctccctgtggctggaagggccatctctcctctaggatggaatgttctccaactgctcctgctcagcccattgcagtcctgtctccctggcctatcgtctccaacttcaaatcctcatgggctcagttgtgcccctcctcagtatttacaacttcttccaggtggacacactcaagacagcggcttcaagcatcacctatgtgctagggtccccacatgtgtactgctagccctgccacacactgtcccctcagaggccaagttaccctgagcagttgaatttggtgcctcgattgtcctcattccccacacgtcatccatccacaccccaaatatgtcttgagtgcttcctattcccgtcctgcttcctggtcttgaccctggaccacagcaataggagcatttacagatgagtttgtgtctgcttcacgctgggttcttccttctccatgctctgctcctggcaagcccacatgtgcaatgtgagggtttgccctcaggcaagcctttcctgtggcccttagtcatggaaaagaaatgcaactttgtaaatggattttaaaagccactgcttgccacacttgcctgccctggaaaccttcatgcagcaatcaattcctaactcatacacatgggggaaaagggggaag

SEQ ID NO: 177383 - DNA, 760 bp, Homo sapiens
ggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcggacaaatcagctgcagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgaatgctttttaagagcaaagcatatgagcggaatgagttgttcctgccgggccgcatggctagtgtggtagacctggatga

SEQ ID NO: 177384 - DNA, 180 bp, Homo sapiens
tatttcctttggactgtcttcccccacccccattattttttttaaacagtaaaataggtactacttatttagcaaaaataaataaaagtttaaaaaataatttagctcaacagtgacaagaatattgtctaagcctctccttatctatagtgattttcaaccagaggcaactttgccccc

SEQ ID NO: 177385 - DNA, 349 bp, Homo sapiens
ttccattgtattcaataattctgtacaccaataacaatagcagactgattgggcgtggatgtggataacattataaaaatcagttattaaagggatactttagcctgactgaaaaactgatctaattgtattagtccagtgcatgattatgtgagatgttttgagacagagtagtagatttgtgaatgaaaatttatggaatttttcacttactaggaacctttgtgtgtggaaaactgagaaaattgctttctgctgtagagtctggcattcatggtatattaaagcttatttttctgtgagtaaatcttattcaataaaataccactctttatactaaaaaacaaaa

SEQ ID NO: 177386 - DNA, 249 bp, Homo sapiens
gctaaaaaggccaggtggactgtgacctttaaatctccatgtaacacaaaaacacccagggaaaactagttttagaggactcctggcctctggtgggtacacaatcccaaatactgattggtttcaaatggctcttcagaaatactaaatattaaaaatttgtaagacaacatcacaagtttcatttttataatctgatagattaaaaatccagattgcttattttacacaacacccattttctttttt

SEQ ID NO: 177387 - DNA, 562 bp, Homo sapiens
agtaataaatcagacagtggccgggcacggtggctcacgcctgtaatcccagcactttgggaggctgaggtgggtagatcgcctgaggtcaggagttcgagaccagcctggcgaacatgatgaaaccccatctctactaaaaatacaaaaatcagctgggcgtggtggtgggcgcctgtaatcccagctcttgggaggctgaggcaggagaattgcttgaacccgggaggtggaggttgcagtgagtggagatcacaccattgcactccagcctgggcgacaaggcgaaactccgtcttgaaaaaataataaaaactaaatcagacataggatctgcagctaaataataggtcccaccagcttccaatgtactgtcgtaatgcataattttaagaagttattaagtcttctttcaaccttagtaaagagaaggccttttgacactgtttgatgtgaatattgcagccgtgccatcccttaaaaggactgttgaaaactgataggctttccacatacagttttactgggtggaatggacagataggaacaaatcaagaggcag

SEQ ID NO: 177388 - DNA, 183 bp, Homo sapiens
agttatgatcctaccaattttctgtcttacttatatttatttgaaaagagaatctttgtgtaacatcttgcaaatcccctactgccatgagaattaattactgggggcttcaggatctttcaagcatgtgactgctctaaaatatttcttgtattttttaactctcagttagaggtctcataa

SEQ ID NO: 177389 - DNA, 290 bp, Homo sapiens
ccataaatatgtcaatataagaattctgaactaagctgggtgtagtgacttacgcctgcaatcccagctactcaggaggctgaggcaggaggactgcttgagggcaggagttcgagatcagcctaagcaacatagtgagagacccccccatctcttaaaaaaaaattcagaattatgtaagtatcttaccttagtctttacccaattttattttcctgttcattcaaaatcagaaaaattaagaccagctttactatttaaattctcaaaagacttcccatgtgagaaaa

SEQ ID NO: 177390 - DNA, 457 bp, Homo sapiens
ctaggcctctggttctcaaatattagcatgtgccagaatcacccaaagcactcattaagatgcagattgctgggccccatccgcagagcttctgattccgtgggtgtggggtgaggcctgagtgcttgcctttttaacagtttcccagatcatgatgatgccgctcatctgggagccacactttaagaactgctgttctaggtcaatggaggaccccactacatacaggtggatagccagtctctgattgaatgccacctgtaatgggaagctcaccaattgtaggccccatccatgctttactgcagatgttttgcccatgctaatctttgttgcaaattttcctctaaaaagctaacatgtgtctccctgcagttctaggagggcaatataactggggtctgagtgtgggtttgaaattcctctgtctgagtttcaactcttgatcccttccctc

SEQ ID NO: 177391 - DNA, 277 bp, Homo sapiens
gtgttgaaactatcacattctagaatgttccatggactcttttggcatccaagagcagggactttactattccaaactcagccataattttgtagtacttggtgaatcattactcactggcaagagttcactgttgtttgtcttctaatcacaatcctgtttaaaccatgtcctagtgctgggattggcccctcccctgccctcaccccactttcccaaatgccacaccaaagtcttggcaggggatgtgcctgtctgggagcgcccagtgggttgt

SEQ ID NO: 177392 - DNA, 385 bp, Homo sapiens
atttgatgcttaagaatgagttatcaggtttgggggtgagaaggggtattaggtctccaacctccactgggctactcctgtcatatttttcctagcaagacaggcaacactcctcaaaggttactaagctgcgcctccaccaagaaggaaaatgggactcctttcaccttgagctctctttgtaccttcagcaaatgacttctgaagtcatcttgatctcctcttctataatgcaatcaggggcattccctgcttctctgtcatctctctaattactgaaagaaattttcccccttcttgtgtttttttctataattagcctcatagattggtcaaattcgtctgtccagatttccccccaaaattcccttctccacactgactg

SEQ ID NO: 177393 - DNA, 487 bp, Homo sapiens
gtgaacttcctgggtccagctgaccaatcagccaaagcaatcctgcttctagcatgcagcttgcattcatctgttcatccatcactactgccacatctgaagtcctggtcactattatctctaggctggctatgtgataacatcctaagtggtcttcctgcttccattctcgtccctccttagttcattctccagcttctggcagagtagatccttccaaatgcaggcctggccactcctctgctggaaaccattcagtggtttctcattgcttttaggataaaggtcccgtgtggtctagtctctgactacctccccaggccatcttacacctccctggcaccatgctccagacagattaatttttcttttctttgaactgaacacattacacatttgccctatttttgaacttcccacaagctgtccccttggcctagaataatcttcaccccactcttttcatcttccagatctcagggtatat

SEQ ID NO: 177394 - DNA, 475 bp, Homo sapiens
caggaagggtgggcaccgggaaggccgggcacatgagagatggtttgagttgggagcagcggccaaagaggcagaaggatcaggatgactctccagtgtgttgtgggcaagatgtgaagggggtcttcaagctgctctctgtcctggtctgaggagctggcttttggatgatggagcgtccttgttgccacccccacctcggtgttggtggtggtggagtcagggaccctctctgcactgtggggatggacatggagtgaaggcatgagggagatctagctctcttgggctcctggctcacttgggttattttgcctgttctgtggagggagcatcttcaaattcatcaccttcatcagcaggagagactattatcttcatgttgcagataagagagctaaggctggaatatttgattggtgtcatttcaaggacctgctgtagaagaactgtctggatggaggctagatgcaat

SEQ ID NO: 177395 - DNA, 577 bp, Homo sapiens
gggtcaccgggatcaaggatggtgattccatgacagtccctctaccaaacacagctgcactgtcatttaccctcacagcaagccacatctacctataaaagcaggtgtgatgatcacctttcacagatgaggaaatggaaactcagaaacatcaagcaacttgtccaaggacacattatcttaaaaacactgagtcaggaccacgatttgggcctggatctataggaccaggaagttctcactctaccatgccagagaggagagggatgcctccaacaccaggtggtcgagtaaaattaattagctaataattgttattggatatgctagactttgtactttttcttttgtactgttgctcattgttgaacatgtttggtttttcttttaggttttctctaatataaagaaaacagtggttatttataatcattactggagggtttgacaatcaggaaaacattaggttcagcttctccgaaatcgatttgagattcacagcaagtcctcattacactgcaccactagcataaattattgtatattttaatgctccatatcccacaacatccaagag

SEQ ID NO: 177396 - DNA, 184 bp, Homo sapiens
ttgttccttagagagttgtgtgtcaagtctcctgtgagatccttttctattcaaagttagtttcatttctggagtaacgtgtttctacattgttcagtgcacagtagtgagaattcatacatttgattccagaattaacatgtgtttgaagtgtaggtgtagtgggacataaggaacccagcag

SEQ ID NO: 177397 - DNA, 257 bp, Homo sapiens
attgcgctgcagtgcactccagccggggcaacagtgtgagaccaggtctcaaaaaaaacaaaaaaacaaaaaaacccatatatggaggaagtttattttacgggggacaaaaaatgttctaaaattcaattgtagggatagttgtgcaaccccatgaatatactaaaaaatgctggattataaatttgaagtacaattgtatcatatgtaaattataactcaacaaagctgtttaaaaagaaaaccaagttttaaaa

SEQ ID NO: 177398 - DNA, 252 bp, Homo sapiens
tgcttactgttcaacatatctttgtttggctgtgttcttaggaggtagggtacaagccttcactgaacatttgttgacttagagtcttggacacaatattagcactcagcctcaaaattagcatttttatctcgcactattctttatttcttggttcttctatgcacattactcatatggatttctcttttgcaagaaatacttcttttcatctaatctaagtagctcttgaactgtttctctttcttcagt

SEQ ID NO: 177399 - DNA, 543 bp, Homo sapiens
accacagttgcaatttttgcctaacaagtatgacagcaagagagggacaagggagatgagtacctatgcggttcaatgatgataagttattacaatgagtgaccataggagttaggctaggtaaagagggaagtgaggcctttatggagaaaggcagtgacatgtaagggataagtggtttggagggcacagtgggttcaaggattgttgggtttgagatactagagaaaatgaggtagaaaaacaattttaaaaaattaagatggcagggcgtggtagctcacgcctgtaatcccagcacattgggaggctgaggtgggcagatcacctgaggtcgggagcttgagatcagcctggccaacatggtgaaaccttgtttctactaaaaatacaaaaattagccggtgtggtctcatgtgcctgtaatcccagctactggggaggctgaagcacaagaatcatttgaacccgggatgtggaggttgcagtgagccgagattgcaccactgcactccagcctgggtgacagagtaagactctgtc

SEQ ID NO: 177400 - DNA, 146 bp, Homo sapiens
agaggatctttgaaaggataaaagaaaaaaaaaaagaaattggttgcctctgaagggaagaagatggctgagggtcacagatgagagtattttcaccaaactctttggttataccttttgaattctgtattatgtacatgtattac

SEQ ID NO: 177401 - DNA, 448 bp, Homo sapiens
tactatcaattattattatttaacacttggttaatatagtagtcccctcttattccaaaacccccaattccaagacccctagctgacacctgaaactgcagataggaccaaacctatactgtgcatgaatttctttttctttctttacaatttcagagatagaaggttcgttcttacagcagatcttagcaaactcggtgtaagattttttttcctcccttattaagtctagaactttcaccctttccctaaaggaagcactttacaacctccctttggcatatccaaattactggaatcactactcttgaggtgtagggtcatcatgaagtaaaataagggttccttgcgtacaagaactgcagtactttgacaccctgataacccagccggctcctaaagggactaatgagccggcagcatcaacagcatgagacgctggacaaag

SEQ ID NO: 177402 - DNA, 545 bp, Homo sapiens
ctactaaaacccgttaccttcttccctgtggtaataggattttgctggatacctggttagactacatttcccaggctcccttgccatttttggggggccctggggggactatgtaacagagttttctccaagggaatgtaaataaaaatgaagtagcctccaagctactttttaaaaatcaaatgagtctcttgaacattctctttttccttctactgtctggatttgaattagaagggcctggtagtataacagagccaggaggtggtaggcaccagggtcgttgaatcaatatggatgaggttaccagtagaccagaaacaccagccttgtattataaatgatcaaaagataaccttctattatggtaaaccactggtatttggagaaaggagtctgtaatggcagcttctcttactttataacatacttttcaaacatctaacaaaatatatctaccacctttcacaattttgcacctggaagggttagggaaaagtgtatcctggggcctcagggaaaaaaaaagaaaaaaggaaagaaaa

SEQ ID NO: 177403 - DNA, 346 bp, Homo sapiens
tttgcagcaaaattaggagaagtgaagcaagtttttctgaaaggccagagctgccagttaggaaaatctctattggagaaacagggtcactgaaagatcaagagggaaaatcatttaatatagtatggttactggctactctagaggatcaaaggtataactttgtttttaatttggtttaccagtcacagcacacatcagtactttcatgtgcacccaccaacaccaccaagtttatggtcctggctagacccaggtatgaagaagattattacaaatgcatgggctgtgacgataacgttgtagatgtggtcgttacctagaaggttgcctggctagacccagg

SEQ ID NO: 177404 - DNA, 242 bp, Homo sapiens
tcgtggtggaagaagcagtgatcacatctcctggctcagagtggcccccacttccccaccatctccacctgcccaaatcagaccaatctgacaagtgtctgtccagcttctcccttgaggatgaagtccttagcaccttccagccttggcacctctatcacagggctgacgtcattctattttgtataataatgatcactcctcacatcgacaactcttcacggttaaccaaaccctcagat

SEQ ID NO: 177405 - DNA, 420 bp, Homo sapiens
ccactaatgcactgtgacttcaggagctccctcccctcagtggctttggggaaggggtgggacttagagttgaagtcattctgtggacctattacagtgttcttcatttgctctgactacatttgcgtatcttcctgccagaatgggaggcttctgagtccagaactcaatcttgtattcatgtgcccggtgcgtgttgggtggatatggttaaatgagcccagttttgttgttcttgtgggtcttttctatgtaacacagtccatatattcttgcctacactttaagtgaaagaggaacttgtaaagacctcctatctttaagaatattagggccaggcatggtagctcacacctgtaattccagtgctttgagaggcccaggtggaaggatcacatgagttcaggtatcagtctgggc

SEQ ID NO: 177406 - DNA, 202 bp, Homo sapiens
actgtagacttgtaaagactgcaggagagggatcacagccagcaaatggtagcgtgactcctatgtgctttactatagaagaggctgcagggcctccacccacaagttccttaccagctagtgtgctgggtggatgggcaggggttgtagagagtattataatactgtgccaaaagaatttcaagctgtggtgctaaaaatg

SEQ ID NO: 177407 - DNA, 273 bp, Homo sapiens
ctcctcacatagtggatggaaggaacaaataagctctctggggcctctttaataagggcactaatgccattcataagggctccaccctcatgacctaatcacctccccacctcccaacactaccactctggggattaagttccaacatatgaattttagggggacacagacattctgaccatagcaccaagtaatttgctcaagtgatgggaagaaaacaggaaggactgatgtgtctacagacaagcctcctcctcaaccctggggtatcct

SEQ ID NO: 177408 - DNA, 529 bp, Homo sapiens
tctttgattatgtgtggtagatatttctatttttgaattcttcctagcatattataatttatttgttgacaaatctatttctgttatagtgggagcttctagaggacagggaccatttaattatcctctcagtatcctagcaactgacacagtaaaggtttttgcacttgaaattacaagtaatctacttgtagttagccctcagttcacctgatactctataccatttgttcctagaaaactatacaatacatgataggaacttggtaaatatttaatggtaataatggaaaagaagaaaaaattgcatttcatatgctgtgtttaagaagaaaggtctacaccaggcatggtggcttacatatgtaatcctagtgctttggaaggctgaggcagggggatcacttcagcccaggagtttgaggctgcagtgagctatgattgtatcatactctaacctagacaacagagtgagaccctgtctctaaaaaaaagaaaagaaaggtgcatgaataaaccatttaagaaa

SEQ ID NO: 177409 - DNA, 647 bp, Homo sapiens
attcaccttaaatgccctccttgagcaccttttccaaagtaacagccccatcactgcctatcatagaacattattttactttctcattcctatgactgtcctaggttggtactgtcctcagcagaatagctgctcctccatgaggtcactcaggaccccaggccaatagctgctctgctatcatcatgtgacttctaaagtcaccctaggagaccgcatcctaatcatccaaaagggtaaagggcctggagaaacacatgggacaagttttcatgggctaggcctggaagcagcacacatcacttctactcacattctaattatgggggtagtgggcagagaacaaacaaaaataaacactaaggaggttttcaagtagctctgtgtgcaaaaaaggggtctgatttttggtagagagctagtaatctctgactcaggaaaaataggtctaggtacttgaaacatactttggaaacattgctggcaatatttgggtaacttagaagcgaaaggaaatgttcaaataggatctcagtttggttaggaaaatgccagctgccgaagccccaaatcccccacgtcttagcacaattaaattagacacacgcctgtagtcccagctactcaagaggctgaggcaggagaat

SEQ ID NO: 177410 - DNA, 174 bp, Homo sapiens
tgagcatggtggcatgtgcctgtagtcccaactacctggcaggctgaggcaggaagatggcttgaccctgggaggtcaaggctgcagtaaacttttattgcaccactacattccggcctgagcaacagagcaagaccttgcctgttaaaaaaaaaaaatgtgattcaagcacta

SEQ ID NO: 177411 - DNA, 355 bp, Homo sapiens
aaatatacatttggaaatagttttttggatggtacttttggccatgaatctaactaagaaacctatgacaataaatacataaataccaaaaatatataaacaaattagagaacttcagatttttgtcaaacttttattggtccaaatttcttagaattgtttatgattaaacattgtttttcacttataatattgcttctatcttttcttttttcacttgcttagtgttatgaccactttgattattttgttaattttatttaaaaaggctttagatttaattctattttcttgttttctatttcattactttctgtttttgcatttatcactacctgtcctcctttatttttct

SEQ ID NO: 177412 - DNA, 337 bp, Homo sapiens
agtttaaggagacattgttacagatcaagagtgggtatttttgtaaggatatagaaataagtggaacagtgataatgactctttcggttttaggttcctcatctgttgaatgaggattatgcttaattaaatgttagcttttattattagatatttacataacttttcctttagaattttggtgattataatccctcccattttctcccattctggtactcatataaaacagacattgcaccttctggatcagattttcatgtcattctacctctttctcttactttccatctttgttctttattactgcatcctgggagaatcctagttgcctaat

SEQ ID NO: 177413 - DNA, 187 bp, Homo sapiens
gtactatcagtcattgttcccaaacccatttaatagtaactgttcatgtttcaagccgacagcccgaaggaagacagggttcttccagacatagcaaggaagctgtccaccaagtagccctccagagtggggtcattttggtaaattcacctcagtgtttggggtctggtccttagccctgatggag

SEQ ID NO: 177414 - DNA, 290 bp, Homo sapiens
  misc_feature (24)..(24): n is a, c, g, or t
attctagaggatcccagttctacnccaccatacttgtgaattactgtagcaattctgtaagagctgaaaaagtgggatgtaacatgacaccatcttctacgtctatcattatctctgtgtggaaatttagatacgtgtatagttttttcctattcagattttctgtttttaaaagacaaaggccacatcttttctttatactcttttgctttcttaaatatttatgttatacatttatgaaatactcgttgacttggcatctgatgtgcatataatgtgtagaaattgaa

SEQ ID NO: 177415 - DNA, 158 bp, Homo sapiens
tatgctcttaaggaaaaccattcaaagtccaagtttgtaacatatcccacccatcgagttggcctcctcattgccctactagtctactaagctactttctagacttatatttaacccatttttatccatttagtctattagaacacatattccatgag

SEQ ID NO: 177416 - DNA, 355 bp, Homo sapiens
  misc_feature (1)..(1): n is a, c, g, or t
ntgcctgtatgagcatatacagatctcgtggagaaattgtcctgtcgacggaaccagtgtaaagtcagtgagactgattctaatgctaagcatggaatgacactggcagaatgcaagagagtggttgatcagggcagcccagatatcgtggtcataaaacaggtgagtggaatggggaagaatttgccaaggagggaaaagtgaattaacactttaataatgtccaggtgtttatcatttcagctgtctgggtattgaaaatggttagtcccatttctttctttttttttttttttgtttttgagacagagtctcactctgttgcccaggctgaagtgcagtgctgcaatcttgg

SEQ ID NO: 177417 - DNA, 252 bp, Homo sapiens
tgagatgtagaggcgagctctggtcccacacaagggcagcggtacatctgtgaataggctggtttgcaactggctcgtccatacaaccagttcattttctaaatggaaacaaatccaaatgcacaaacccactgccatcccaacgtactgctgactttgctgtgtggttgaacagaactgactttgcttgaaaaggaacttacgggttctgtgtcacctgattctaaaaataaaacacttccattactgttg

SEQ ID NO: 177418 - DNA, 594 bp, Homo sapiens
ccctcacgatacctcaaggttgtctaacttcctggagaactattctccagaaatgcatgtgcacaatttcactgcgttaacccatgttcacaactgcatctgatctgttacactgtttggtgtacttgagcactctggtatttaagcattttgctgctgttctctgtgcacagctggcataagtgtcactccctactaaatgatgaaaccaaaaggtagagagcaggctgctacttttatgcaaaacagatttgaaataaaggcttacgcaaatattggctttaaaaatgttgcctgtttcttttagcagttttagactaactcttcacattgctttttaccctgaaacaaggactgagaccttgagtcactcatttgtgatataactgaagataggagatttattgagactttaagagcacttcagctcattttttttaaccaatgaagatattttttccttctaaaaagagcccaaagctagaacctgctctttctaatttaccacaggttgagagatttgggggtagagggtcggataggcaacaaatcagatctctagaaagatttcgggaaaatgtatttcattatttg

SEQ ID NO: 177419 - DNA, 119 bp, Homo sapiens
atgtgtctgtagaggaggagctggatggaatgtgtctgtagaggaggagctggatggaatgtgtctgtagaggaggagctggatggaatgtgtctgtagaggaggagctggatggaatg

SEQ ID NO: 177420 - DNA, 479 bp, Homo sapiens
cgggatcaggcagaaggggaaatacgaaagcatggggtatattagtagaaggggagagagaaatacaggaaggactcaaaaccccatcccatccttagatgtcaccttggtatgtaatcttctagataacttgtacatactttggttatgctcctccacgtcaatgtcacgtgtcatttaaattgcattccattggattgctgcactgaaataatttgtactcattgtcaggcacttgttttctccttttttactgttaatgtgtccacaccattgtttctttcagatgaattctcaaagttaaaattactgagtcaaaaaacacgcagttttaaaacttttgatgtaatgatcccgttttctggaaatgcagtatgggttcatacggaccatttattttgaccattgcttgcagtagacactgtaattaaaaatgtatttgcttgtttggtaggtggaacatggtacttggtttaatt

SEQ ID NO: 177421 - DNA, 407 bp, Homo sapiens
tccgcctcctggattcaagcaattctcctgcctcagcctccctagtagctgggactacaggtgcacaccaccacgtctggctaatttttgtatttttattagagacagggtttcaccatgttggccaggatggtctcgatctcttgacctcgtgatccacctgcctcggcctcccaaagtgctgggattacaggggtgagccaccacgcctggccaccaggcactattcttcatcctggggataccactgatcatggccactaggtcctctctacttttacattacattgtaacagacttagatagttatcaccaatatagttaacattctttgttttttttttccctttctttttttttgagatggagtcttgctctgtcacccaagctggagtgcagtggcacga

SEQ ID NO: 177422 - DNA, 385 bp, Homo sapiens
tttgtggagcaaagcctgaaatgcctttagggacccatcagtgcagtaaattacaccgactctcacaggcctcgttacgtgagactgcaggatatggccgggccactgccatctgcgactgtgacataagttaatgatcatgttgttatgaattaacctatcattagaaaacaagaagtatttccagataagacagaattggagactttcttgaaagagtaatggagtaaatgggaaacctcctcatccagcaagatgcagagaagagttgggggaaagggatcccttagttaaggcagggatccccaactccgggctgtggacgggtacccgtccatagcctgttaggaaccagctgcacagcaggaggtgagcagtgggcaag

SEQ ID NO: 177423 - DNA, 481 bp, Homo sapiens
atttgtcgagcaggtactcagttgcagggacaagtgctcaacactcagctaggtagcatctctccaacttctggaggagggaccagtgagacaggccacccccaacaatgaaatgctctccccaggcctccagcaccagcctcagtggggtggttttgcatcttctctttgtcttgttcttcaagacagtgagtgggaaagttccccagctttcttgacagtccatcacaacccctccttcttcattccttccgtggcgactcacttttagagacttttgcaattaaataaataaaggcatttcccaccaactttaagcccaacaactttatcttcagtgtctaccactcatttctcatatcccacaagaggaaagattaatgtgatattgttgctatttaagacatctgagcttgtccatattcagattttctttatttttctgaggttttccctgggttctcccacctccccagccaga

SEQ ID NO: 177424 - DNA, 662 bp, Homo sapiens
taacagtagtatgacaaattgttttaacttcacaggtccctttttaaggatctcaggaacatctaaagatccctagatccggccgggcgcggtgctcacgcctgtaatcccagcactttgggaggacgaggcgggcggatcacgaggtcaggagatcgagaccatcccggctaaaacggtgaaaccccgtctctactaaagatacaaaaaattagccgggcgtagtggcgggcgcctgtagtcccaaggtgctgggattacagacgtgagccaccatgcctggcatgtgtctttattttcttttacttacccacatgagctaactttctaaaagcacatatactgcttttataacaaaagattatgttatcttaaaaagcaaatggagaaaattatgtaaaatatcacttttaaacaaagtattacgtgggggaggtgtattattccatgggcaacctttgacatacttatggctccccaggtaggaatgaaaggaaacaacgaccaacagcgaacagacaaagaagcacaacatggtgggggcggcccagggcctcaaaaaagtctgtctacaagccaacgcgacatggcggcagcgggcccacagggggctcggcccgtgggtaaccgggttccggggatacttgggaacagaaaggggg

SEQ ID NO: 177425 - DNA, 148 bp, Homo sapiens
  misc_feature (24)..(24): n is a, c, g, or t
  misc_feature (30)..(30): n is a, c, g, or t
  misc_feature (35)..(35): n is a, c, g, or t
tgtgtggtgtctagaggatcccanatgatngctcnacgctcctcaattcacccatctgcttcccctattggattgccaaaaccttgaaggcaggagctcaccttgatggtcttctaaaaaaattcctgtccccggccgggagcggtgg

SEQ ID NO: 177426 - DNA, 334 bp, Homo sapiens
taaagcattagtaccattgaacagtttttgctgctcagttaagaccctttagggcatcttttaatacagacatcaaatattttacttgctctgtctgcatttattcgataagtattaggtgagtttcctactatgtaccaggcactatggcaggcacccaggatcttggatggcaaatcgaccacagtttctgcctgcaaggagtgggaggtgcattttctttcttttttttttttttttgagatagagaattgctctaacctcgtgggaaccaaaaaattgttcccctcaggttgtcagtaatgattgacctgtaaggaaggtttgctaggta

SEQ ID NO: 177427 - DNA, 1706 bp, Homo sapiens
catttccaggcattttgtgaaaaacgattctctgtccttgaagatgttttttatgtctcctaattgttgttggcattttctctttgagttaaacttcaaaaggggaaaaacatctcagggaaaaaaatttctcaaatgtttgcaataaagctctaatatcatacatacaattagaattgtaaaagatattctaaccatttgtggaacttttgtgaagtgagctcaccaaatgtcagagaagatctcactgtgtaatttctgtagaaaggctcccccggacagcgtcactgcacctgctgcagaaatagcattccaaagctggggaacccatgggctgcatgtttcctgtgtatttccaagtttgtcagtagttgtggatttcagaattatccctgaaaagtgataacatgtgtctgtccctagggtccatagactatttttgcagtgatgtcaccaagaaaaaaatccaccccagaaaacttcagtcacctgaaactctgagaaagatggatttatttggcttaaaactgtgctctgttaggattaaaggaggctttgaatttatcatattctttacgacagcatattttatagcatagaacgtgtaaggatacggggtagaagagaggctcagctctgcagacacaaatcatggtaactctggtattttccacaaagctagctgttttgaatcaacattgaaaacaaaatccactaaccgcaattaaatttagatttacaatcgataaatgacaggtgtctgaaattatcaactcagatttttaaagcagtagctgtatggtaaagaaagaattagattaggcattaaaaaagaaagctaatgactacctagcaaacagattctagtccagctaaccactaattaaccaactagattcttacctagctaaccacaaactgagaaactagactcctgtctgtctaactagtaactaacaaacgatactctatctaatacagctaaccactaacaagctagactcttatccagctaaccactgacaaactagactctagtccagctataaccactcattagccagagaggtgctgggtaagtcatgttaactttttgatttcttgatgttattgaaatgaaataaagactttaaagtttcttgaaaaaaataaagaattctcattagtgttataatcaagacaaataaagctagttcaccagtatcacatgaaatataaataccaagcgttattatcatggtggcatcatcgtgactactgggaaacatcgtcccaggtcacacctactataactagaagcaagaccgcttaagtatcttaaactgatgaaaccattgtgataaagtacagcagagtaaggagcaaagatccaaaaacttcgggaagctagtgtgaataatgatcattttagtagcatatgcatttcctcattcccagagactctaaaaatgtttacctaaatgctgccttacaaacatacgggaacaagcttttcatgtacgaaggtaaacctcgatgcgctaccctcaaccctaggaaaccggcacgcaagcagggcagaggtcaccaggggtcttgtagccccagccggtgctcccggatcgctgtgctgggagaaacttgtcataggactgtcatgccacagccatcttgaccggctattggagtggggcagtaacacgtttttactgttttcaaggatttag

SEQ ID NO: 177428 - DNA, 281 bp, Homo sapiens
agtggtgaacacccgtagtcccagctactcaggcgactgaagtgagagggccacctaagctcaagaagtcacggttgcagtgagctgaaatcacaccattgcactccagcctgggcgatgggaatgagaccctctctcaaaaaaaaaaaaaaaatcagagggcaggaaatttatatgaaggtaccaagacaaggacagatttccttgtaagtggcataaggagccatctgccagtcacatttcaaagggagctttaaggacattccatctaagtgatcaag

SEQ ID NO: 177429 - DNA, 114 bp, Homo sapiens
gcctatgatttaagtcccttcttaacacaagcattcctatgagactcaattgcttattattttcccttccttagtatgtttaataatgttaatggagttttcattcaataagta

SEQ ID NO: 177430 - DNA, 679 bp, Homo sapiens
tagaggttgtttaatccatgccaaattctttggacgtgattttctgcctgaaactatagtcttctttgcattttgctggcccaatgtcatcaagtttcacacaaagcttggaaaaatagcccacaagtgtagttggatcagcctttagaaaaggagactagagattctcagtatatttaagagaagatttaaaaatagaaaattacataagcgtagagggaatgtagaaaaataaattgatggctatatctaacaccttcatataaaaatggaataaaagtcaatcttccccacatcaagaacttcagagatgtaatataaagtctggagttcacatgagctcttgactgaaggacacgatcctatcagagaaaggtaagagagaaaaggtcttctacggccctggttatcaccagagtagttaggagaagggctggggatagaggaggaaatgagttccgtaagttccaccagacagcagacctactgaatgaggcttaatttgcttccctaatctctccattggtagaaattgcatagtggcttaagagacagttagccagctgccattttaatatcttcatgtttccaagttgttaactacacgtttcccaaatcctaactttatatcacagtattggttaagagtcttggaacaaataaggatactgaattggct

SEQ ID NO: 177431 - DNA, 414 bp, Homo sapiens
acgttgacacttcaggaagaggaacataggctggaatttagattatgggggctctgaacaccaaactgagtttggacttaattgacttctgtaggcaacgaggagccatggagattctgctcagggaagtgaggaactgggcatgccttaggaaaattaaccagggggtggctggcaagcaagcagacagcaggagaggaacgctgtggggatagggaggaagaacctcgcatgaccttgctaacacagcaacatcccaaccgttggttcggcctagaagctggtatttgggccatctgtttcccattgtcttaattttctgctcattagaaattgaacccataaaccagtccacacaagtacgttatctaagtaatgttgcattctgcttctcttagactacttttttttttt

SEQ ID NO: 177432 - DNA, 673 bp, Homo sapiens
tgttcagaggatcccacaagctgtcacaactgggcaaccaagtgaaagggattaacattttaacacaatacttcttactcccctccccaagtcccagtgcaagggcacacaagagcagaaggaaataatatgtaccctcaatctcccagagacttgacaacaagaaagccaagggcatatgacagggctagaaatacactttgcaggaagggtggaacgaaaggctctgcctgacagtgcttgctggctgccccttctcctagacagaaatggtgatggtacagactaacagattcataccttcatacctgttggaaattatttctccagatagacagctgctgcctaagtgataccctgatcggtcaccacagccacaaagctcagtactgctgcagagcatcctactgtttaacagcttgatctaggcaccaggaaaaggctagagggaccttggttatcatcttgagcaacttcacgaaggcacacatacccaacaatatttgacaaagcaagctagcagaaaattcctttatttccatcccctaggcctacaagtaccagccaatgataaataaaagacatttcacatcaagagtcggaatagcaaagagttacaaaaaaactcaaagtacttcggagtaaccttctcagaggcacacacacactcagg

SEQ ID NO: 177433 - DNA, 317 bp, Homo sapiens
ttaacttttttcctggccagtgtcatcagtggtattatgttctatcaagaggcacataacgtctggtggtctctccttttgtgataattagcagactgttgaagctcagtgcctcattccatcagtcaactaaggtttgcaaactcatgatattttgatgcagtcattgcttttcatttatgagctgaaccatgaaacttgcccttatctactattggtttcccagtggtacagtttatataggaaacgagaataaatgctgattcttcttttatgtacttactttcaaaataatgagttagttccttggtatcatg

SEQ ID NO: 177434 - DNA, 232 bp, Homo sapiens
ctcataacctaaccaggaaaagaagtgtatgataccatagaaggattaagtagttcactgtttgtaccactttgttaaataaccttctttatgcaaaggtacaaaagttccacacacacagacacatgcacaaacacacatgcacgtacacacaagtacttgtaacacatatttgtttgtttttaagtttcatgtaacatccaagttaagaaagcacagttaggtctactgg

SEQ ID NO: 177435 - DNA, 1111 bp, Homo sapiens
acagctggtgggtggcagagctgggattcaaacccaggcagcttggctttagaatcaacagtctgagcctcatgtcctgctgcccagatctggctgtagacgctctttatttatgtctttctttctctccagctgctgagctgctcaccctttatccactttgcttatcacagtgtctggcacacagtggcattcaagtgctatttgtcaggtgaatgaaggaatgaatgagaaagggggaatttcccataacccaactaccttagcacaataattatggtaattttgacagattgtagatttcaaatcatgggtcaggaaccgctcctgccagtcctgttgtcctgtcatcatctttgaggccagaacagcccagctgtgccaacatacctggggcgagaggcagcccatgttcctcacgccagcggtcagctgcgggttggcctcgggcctgtctctctcttgatctcgcccttactcactccttcgctgtctctctgaacctccttatcgctgtctgcctgtcttgcccacttctccttgttctcattgtgcctctagaccctctttaaagccagtggagtttgaggacatgcaatagtaattttataatcattactgggcagtgtaaaacaaacattagcacagctggcaaagagtgtaggcagatggttcctttgggatcctaaaaaagcaggatacagctgagatctctgtgacactgtggattcagaaactgctggaactgtccagtccctgtggtggctgccccttgtaggggtggtgccaagggtggcttgggggtttaggtcctcctaaatttccattaggccccaacaaatacacaatatagctaaaaaaaaaaaaaacccagtgtatttgttatgaaaatgcaactttgagatgagtctctagaccccacgtcccccctttggataaactctggtgcttcacagctgccggagacccatttgctgtcctctgctttgctaaccatcttcactgagtctttaatatcaagtggggctggaagactgaccagtgccctgattcatttacatattgattcattgcaggtctcaggcacaggttgataattatctaactgttt

SEQ ID NO: 177436 - DNA, 343 bp, Homo sapiens
cctatgggtccccttgatcattcggcctgagtttggggtttcttttcctgttcccttttcccttaccaaaagttctcaaaagataaaccctggtttcctcaagtctagtttcaaagcaataagtgttcaggtagcaaacatcttctatctcattgcatcaatctcatgatcacaaatgccacatttggctcccaacctgctccaggctaatccaattttatgcaaaattatccagaggtgggatggtgggcataagtcggcttgagtgtggtcctccagtcgagaacctcttgagcacagttagataatgtaggcacttaaagcacgaggtccaagcagcttg

SEQ ID NO: 177437 - DNA, 169 bp, Homo sapiens
tgacaatttttaaagtaggtatttatcacctcacttttatagatgaattaaagagactgtgactttccagaagtggccaagccactgcattctattatctctctagtgattagagggctatcagatttactctctccctcagggtttaccatcagcccttcctgcttcc

SEQ ID NO: 177438 - DNA, 386 bp, Homo sapiens
ctccaaaaggccgtctccacctgccaccgggaaaggacccggagcgaaggatgtcgtgggcggtcagcccaggtgattgcccttcttttgctttggagccaggcagaacagagctcaaattccagctttgggacagtgtgtggcccagaaggctgtaactgcggagttaacactctccagtttccctagatggcccgacctggccggtgactcggggatgatgaagctcctggagcctcagcgtgctcacttgagaggtagggcagcgctttgtacttcacagggccatggggacaggctcagggcctggcactctagtgaccggcttcatgctgggtcactgactagggaatccacacacctttttagtccagactgagtaggta

SEQ ID NO: 177439 - DNA, 105 bp, Homo sapiens
ataaccatcatgaagaccaaggaagagcttcctggttcatgctaagtagtttggattttaccctccagtcaatacggaaacaagaaagagcttaaaggccagtta

SEQ ID NO: 177440 - DNA, 671 bp, Homo sapiens
gctgagtataaatttcttaagttcgatatctgagtatataattaaaaagtgatttttatccagcgttgcaagaatgctctcctaggtaaaattactgattaaaaaaaattagtccagttgatttatttaaatagatctatatagatttttttgaggcatttctatgtcaggagctatctaagcctcatctaaaaatgttgttttcctaccttatgtggaaaaacctaccacctggaaagaaataaagcctcagttctatgtagatatgctcacacccagataatagacagacaaacatcttgcttgtactccagcctgccctgccctgtcctgccctgtcctactgcttacatggctatagaagctgtttagggtgtttctttttccgccattcagtctctatatggtaaaatggcagcagcaatgcttgttatcttatagaattaagtcagaattccagagcagaaactgggacttcttcaagaaagaagaagcataaccgaaaccagaataagtggagctcggatagtatccagagaggggaaaatatcagaataaaatgagcagagccacaccaacatacttctaggcaaaatcagtactacagttaaggaggcacagtggggtagttggggggatgcagtttttgatacccataacttctgactgtt

SEQ ID NO: 177441 - DNA, 420 bp, Homo sapiens
tgtcaattttcatcctcaatgacctacctgtcatttgatgttccagagccattaggtctatatcacataggtatgttcctactggatcctccattttttaaatgtccttcagcaagacctgcacactattagcacagtttgaatggattaaaatattctaatgccatcatttcagaggtaagtctacagagaagagacagtcattcaaagatgcatgacactttggatccattgagttcatcctcttactgccttgaatgaggccacaagagaagtgaggatgctggagctggcagcacctacatgtgaaccctgactctaacacccagtaactgtttgatgtggaattacataagccatctttgggtctcagctttctcatctgtaaaataggtataatatcactcacttcacagggac

SEQ ID NO: 177442 - DNA, 763 bp, Homo sapiens
ctgagtttgtatttccaacaacagcctgcccgggtgatcgttctgaactgtggagctcaatgcagccaggatgccaggcatacagcactggtcaggtgccaagcagctgccctggaattgtaaacgttacccacacccgtcacaacggattagggaacgtagagagaagaggggcatctgtgcggtgtcatgaaacaagtggatatctgtgtcattccagttgaaacctgacattgttttccgatcttggagtgccgtacacgttctgcttctcgtagaaaagccgcaacagctcagaggtgacttcctgtcctttggaaatgcctgttccactggcttttcagtttcctgaaatagctcagtcctccagaggcgaggctcccagcatcctgaggcacgtgtccatggggaaggaggggcacgctgattttagttgcttttccaaaggcgccttctaaagccaggcctttatcgggccctgctggtggcttctccacggtgccctcatgtggacctcagactgggctttggagcctcctgtctcacacacccattttgtccttcccacacaactcattctttgttctcacactcccactttcccgctgcttctcacactcattttcttacacttgctattccactcacacttgttctcatttgtttcacacacctctcactgttctcacactcgttcactcacttgttctcgttcttacactcacacctcactttgttctcacactcgttcactcacttgttc

SEQ ID NO: 177443 - DNA, 1042 bp, Homo sapiens
ctgagtttgtatttccaacaacagcctgcccgggtgatcgttctgaactgtggagctcaatgcagccaggatgccaggcatacagcactggtcaggtgccaagcagctgccctggaattgtaaacgttacccacacccgtcacaacggattagggaacgtagagagaagaggggcatctgtgcggtgtcatgaaacaagtggatatctgtgtcattccagttgaaacctgacattgttttccgatcttggagtgccgtacacgttctgcttctcgtagaaaagccgcaacagctcagaggtgacttcctgtcctttggaaatgcctgttccactggcttttcagtttcctgaaatagctcagtcctccagaggcgaggctcccagcatcctgaggcacgtgtccatggggaaggaggggcacgctgattttagttgcttttccaaaggcgccttctaaagccaggcctttatcgggccctgctggtggcttctccacggtgccctcatgtggacctcagactgggctttggagcctcctgtctcacacacccattttgtccttcccacacactcgttctctctcacttgttctttcacacttgtccgcactcattctcacagacttgttctcacacggtttcattctcacatttgttctcatggacacacattttcacacttgttctcacccatgcttgagcttccatactcattctcacacttgttctcttgcagattcgttttcacacccattctcacatttgttctcacacttgttctttaatacttctttgttctcacatacccacttcacatgttctcatttgtcacacgctcttgttccttcacactcattctttgttctcacactcccactttcccgctgcttctcacactcattttcttacacttgctattccactcacacttgttctcatttgtttcacacacctctcactgttctcacactcgttcactcacttgttctcgttcttacactcacacctcactttgttctcacactcgttcactcacttgttc

SEQ ID NO: 177444 - DNA, 130 bp, Homo sapiens
agaggaatatcgtggcaaaatataaatttataaacttatacaaatctataagacagcttttcagactctaaatggaaatgttggggagagacataaaagtaggaaaagtaaaaataagcacctgatgatt

SEQ ID NO: 177445 - DNA, 331 bp, Homo sapiens
gaaaaaggaggaaaggaaggtaatgtaagaggagaggaggggaggggaaggaaagagaccagcaacttgtctgagtgcaatgccatcttgcaggggaaagcatttttcagagattcacagtccctattgttcttcctcaaaggcctgctgaccaataacgactgattctggatctaccttacgaccttcctgggccttctgcacttgaaagcaggcactgcttattgaggatggtttatgggctttgctttatatacttatgattctgttttgcttagtgctgggtctcaaaaagcctagaaagccatgtccccgcctccttgagacatta

SEQ ID NO: 177446 - DNA, 474 bp, Homo sapiens
gtgaagtgcctttgggatttttctcacctttaccgagttgttcacttatctttgaggtttactatatacatatagatagagatatataggtatactgcatacaatttcttggccagaattatgatttacatatattatctctcaatctgttttgtttttttcattttcaacagtattttgtgcagagcaaatgttttcaattttgataaagtacgacttaacagtttttcaatgtatgcattatgcttttaatgctgtatctaacaacttttagacttagatgtgagattcatggttaactgtgtttttctttcagcattttgaatatgttctacaactgattccagcttccatggtttctcaaaagaagtcagtgttaaatcttgtaagaatcacttgtatgaaatatgctccctttctcttgcagctataaaggtattctttcttttacacattctctttctctctctctct

SEQ ID NO: 177447 - DNA, 309 bp, Homo sapiens
caaaaaacaagcaaaaaaacgagactgcaccagagctgctcagctctgattccagctggacaacaaaattaatcatgcagcttcaaaaactcattgactgggtgttagttaggtctcaggatttaagtttttaataagctcttggtgatttctattagatgtgaaggcagggacgactatatgtctctgtggtgtccaagcaagctgagagtcacagctgtggacgtttgcttcccttacagaagtagctctcaaacaggaatgaccctgcccctgatgggacatctggagacagttttgcttgttacc

SEQ ID NO: 177448 - DNA, 350 bp, Homo sapiens
agctcctcgattcaagagaaagagggcaagtacccgcctgagaggcacagtgttccacagttcattgcctcaggtgatttgagaaggctgtgcccaagaagatgcatgggagaagggctaaagctcattaaaggcctcagctgatactctaaacttctgtgtggtctcaccaaggctgccaagtacagctgtgcagggcatgtactgcacaagggtgtctgagcggggctgaactcaccaagccttgactctggctgtgcccaaccagacaggcaccttcttccacttctcataaaggcactctatgggctagaagccacattccacctcagtgaaggaaaccaagggga

SEQ ID NO: 177449 - DNA, 267 bp, Homo sapiens
cgtgtaaaggttaggctttatattttgtttgggtggatgtgtggaaagctcctcaactgtgcatcttgtgaaagattgatattaggcttttgtatagaagactgagaaagcaggctttaccctaaggcatggggctttactcttagggcgtggcccttgtggtgtcaaagctggattcttgaagtggtaacaagatgttaatgatgtccctccactgtggctgcggaggatctccagcattacttagttcttctcaacctttacatt

SEQ ID NO: 177450 - DNA, 237 bp, Homo sapiens
cacagaaaaaaatgggtaacttagtgaagaccacacaattaggaagtagcagccttgggtccaatcaaagaccatctgctttcagattttgtgaccttgaaaagtgtcacaaatatattgcttttcctttgatatcatgtccacatcaagtagttgcaatatttccacccaccccttcacgctagatttctcagaagagctacttgtgttttatgattgcattttctcatattccag

SEQ ID NO: 177451 - DNA, 444 bp, Homo sapiens
cttgataccttatagaagtggtgcctcaaagtcacttggaaactttgttacacacagactgctggaccctactgccagagttttcgatttgatagatctgtggtggggcctcagagtttgcatttccaacaagtttctaggtaatgctgatactcctagtctagaggccgtcctctgagaaccactgccctgtggtatgcctggaagtgtcccatgccagtagagccaaaatggccttgccaagctggaatggaggaatctggggaccctggacttagggatgtcatccagcagggctccaggcatcctgtcactggcaatgggcttaatgtccacaataggcctagaggcccatggctcttcttccagggatgtagcacccttgtttaggacatcatggcccaccatggtctgtccagtcatctctaacccctgccatcctca

SEQ ID NO: 177452 - DNA, 505 bp, Homo sapiens
tcactgggttgcagctttcccttgccaataagccacaggtctgcgggcggccaaaatactacctaggaaaatcattcctatctggtgtgtttgaactttgcagtgataggggaactcgtttcaccagccaggtactggaaagagtttgaaaaatctggcccattctacagcattttcactgtgcctatcacttgcagtcctctgggctagttgagcagattgatgaaatcattaaaagacagctggtctggcaaaagtcacaaaaacttttaattttgtcctggcctaaagccatttcactagtactactgattctgcagtccactcctaccagagaacattgactctctccttttgaaattgttactggttggtccattccctcagaccaaggaatatttcttcgacctcattatagggggaactcctggcttattgccaggggctcataaaagctataaggatcaaccaccacaaggtgggagaatcttcttacagcttccat

SEQ ID NO: 177453 - DNA, 198 bp, Homo sapiens
tacaaaaaaatacaaaagtgagccaggtgtggtggtgtacgtctgcagtcccaataatgggaatctgaggtaggagggtcacctgagcccgaggaggtcagaggctacagtgagctgagatcgtgccactgaactccagcctgggtgacaggatgagacccctcaaaaaaaacaactattgccagtatatatgaaacc

SEQ ID NO: 177454 - DNA, 292 bp, Homo sapiens
gggtccctttcccctatcctcaatctgcgagatacatggcaattctaatcatgacaagcttaaattaatttaatactatcctattatctttgggataaagatcacacgtgcttcctgaggtcagccttcttagcatggccgaaaaggtcctacctgatttggcaccagtatcatctctcaggcactcacaaacccattctccacaattcagtcttttctgctggtcttttcttctgattgtctaatgcatgtgattcttcttgccacaagaccattgcacattccattccag

SEQ ID NO: 177455 - DNA, 264 bp, Homo sapiens
tgtagctaaggaaagccccttcaacaacccaacaaaccattaatgctgctaaactaaatgagacacatctccatttttccacatctcccagtatagagagagaataagccagacccaaaaatatgtatggttaaaaaacaaataaataaaataaggcccaagaactggtatactgctttgccaaacacattagttaacaggggccatatcagcactctgagtgtcatggctggcacatgaggtttattgttaaaaacagaaaca

SEQ ID NO: 177456 - DNA, 579 bp, Homo sapiens
ccactggcaaaaatggaaaagttaaagattagggaggttactgagggaagaccaacatctaaatcaaccgctcaggcttgttccctaacggaagatttacaagtctcttaggatgagtaccgcctaccaaagaatgaccctctggtaagggagactctccttgtttagccgaagcttctaacaccagatgagcatagctgtcaggccattctcaagcacatgcttcaagattcattcttcagatttcagttcctgctatggcatgatgttcctttgagccggtttgcctcttagcacagagtaactatgatgagcctgaacccagtataacgtaacattcctaaaggccaagtgttgtaaactggacctgctcagaaagagaatgctgactataaaaacttagtcatcttcaaatatataggccattgtgcagaagaacttaggtggtatatatacagatacagaaataaataatggtaaatcatattttgggaaaaattatttcctttctaattctctatcaaaccttctgattttgaatctcagatctcagctggatgtggtggtgcatgcctgtcg

SEQ ID NO: 177457 - DNA, 207 bp, Homo sapiens
tgggcatgaccattaatgcttccttctgcttctcaacttgcttcccagcccacacaggatcaccaaattgtacaagttaggaagcattcacattatgttccagggatgccattcacgcagaccacaatgtaaagggtgctccttggagttaagccctgaatgtgggggccctgaatctactgccaaatcttgcccattctacttccc

SEQ ID NO: 177458 - DNA, 538 bp, Homo sapiens
ctccccctttccctcctctcgtttctttttcctcctacactttctccttcttcttatctgtctttttagagatggagtctctctctgctgcccagactagagcgcagtggcgtaatctagctcacttcagcctcaaatctcctggactcaagtgatcttcttacctcagcctgctgaatagctaggactacaggtatgcaccaccatgtccccttttgttttacacttttttgtagaaatgaggtctcactatgttgcccaagctggtctcaggcttctaacctcaagtgatcttcctctatggccttgcaaagcactcggattacaggtgtgagcactgcactttggcctgttgggttatgcagtaggagagcagggatggtggtagtggctccatatggattcctgcaaaaagtggtgtgggtgaatactggatgccccgttatgttggaacttctaaattcctgagctaaattagaaaaaaagaagcagctcttgaaaggaatgatgttgtgaaggagagatgcttggagaaacc

SEQ ID NO: 177459 - DNA, 521 bp, Homo sapiens
tcacatggttagtgggtaaaacagatattaagcaaattatcacaccatagaattgcaaactgtgacaaatactgtgaaggaaaaggaatgatactgtaagaacttacaaggacacatgatgtagtggggggtataggactggatatttgagtttaggtttaaatggttatcacaaaactgtgggccttgggaatccgaatgacttctggtgctcacttcagtggcaacagcaacatagtattttatgtttctactgaagttgaaacaatttcattgtcccttcgatttcatttgctttaacaaatcatggctgactgccaacatcatatgcagaccattactatttgaaaaatggatggtatacaggcacaaatctaaaaacagacacatgggttgggtgtgatggctcaggcctgtaatcccaaccctttgagaggctgaggtgggtggatcacttgagaccaggagttcaggaccagcctggccaacatggtgaaaccccgtctctactaaaaatacaa

SEQ ID NO: 177460 - DNA, 215 bp, Homo sapiens
ccagcctgggcaacaagagtgaaactccatctcagaaaataaaaataaaaataaataaaagtacatgaaaaaagtatattcccttaagcaggtaaaatacttgcattgtatttttacatcatgaatttgcttgttaagaaatttcttttctgtaagtggttaaaagataaactgtattccatcctctgggttttcaattctaaattattggagct

SEQ ID NO: 177461 - DNA, 506 bp, Homo sapiens
tattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaa

SEQ ID NO: 177462 - DNA, 537 bp, Homo sapiens
gtattcctacactacaagaaatctttaagaggtttttttataccgaaggaatatattagatggaaacataaatcttcacaaacaaatcaagagtgctaaaaagaaataaattatctgatctaaaatattactagaagtaaaatattgtgcagaagtagctatagtaatatcagacaaagtaaacttcagaacaaagaatgttgtcagaaattgagatattacacaataataaagaggtcaattctccaattagatataaaaagtataaatgtgcatgtacttaacagagcttaaaatatattagacaaactgtgacactactgaaaaaataaaatgacaaatacacaattataatgggaaactttaacacttctctcttagtaactgcaggaaaatgtaggcagaaaattagtgatgacataaattacttaaacagcactactattcaccttgacttaactgatacgtatttttaaaactacatccaatgcacgtttttcagcagcacatggaatgttcatagagatcaaccatgct

SEQ ID NO: 177463 - DNA, 345 bp, Homo sapiens
gccaaggagaggtgtcaaagctttgtcttccaaccccactatggcttggtacaacctgctcttacactaagtgagacaaagggatgacagtgtgctttttgtctctaggaggctttactttctttctacccatcatcctctcttttccattcccagagagtactgggcacaaacaggtataatagctcccaccagtcaaaagtggctgaacttggcattgcaggattggtgtttgccaagaggctctgagtccctgtacaaacacttgaactaggtctgggtctgttattaagtaacccaaggttgatctgatttccccacagaaaagaacatttataatcaaat

SEQ ID NO: 177464 - DNA, 253 bp, Homo sapiens
tttgattgaacaacatattaaaattacttacttccactaagataataagaaagcctgttcaaatatatggtgcatatatttattcctttataacgtatcttaaatccttccttttgctttccatccctagtgacaacagtcttgggtatacatgtttttttttttttatttgatgcatgaattacaaaatttgttttctaactagctttcatttctctagtcctactcccttttactaattgtatatacatca

SEQ ID NO: 177465 - DNA, 671 bp, Homo sapiens
gcagcctgacatggtgacaagaatgtcagacagatgaaagggacacagcctgatttaaaaccaaacactgaacctttttaaagaagaataagacattttatacacacacatgacaccaaaagcacaaacaaccaaaggaaaaatagatacattagattttatcaaaattaaaaacttttgtgcatcaaaggacactggcaagaaagtcacagaactcacaggatgagagaaaatattggcaaattatctgttaaggtctaatatccagagtatccagaagatatagagaaattcctataattcaataaaaagacaaatcaattttttaaatgggcagaggatgtgaataaatatttcttcaaagaagatatataaatggctcatatacacataaaaatgttgaatgtcttaaatcattagggaaatgtccatcaaaaactgcagcgagatactactttacactcactgggatggctatgagaagagacagacaacgacagtgttgacaaagacccggagaaattgaaaccctcaaacattgcagatggaagtgtaaaatggagcagccactgtggaaatcagcctgacaggtcctcaaaaagttaaacataagagttgccatacgatctagcaattctgctagggatgcaccctagaattaaaaacatgtc

SEQ ID NO: 177466 - DNA, 288 bp, Homo sapiens
ttgtgacggagttttgctctcgttgcccaggctggagtgtagtggtgcgatctcggctcactgcaacctctgcctcccaggttcaagcgattttcctgcctcagcctcccaagtagctgggattacaggtgtgagccactgtgcccagccctaagaatgttttaaaatgctcttttaaaaaaattcaaggcaaaccactcaaatacttttggagaaaagattaaatatcataggaattatacaacgtgatttaaactttcagagattgaaggaaagaagattaagctt

SEQ ID NO: 177467 - DNA, 438 bp, Homo sapiens
ggctgaggctgaattaacaccctctgtattggtttgccaccttcagggtacatcccaaaattctgttaggctggtatttgttgtattttttccatctatacttgggccagaaagtatcttagagttcctattagcataagagcaatcatcgtggctcactctgtatttgaataaaaaagagcacaaactataggacgggcgcagtggctcatctatctacgcatctatccaatctatgtacctatctaacctatctatgtgtttctctattatgtagttattttcagaaagggtctcattctgtcaccaaggctggaatgcagtggtgcaatattggctcactgcagcctctgcctcccaggctcaactcaagcgatcctcccacctcaacctctccagtagctgggactaccaggctcctgccaccacagctgacta

SEQ ID NO: 177468 - DNA, 114 bp, Homo sapiens
tgcttttcaactggatctttctcttcttcaggtcctcaagtcaggcctacaacaatttgtttcctaactactcttcctgtttatttttaatctcccttactgcaccaactatct

SEQ ID NO: 177469 - DNA, 467 bp, Homo sapiens
gatttgggggataaagaacacttgtgctgattgctggaacttcccatcaatcagccaagaatgctctgccagtgggtgagagtctgtgaggcaggagagcttgggggcttcccctgtatggtaataggtgtatgaggaggaaatggtgggggcatccaggccatgtggagcaaagagaataatgtcataggtggtattgtcagagggaagggaaaatcctggtctgtggaagggccacagtgaccctgtgagccaagttgcaacactgaagtcccagccaaatccctgctgtgttcactgatctggagcctgagacagtcacctgttttgcccatcacaagctgtggacgctgagtctcccatgacaggagcagcctcttttctcctattgttgatcaagcctaggcctactctggtttgcctggggcagaaagtcatggccaggtttgatgtccaggggtaaaggt

SEQ ID NO: 177470 - DNA, 223 bp, Homo sapiens
atgttgcccaaatgttgttagccgcctgcacctgtttctcttccaaatagccatgaggggtgggagaaggctttgaaaaggatgtaggtcttatcgggatattatttctttttctctctattaatgaaacctctgaacctagggtgaactgtaaaatctttactattacagacccttaagtgtatgatgtacttttggtacttaaacaacttttttagttcta

SEQ ID NO: 177471 - DNA, 470 bp, Homo sapiens
tttttttatagggacggggtctcgttatgtgcccaggctggtcttgaactcctggcctcaagtgctcctcctgcctttaagtgctgagattacaggcatgagccaccagacctgaccttggggttttattatttgccttcgagccccttcagacagttcttcttggaggtttggggaaggcttctgtaaagaaaacttccttatacctgtttgatgatggtaaaaggtccaggtggagaaagacttcctaggcagaaggaaaaggaagtgcaaagctatgtagcctctacaagagcacatgtgtagtttagggtggctgcataggacctgggaagagagctgggtgatgcagggcagatgactggcaggtaatgaaggtacttatgggctatgctaaggagtatggaaaatggggagtattcaaaatttagagcccagggtacagtgatgggattgcattttttgacaaa

SEQ ID NO: 177472 - DNA, 457 bp, Homo sapiens
actttctcatgctctggagctggcctattcaatacagtagccactagccgcatgtggctatttaaattaaaattaattacaattaaattaaaatttcagtttcccagttgcactagctacatttcaggtactcagtagctgcatatagctaatgttcaccgtattgggcagctctcatatagaaatttgatctgattattcagcttcaaagtttgaatattttattcttttttccatcttgacagtctttctcttttttagccttcaaaagcctatgaaatttattctgtatccttagggaagcccaacctgtttataaaacattttgagaatgcttagcttctaagagttaaattaaggtgtgagatttagtagaaatcgtgtgtgttacaagagtaaagggaaaattttcattgatttgtgttgagattgtgctaaaggacgagctcctaaagat

SEQ ID NO: 177473 - DNA, 469 bp, Homo sapiens
tgacctcctgggctcaagtgatcctcccatcccagcctcctgagtagctgggactacaggtgtgtgccaccacgcctggctaatttttaatttttttgtagagacaaggtcccattatgctgccgttttgtaccactttaatataaagctaaaaatcttccttatcttttaaacttttagccacttagtaatttcattttttaaaagtctatttgatttgttaagtctctattaaaaatgatgcaatgtgctttgctgtgtagcacagcagacagaacacaagcgttagtgttggacaggcctgggcttggattctcgcactgtggatcactaactgtgaatctcagtgagttacttaatgtttcactttccacatctgtccaatggagagttcataaggttttccttattgggattacatgaggtaatgcttgtaaaggcctcagcaccaggctcagctcttgttatt

SEQ ID NO: 177474 - DNA, 224 bp, Homo sapiens
cagcatgggaaaggccctgctaaatttcaccccagcacttttaggagtggaggaaaagcagagtttggattaccatgacatgagaagggaaggtgaggttgggagtggaaacttggattctggaaaatttcatgaagcttggctgtgaaggaagggagattggatcgcaaggtctagagaagtatttatggttgtcatttgtttttgtttttgttttaaacact

SEQ ID NO: 177475 - DNA, 817 bp, Homo sapiens
tgaattgacaaattgatctgtaaatttaggtttccatgtagccagtgatccccaaatgcactaacatgccaatcatatgaaggggtaggggtggggggccaaggtgggagaactttcatctacatccaagtgagctgtcagagctgtttcatcccagaggctgcacggggctgaagaaagcaagcgtggatctgtggagtaaagagcaacctgggtgcaggtggcagctggactaggcatttctttagaggaatgactcaatggaatctgtcccagccagcagggatggagaggtcagcccaggggactctgttgactgaattctaagaaatgctcttctctgcacctgtgggatacagagtcgacaaagaaccagtgaacagtcatcaggagagcccatgaacttggctttctgatgttataataactgataaatgtttctgtggcacaccaagaattccacagtgataattagaagcttgctgggtaatgtgaatcacgcatgactggctattacgaacttggtgtgggtgctaagaggcaagagaagggttgcagaagccacttggatccagctccgagatacatactgtgagtgcctttccacccagggctttggtgtgattgtgaaacttctgtgaggttgttgcaattgtctttctccccacttcctcctaggccagctattttcatagaggactgttactgcactccccatgagaggagatggtaaatatagaattttagcaacacaatttcagggggtgcacgatgaacactccacgcctgcaaatcttccttgaagagactcaaaaat

SEQ ID NO: 177476 - DNA, 728 bp, Homo sapiens
aggaggtgaaggttgcagtgagccgagatcgcaccactgtactcaaaccgaggcaacagagggagacgcaatctcaaaaaaaagaaaaaaagacaaagcttgttaataccagcatattgttaagggaataaagtaggctgcagaacaactggtgtaatatggtgccatgtagggaaaattacatgtgtgcataggagaggggtctgcaaggttgtgccctaagatgttagagtggttcctttgcttttctcttttataattttgtatttgacttttaaataaggaccataaatcacttttataaaatacattctctccagcccctactactcctttaaagaataagagtggtttgcccaagaaagacagttttttttgctctggttttcttgattctgacatcagaggaaactccttctcatccacttggggctctgggttcaggggattcatttcaggcagattaaagtggtgaccaggggcattcgtggacacagggagggacaggagcaccatcagtttgtctcacacaaccactgtcatcctcactgaaggctgttgcctgatcaaaaacagtattgggccaggcacggtggctcacacctgtaataccaccactttgggaggctgaggtgagtggatcacttgaggtcaggagttcgagatcaacctggccaacatggtgaaaccttgtctctactaaaagttcaaaaattagccaggcgtgg

SEQ ID NO: 177477 - DNA, 490 bp, Homo sapiens
taatattccccataataaatccatttctacccctgcctgatacactcaccgaacctctctcatcttcccctccgaaaatctctatcacgacttagttccaaacagaagggaacagccacaccaggaatgtgaacaggaaaaacattaacatagcgaatcgttacctagtaagatgacgttaacagcggaagtcaagaaaagaggacacaaagggattcagaagcagcaaatgcagaaagatgccgcgatggctgggcttcaggagcaaggaaggggccgggaatgcacagagctgccaggggtgcgtggcccagccaacctggtgcatcaaattaactgtcgcatgcggttaatacctaagaacccttttattcttttcctgttttagaatttttttgacaattgaacacatttttgcatatgaactttaaatttgtgttttcctatttttaacattggaaatcttactggaattaaatatttatattca

SEQ ID NO: 177478 - DNA, 472 bp, Homo sapiens
agctccaatcacactaacccatgccattacctggacacactgtgctagtctacactcacgtgcccccagctcacatctccccttttcctggaatgccatgtccatatggcctggagaatgacctaaagttagtgccagcagagagcttatcagtagtggggcagatcacaggggagagcaggttttggagctagggtgaggtgtcaatgagaagaagggtgatttattaagaagtaagctcatttcaagccatacacctgaaacctgacgcccaaagaggaggcagagacccaatcaactactgatacagtttgtgaggctggagacttgagagaacaataggttgaggcaagtgtaaccaatggattaattccttaccaatctaggattcctggagcgtggagtgctccaggcctggtggcaccaagactttaaaaagaaaaaccattacacagtgagatttggtctctac

SEQ ID NO: 177479 - DNA, 554 bp, Homo sapiens
gctgcatagctttaggtgggcttcctcaagtgttcccacagctttcttctttgtggattccctccacagtttaccatggagaccagaatcctcttccctggggatgccccagcctttcctcctgggaaagtaagcatgcttactgctattggtccagcctcatcttcccaggctgtattgacttggcacagtgtcaccgatggggctgcgtcctctataagcccccacaaacacacatccatcccatctggggagagaaagcggttttatctacttttccacttggcttcaaagaatctagaaaatcagatattttgtatcaagtgacaggcaacaagcagaaatctgaaacccactaaaaagtccttcttttgatgaaaaatttcttccgtatgtttggaaaccaagctgctttcatattaattgaatatactgaacacacacaaaaacaaatgtcttaagatctttcttttacaatgctgggttcaaaagttttggattccaaaatgtttctgacaaggctttaactgtttttcaggcatgttgtgtgcttc

SEQ ID NO: 177480 - DNA, 419 bp, Homo sapiens
gccagcaagtggcagaactcataacttgaacccaagtccgttgaccccaaggcatagttcttccccatttcaagcctctcattattacagggtatttagactatctttttggactgtactcacttatgacaggctggaaatgtccatgactgaacttgacactctttttagtctctaactaaacataaactgaaacctgggcttaaggatggttgaatggtttctcctctctaatttccttcaaggtctccagacttctcactaggtaatcattggactgtccaaatcatctgaaacggaagtccttcaagggacaatcagctgacagtacagctctttgcaggttgccttcctcgtgttcagctagctcattgactaagcatctacttgtgttgtcaaactctttcaaacatttctca

SEQ ID NO: 177481 - DNA, 384 bp, Homo sapiens
tggtgaacaatgggataagattaagacagttttgtctggcttagaagtgagaaagtggttggagaggaggctagagaggcaattatggaggactttaaatatcgggctgggatgactgaaccctggctctcttcttattgcagctctgtagtgccaagtgcttgaacatttccaccggagcatgtcacagcaaacagaactgaaattactaaaagtgaatccgtatctttcctcccaaaatcaatgcctccttttattttttattttattttattttatttttttatttttttgagacggagtctcactctatcacccaggcttcagtgcagtggcacgatctcggctcacagcgacctccgcctccccggttcaagtgattct

SEQ ID NO: 177482 - DNA, 531 bp, Homo sapiens
tctcagctcactgcagactctacctcctgggttcaagcgactttcctgcctcagccacccaagtagcagggactactaggtgcacatcaccaagcccatgctaattcttgtatttttagtagagatgtgggtgtgtctaccatgttggccaggctgtgctcgaactgcctgtgctcaagtgatgccgcccacctcggcctcccaaagtgctaggatacaggcataagccaccgcaccgtgccagagagtagttttttaccactgtttattctctgattccacctttctgtttaccacaatcataatcagcacatctctgcactttatacagctgtatactaacttacctcgggttcttgttaaagtgtagattcagttcagggggtctggtgtggagcccgagattctgcattcctaataagcccccacaggatgccagcaccgctgattcagtttgcacacattggatggcagggatctatgctgcccaccatagcagccactcaccacatgtggctgctgcaatttaaa

SEQ ID NO: 177483 - DNA, 381 bp, Homo sapiens
ctaagctggtcaaggtacacctgtaaaataacagctttagaacaggagtgagggcagtggtgggtatggttctgcctggggactccagtcagtgatacggttgttcacttccatcgggccagagtccccatgcgctgcctcctccagagctcccagccttctctcagtgcgaacagttgggcatttaaggaaccagattgcctctcgcctttccccaccctgctcagcgtccggccgtgggctccagtactgtgatggtgttggatccaggcctgtgggcggccacagagtgcctgcctcttggctgccctccctcagaggccttctttttctatcacagcctttgatggtgtcttttgtagggaaaaaccccaagcaaag

SEQ ID NO: 177484 - DNA, 236 bp, Homo sapiens
tgcttttagaggcactttaaggcgacgagttatacgttagtttcctgaaatcagtagcctttgtagaaacaagtcatcgttcacttggtggggattcgacagagtttcccttgaggatttcgagttgcaggaagtgttcacgttgttgggacattaatcgctaggatttggttcttcgcaccttcgcagagccgattccttatctggcaaagtgtaaatgcttctttggctgtcgg

SEQ ID NO: 177485 - DNA, 594 bp, Homo sapiens
aagccactgtgcctggccctaatcaggtattaaagaatcttagctccatattggagtacctttgagctccttcctttctctaggatcttgcctgtagttgcctcagttctccaagtcttcagcaaccataaacctctagacctggagtctctgctcatgtcaagagaggatatctcaaaatttagcttgatttctagttccgtctggttatgaaattaggctatagaatggcacaatgaagatgatttgacttgaatggaggcttgcatgcatccttggaatgttcactgtgacctctgttttaatgagtaaagcttgaaacctaagctctatgtaataatatatgtcaatatgtaacctgtagacctttaaaatacaaatggaaacacacttaaaggaaaacaatctctcgaataaagacaataacattagcaaaatgacatcttggaatctgtcaaatctttgaaaatgcttatggtcatctaagtcatttcgagggaactttgtgcattttactgctgagttgctggatttcagtgtgactatcctttttctttttcttttctttttttcttttttttttttttttttttt

SEQ ID NO: 177486 - DNA, 564 bp, Homo sapiens
agccaacgcacccggccaggagtggcttttagaagtggaactagcctcggagaagagaggcgagaagaagtttgtctgacaggcgttaggacccaggaggcaagggtcaggatagataggatagaagggcaagtctcacttgggcgatgtgactttgagagttccactcatggccacaaggtcaaccaacttgttgttgggaccccgaagctgaatggctttcctctctggtgaccctcggctcagcccagaagtacaggagatgtggaacctggttccaggcaaaccaacgcttccaactccaaagagttgggggttgttagagagccctttcccagaaagcctgacactcatgtctttagtctggcagctgcactagtcactttcaactggctgacaggtgcccagtatttagcccccaaattctaaggaaaagtaggacagaatagcaagtgaaagggatccgatggtactccccacttggcgatagctgattgccccatctgggtcaccaaagtgtgtccagaattggttccttccagtgggttcttggtctcgctgact

SEQ ID NO: 177487 - DNA, 150 bp, Homo sapiens
cccgtgtgaacagctggaagaaggagctgtaaaccagagggaccattctctctctactcactgaaagtgcactgcagaagagccagtggggtagagaagacacatgggggagtgatgaatattttatttggagaactgaggatctcttac

SEQ ID NO: 177488 - DNA, 658 bp, Homo sapiens
  misc_feature (658)..(658): n is a, c, g, or t
aggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccgagttcatcccctcgctactagctcctcgacgccccgatgtcctaacgcatggtcactgcgcatggggaaacccatagtcacatgcgcacatcgtcgtcagcccgggcacgtgccgcgagtatcagcgtggcatgcgagcgtgatccatgcgtgtgaggagttgtctgcctggctggatgggtgtcaaatcgactcagccaagagggaccctagcgtcaataccctgtgagcatccccggagggactggttgattattgccggaattcccaaggaggtctccatcagagggcattgcccgttgaaggccatacttgtgtgaggacttttgaccacgttgcctagagcaaacagcgtttcggacgagagaggagtaattggtcagcgccgtgggcccttggtgcgcgctcagtcgctggcgaatgtcaacatttagctttgtttcccctatgggaagtgactcggcgactggggagcccgtgcaacggtggtcttgtgttgccn

SEQ ID NO: 177489 - DNA, 2211 bp, Homo sapiens
aggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtgccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctcctccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccccccacttccccccaaggggccctgcccaccaccaccttcccggtgacccagatgaccacatttaataccaaatggggtggggggaggcgcccctccagtgccaggggcacgtgctgtgagcttcctgggagcccaggttgtgctcactgctctcccgtatcgtgagcaccacctctgctttccctgcgtagatctaggccaggggctgcttgtttttgtggagccgtgtgtgttcttctctgagcagctcctccccagaggaccccagcgcagtcccgggagatggcggaaagaaggcaccagggcacagtggacactcatcccgtgacagcgatggtgaccatgactgtgggagaaagaacaggacccgggatggagtggggctgtctgagtttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgtt

SEQ ID NO: 177490 - DNA, 510 bp, Homo sapiens
attagaagttaatttggcaaagggagttgcctgggcagagggacacaggtgttgagagtggtatattgaggactcacagttacttcattgtggccaagccgcatttaacaaagtaaagatgagattgaacaggggggaaggggcgatgagatcatggaagacactggatactatgtttaggaatagagggtttctcccataggagatgaaggattcaaagttccttcatgacatgctcagactgttctagaagcttgctttcagaggtgagagcagattaccatttgtgctgcctgccagcaagtttcctataagctgcacaaattccctgttccaatgcaaagagctgctttatatattataatcttaagaccagaggcattttgggtagaatagtataggattaaattcatgaaatcttagcctttaagcagcaataagatttagtagcttactttttattcctcaaggaattgattgttaatatatggtatctcggtgataaagata

SEQ ID NO: 177491 - DNA, 310 bp, Homo sapiens
cccgttacccacacctgttatcctgaaagctttcaaataattctgggattaccaggagatctctgacatgtttcttggattatacactctgtctctcagcatagcataatatttaggagaatagattttgagcttgagttctggctctaaacttattgtgtgtgcttatgagcaagggcgtgaaagccataagattcattaaattaatatatgtaaatttgtggaaagtgtgcgacacatagaaagcaccatacatgttttatattgtcatccttagtcacaactgctggtacccattgttcggggcctg

SEQ ID NO: 177492 - DNA, 351 bp, Homo sapiens
acgttgacacttcaggctcccaaagtgctgagattacgggcgtgcgccactgcacccagccatgtctttttaaattcatgaattccttcccagtcacatttttaaaattcctgtttttggtttgcttgtctactaagagtctctcaccatctggattttgctgattgcatccttgacatgccatttaatgtgttattttctcctctatattttctgtaaattggtaattgaatctacaggcttgatcagattcaggcttgcttgtttgcttgcttcctttttttctgtcttttttttttttttagtaggccactgtccaaattaagtaggggtctttaatcaggagacata

SEQ ID NO: 177493 - DNA, 457 bp, Homo sapiens
atgcagggatgagacggtagatttataaaagatatgcagtaaaagagtaacatcggaagatacacaaatccaaacagacaaaaagtggactggtggttaccggggcaggcgaggggaatgggaagtgactgctaatgggtatgagttccttttttagggtgatgaaaatgttctggaattacagtggtgacaggtgcacaactttgtgaatacactaactgaactgaataaaacagtgacttctggccaggcatggtggctcacgcctgtaatcccagcactttgggaggctcaggcaggaggatggcttggggccaggagtttgagaccagcctgagcaacacagccagaccctgtctctattaaataaataaataagccaggtgtgtggctgggcgtggtggctcacgccggtaatcccagcactttgggaggccgaggcgggcggatcatgatg

SEQ ID NO: 177494 - DNA, 408 bp, Homo sapiens
atgcagggatgagacggtagatttataaaagatatgcagtaaaagagtaacatcggaagatacacaaatccaaacagacaaaaagtggactggtggttaccggggcaggcgaggggaatgggaagtgactgctaatgggtatgagttccttttttagggtgatgaaaatgttctggaattacagtggtgacaggtgcacaactttgtgaatacactaactgaactgaataaaacagtgacttctggccaggcatggtggctcacgcctgtaatcccagcactttgggattacaggtgtgagccactgtgcccggccattcaattttttttttttttttttttacgaaaggaatcatgttagaaacaaccttggttgaactgtaggagactcgttaaatcaaccgtggg

SEQ ID NO: 177495 - DNA, 532 bp, Homo sapiens
gtcctacaaacctccaaatgtctaaaatagacaaatcctgagataattcttatttaaaaaggattcaccatagaattattttaaataggctatatcttatgtatttcacctatttatttatagataattatctcctttatagagacaggagagaccaaaaaaaaccaacaacaaaaaaaacctaaaatgcaaagcagtaacactgaatgctgctcaaaaacactgaaggaaaagcttcaaaaaccttaattgtttaatggaaaataaagttcaatttatatttgattttaaaactaattttcaaattcgcaggtaaaattaaagtaactgtttaatgggaaatgatttaaaatgttagattttaaaattagttaattaacagaaaataagttttgatttatacttgatttaaaactaaaatcaagataaactaaaatcaacgattttaaaatatctttctggataatggagatgaacaaaacctttatctttgttttatttgatttatttatttttttgagacagagtcttg

SEQ ID NO: 177496 - DNA, 364 bp, Homo sapiens
atgttcacgtctccaggtttctccccgggggtgtgtggtgccagttcagaatctagcacacagtagacttcctaatccaaattttcctgaattaatgtctaatttttcctaatgtggcttgttttttgctatgaccaattcctgcttatatttcaacgtcaaaccttaaagtcacccttttgtgacttttcttgtttattattttttaaagcagaattaaatttttgtatgtgtgttttatacactctcatgcaagtgcataagctgcttcactagttatcatgtcctctctgtcttttctgctattattaaaggtaggtaatatattttagtctcattgcatcattagtacttagtatactct

SEQ ID NO: 177497 - DNA, 162 bp, Homo sapiens
aattaggctgtgatgcactagtccctcccccacgtgctccccagatttatttcattttattttatatttttttgagacagggtcttgctctgctgcccagcccggagggcagtggtgtgatcatagctcactgcagcctcgaactgctgggctcaagctatg

SEQ ID NO: 177498 - DNA, 597 bp, Homo sapiens
  misc_feature (2)..(2): n is a, c, g, or t
cntgctttcgggaggcgacagtgctacgacagaaatcgggaaaaactagccaaaatgtacaagaccggtctgtttcctgcactccagcctgggctacacagggagactccgcctcaaaaaaaaaagaaaagaaaatggattcaaagacttaaatctaagacctaaactactagacgaaattggggaaatgctgtaggacatttgtctgagtggtatgacactgtataatacctcaaaagcacagtcagccaaagcaaaaatggacaaacaggatttcatcaagttaaaaagctttacagcaaaggaaacagtcaacagagtgaagagacaaccaacagaataggagaaaatatttgcaaactatccattcatcaaggttttaataaccagaatgtataaaggcctcaactcaataacaaaaaaccaaataacccaatttaaaaatgggcaagtgatctgaatagacattgctcaaaaaaagacatacaaatggccagcagatatatgaaaaaatgctcaacatcactaatcataatcgaaatatcaaaaccacaatgaaatattatctcccagttaaaatggctattataaaaaaga

SEQ ID NO: 177499 - DNA, 471 bp, Homo sapiens
tctgtgcccagataactcaatttactcccacataacctgtggagtccttaatagctgcaggattgtgtttttctttgtagtaatggatgccattattttggggaatgaaagaaaacactcacactagtaagaagggaaaggaataaaggactgtagaaccttgggaaggaggacaatggccatgcagatgagcgcatcatctgtgcttggacatccccaggagagggagatgactacttcctgtgggagctcattcctcttggacagcctttttaaatttttatttgcaaatacaaattttcttaagttgatacaaagtttttcttcctgtcactcctacctattgtttctaaatttgctctgtgaaaccacaatgaaaggaaattctcccccttccatgggacagaccttcatggggtcttacagattgccctccagtgatctcatcactttattccccagcactctgag

SEQ ID NO: 177500 - DNA, 554 bp, Homo sapiens
gtttgcacaatcttcagttctgcagtaatcttttcttttttttcttttcttttctttctttctttctttttctttcttcctctttttcttccttcctttctttctttccttctttctttctctctctccttttctttctttcttctttctctctcctctctttcctctttcttttttttctctctctttctcttcttttgtttttcttttgagatggaatttcactcttgtggcccaggctggaaatgaaggtgtgtaatttttcggcccagtgctgccctgtcaaaatcaccatggttagggagaaggacagaacggatattggatggatgctagcaggttctgcccattcatcatcttttataaactgtgggcctttctaatgttagttacaatgaaccggtcacaacagccccatgctgttgtgaagcacttcttagttctttattcccaggcaatacaaatccacagtgaaaaaaaaaatttaaattagaaaatacaccttagaaagaaagatttaaaaatacctataatccattacgcagagagtacca

SEQ ID NO: 177501 - DNA, 517 bp, Homo sapiens
gagaaggacatgagttttggggagctaggggcagaatggtatggtttgggtgtggttcatccctgcaaaaactcaaggtgaaatttgatccccaatgtagcagtgttgggaggtggggcttagtgggagatgtttgggtcatgggagtagatccctcatgaacagattaatgccctcccaaagggttgagttctcactctcataggaatagattatttcttgtgagaacgggttgttaaagagcctggtttctctcttgcttcctcttttgccatgtgatctctttgcacatggcccctccccttccacttcccaccataagttgaagcagtatgatgccctcattagatgcagctgcccaatcctggattttccagccaccagaattgtgagcgaaacaaacttttctttataaattacccagtctcaggtattctgttctagcaacacaaactggactgagacactcccatagttttgttttttgagcaatttccttactttctggttctacaag

SEQ ID NO: 177502 - DNA, 598 bp, Homo sapiens
acgttgacacttcagcattctcactatagttctataactaggaatgattataactcttactgggtcattttgcaaatgaagaatttggaaattgaagttaattacttaaactcacacatgtactaagtggggcagaattgggttgttaaccaggttccctgactctctgcttcctaatcataaaacatatgagaatgaactatcttactgccctttatttgctcagtttttaaagaaataggaacctggaggattttaagtgcctagcatctatttagagagtaacaactactgtttaataacatttcaccccagaatgtgcctgtggctcacaatctagagaggaaaagatggcccatgttggggaggacacacccataatcaacacaaaagaaaaacctctcctgcttgttgccaaggcagccaagcattattgttcagattattcattagccaaaggggtaagggaagagaatgaaacccagtctacatttggctcaccaagataagtgtcctggcaagggacacatatactcacagaaaagggcactcttttctaatttacacaagcaccatagagactagaagtggtgcatgt

SEQ ID NO: 177503 - DNA, 763 bp, Homo sapiens
  misc_feature (489)..(489): n is a, c, g, or t
caatcccattcctatgctaggcttaaccaccattattagtataattattcatactttacagagccaatcacatagttacatatgtattgtcatctcttctcattaacctttttttaatccatttccaataatcacctctcctaggaagataattttttaatgatagtagaggaatagacgaaagagatctaaatgaaagaaaagcaaaaatacagaaaataaggaattacaccaagtataggatatttcataaaattctaattttataatcctataggattgtgagagtaaagcaaatgccagcctatatactataaattttcccacaaaatactattttctccaaattaagagagagagagataaaagtaattttaatatgactagatattgggtatgttttggtttcaaatgtaccatgaaccaaaaaaaaagtaacaggaattctcataatggctttcttcatagtcctatacttacaatttttangtattaaatagtctgtttgctagaaagtattaatagaactgtgagatcttgtattttatatccataatttccccttcatacattcagccttttgtttttcacagatcatagagataacattgtactcattagtagaaataaaccaatttgttctcacacacaaagttgggtaccttcaaatcaacaacttcaagaatcatgttcacttaaatctttgaaactttacagaaaattccaactgggcatggtggcctatgcctggattccattgggg

SEQ ID NO: 177504 - DNA, 671 bp, Homo sapiens
  misc_feature (489)..(489): n is a, c, g, or t
caatcccattcctatgctaggcttaaccaccattattagtataattattcatactttacagagccaatcacatagttacatatgtattgtcatctcttctcattaacctttttttaatccatttccaataatcacctctcctaggaagataattttttaatgatagtagaggaatagacgaaagagatctaaatgaaagaaaagcaaaaatacagaaaataaggaattacaccaagtataggatatttcataaaattctaattttataatcctataggattgtgagagtaaagcaaatgccagcctatatactataaattttcccacaaaatactattttctccaaattaagagagagagagataaaagtaattttaatatgactagatattgggtatgttttggtttcaaatgtaccatgaaccaaaaaaaaagtaacaggaattctcataatggctttcttcatagtcctatacttacaatttttangtaaaatattaaagtattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactatgccgaaa

SEQ ID NO: 177505 - DNA, 502 bp, Homo sapiens
gcagtggtgcgatcttgactcactacaacctccgcctcccagttcaagcaattcccctgcctcagcctcctgagtagctgggactacaggtgcacaccgccatgcccggctaatctttccatttttagtagagatggggtttcaccatgttgcccaagctggtcttgaactcctgagctcaggcaatccacccaccttagcctcccaaagtgctaggattacaggtgtgagccactgtgcctggccaggatttaagatttaactcactcgtggatactctgattggcttctctctgcctgagtgttactcaagagtgacttgaaagtccggaggaattagggcaggacagtgaggaactagcaaaagaggagaaagcactgatttagatggtagctgtgagttactgtgtccagatattgtcagtgcctaacttggaaatgaattaagtatcttggttttagattttctaaatctaaagggagttggactcttctgagtgga

SEQ ID NO: 177506 - DNA, 261 bp, Homo sapiens
aataacctaaccatatacctcaaggaactagaaaaagagtaaactacaccaaagctagcagaagaaagaaaataataaaaattagagtgaaaagagagaacagaaaaacaatggagaaaaattacaaaaccagaagctgattctttgaaaaagtcaacaaaactctagctagataggttaacaaaaaaataaataaataaaagagagacagagagaaagaacaccaaattactaaagtcagatatgaaagtggtgacacgg

SEQ ID NO: 177507 - DNA, 286 bp, Homo sapiens
  misc_feature (215)..(215): n is a, c, g, or t
cctatcccagcttctatcggtgaaaaggcaggtgcaaagcaaatcctatcccagcttttatcggtgaaaaggcaggtgcaaagcaaatcctatcccagcttctatcggtgaaaaggcaggtgcaaagcaaatcctatcccagcttctacaggtgaaaaggcaggtgcaaagcaaatcctaacccagcttctacatgggtggttctcagtggtttncttgtcttaatcgtttcctgcatctcccagcagtcctccagtgagcaggcgtgactttcacaaccagagag

SEQ ID NO: 177508 - DNA, 543 bp, Homo sapiens
atgttgccacagcttggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaaatgctgcctgactgaatcctcagggcaccccagcaggatggatgtggtgtcccccccaactttacagatggggaaactgaggcttgagagctaaagcagcccgcccagcccccagagctgaggaggccgactctggcaggagtcactgtcggtgcatgggcatttcttcctgttacagcctgctgccccttccaggccaggaggccttctgtgcggggtaggaaaatgggaacacccaggccgattttccaatcagcaaagctctgctccctaaggctgatgggcttctta

SEQ ID NO: 177509 - DNA, 292 bp, Homo sapiens
acttaacactttctaaacaacacataaagcagatacccaagattgcatactatttatagttctatttctggctcacattgtctttctaactactcacactttctaactggctcacactgtctttctaactacaaccttgactcaccttcatggtagagaagtcatggttgacttttacgtttggctgccttcccaattcaaccccaattccctgtcacctcctaccttagtttccttccaccctagcacatccctttttgtcatgattagctattgggtatggtataatttt

SEQ ID NO: 177510 - DNA, 323 bp, Homo sapiens
gagcctgtaagagctccccgctctcatttgcgccctagtgccaggtggagtcagtgtgagcctgtaagagctccccgctctcatttgcaccctagtgccaggtggggtcagtgtgagcctgtaagagctccccgctctcatttgcgccctagtgccaggtggggtcactgtgagcctgtaagagctccccgctctcatttgcgccctagtgccaggtgcagtcagtgtgagtctgtaagagctcccccctctcatctgcaccccaggaccacaagagctgttctctcaggtggacaatagagagatgggatcagaagtcattg

SEQ ID NO: 177511 - DNA, 415 bp, Homo sapiens
tgttttttttcctcctgtgactttctcctttaaacttctttcatcgcaccttcatttttctccccagtgttgcacatgctaactttagtctatctaaccaattgagctttcctttcaagaacactctcatatttctaatatgttcctaatatattactaatatgttcctatatcatccaggtgatgagctccaccaatccctcatcctctcactggaggaaaacgcaacagtccctacccaaaccaggtctgtgcctgaaggacagcagtcccaaatttctacttgatttagatgaaaaacatgaaatcagaccttctgtgtcctgtggcactgaggcattgtttcatttagaaaataaaagtgtctacaacttctaagaattcacaaaaaaaaaccactgcatgggcccttcga

SEQ ID NO: 177512 - DNA, 220 bp, Homo sapiens
taaatatctatgcatttatacatactgtataaaaatacagcatatggcaggttttttggttggatttagtttagataaaacatggccatactattcttaacatgagttctcacctcgtggacccctttccatccaggactatatatccaaagcattgttttttttgttgttgtttgggtttttgttactgttgttgttttttgaggttaggtcttgctct

SEQ ID NO: 177513 - DNA, 674 bp, Homo sapiens
tcatgtcgggctttgtcactttcaaaagcattacattataagctatgtggccaaaacacaatcaataaacaaacacacgcagacagatacaactaaatacacacaaacatacatgccacaacagagagggtctttgattcttaggatcccccttttcttttccatccattaattcctaactacactgttcttctctaaccatgtaactatttctcaatatccatttgtcacatgtaaaatattctcaagaccactcctagccttgtatacctgagacctgtctcccataccaacaccatcacttaattaagaaacaatggcactaaagctttgcttacaaatctgtgaaacaaaggtcatcccacctgcctaccttcccacttcaccttactaataggaggtttaaaggagatatgtgcttaagtacaccaaagaaccagaggtaccaacagggttaagatacgccttgaatccaagaaaatcccctgaagcagcatgtcaatactgagtaacacaaccattccctaggctatcacctttttttttttttttttttttttttttgagacagagtgtcgctttgtcacccaggctggagtgcaatggcacgatcttggctcactgcaacctccgcctcccaggttcaaatgattctcctgcctcagcctcccatg

SEQ ID NO: 177514 - DNA, 791 bp, Homo sapiens
ttgactttgtttcctcacacaacactttgaaaagacatgagtttgacaccccaaacaggataatatttaccattttaatggtaatatccagcagaaccttagacaagaaacagtagaatctaacttttaagaaaactttattaaaatgtaattcacacactataaaattcatccatttaaagggtacaatttagtgggttgctttttttctgtattttcacagaattgtacaaccatccccaatatctaagtttacagcatttttatcaccccagcgagaaacctggtacccattagcagctgctccgcatcttctccctcttgtttgtgcccggcttctttcactgagcgtagttttcaagggtcatccatgttgtagcattggtcagtaagtacttcattcatttttatagctgaataatattgcagtgtatcagtattttgcattttatttatccatttatcaattgatgggaactgtctgtaactaggtatttggtaattccaaacatcttattttccaacaggcagagtaagatttgttacatgtaataaactccaagggtctattaactttttcattataacaaattgtgtaaatattgctttcagttagttacccacagtccttttgcagtagagatagttgtcttggttttaattggattcatgatctacaactttatgttctaatctcatgtcatttttattatttttagtaaaagtaatttgtttgactaaattaactggtaaacagttctgagctttttcaattgtgtctacaaatttta

SEQ ID NO: 177515 - DNA, 599 bp, Homo sapiens
gactgggaccagggaagaagggcggcacctgtaccccgtcctccctccccgatactgcctcccgggttcgtgattctcatgcctcagcctcccgagtagctgagactacaggcatgtgccaccacgcccagttaatttttgtatttttagtagatacagggtttcaccacgttggccaggctggccttgaactcctgacctcaagtggatctgcctgcctcagccttccgaagtgctgggattacaggcgtgagccaccgtgagtggcctgtttctttgttttaagtaacagcccttgcagaatgaatgataaagttccagttagatcatcagacccaacgttccattctcaaatgtcttaagagttttgaggtcaatacacatatattttttgctccagcagtagggagtcatgtgacaaatctgaataatggagttaggtggacaaaagcctaaggtgaatttcgtaaggttatcaaaaacgttcaggatttgtagtcatttattttcagtgactgtcagcgaaaagcttagtctggcttagttttgacttcgtcttgaaataaatgttccacggccaccttctctcacttaattca

SEQ ID NO: 177516 - DNA, 182 bp, Homo sapiens
ataactttctaggtaataatgtctaaactttaggcattgcttgtttattaactaatgacacaaaaagcctccacgctttcttaaattaatgatgcaatatgaaatttggttgggacaaatgactaagctaatttaacttcttcataattgtttcttttgcctttctgtgtgctttcaggact

SEQ ID NO: 177517 - DNA, 393 bp, Homo sapiens
atagtggtgtgcacctgtagtcccagctacttgggaggctgaggtgggagaattgcttgaacccaggaggcggaggctgcagtgagctgagatcatgccactataatccagactgggtgacagagtgagactctgtccccccaaaaaaaagaaaaaaaatgaggacaaaaataaaaactatttccagattccaacagcctatcccctccacctctgccacctgagtagagcctgggttgctgcggtcagctcctaactggtctcctcttccctccctccacatggcagccagcaggatccttttaaaacagacaaggcagcagttttccccagctttgggtgatggccactacccaacttcagcttccattctgtgaagggcaaggccacgta

SEQ ID NO: 177518 - DNA, 304 bp, Homo sapiens
taaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaa

SEQ ID NO: 177519 - DNA, 150 bp, Homo sapiens
ccacattaaggtaaattactaccactagggcttcaaatctggtaagtgtttaaaaaaagaaatgcagtaagatatccagtgtcattcaatattattttatttggcataagttttttgatactaaattagtaacaagcaatcattgtccta

SEQ ID NO: 177520 - DNA, 446 bp, Homo sapiens
agaccaacattagacaccatctctctccacaaaaaacattctccaagcaaaacatcctgatctctaaatacactacggcaggaatgaaactgttgatcagagttgcagtattgattctttttgtggccatggatacacatatgggaactttgaacacttttccatgctagggaacatcacatttgtccattacattgatgatatcatactgcttggacatggagaacatgaaacaggagctacttaataccctttgaaaaagaggaagtattctagagaatataaaaagacttcttgagtactaagaggtcgtgaagacagctttggaaatgttataagcgtcaagattcgctcaagatacacctgcttctcttgcaaaagcattattcaaaagagccaagatatggaagcaactgaagtgctcatcaacaggtgagtggattttt

SEQ ID NO: 177521 - DNA, 713 bp, Homo sapiens
ggccaggcagaagcagcatgggtttccactcacacgatttatctactgctcgtgaaatctctggatttaactgtgatgaaagaccggaggctgaaggagaacttcaatatcatatattttaaaggttgactcacagtttggaacaagaattaaagaaccacgaacttcaagtctggatgaagtgcttcatgcctgtaatccaagcactttgagaggctgaggcgggcagatggcttgagcccaggagtttgagaccagcctggaaaacacagagaaaccccgtctcaatataagaagaagaagaaaaagaaaaaaaaaaaatcaaaaacgaaaacaacacaaattttagagtgatgtaaaattctcaaacaatgagatagataaaaagtacgcagccaaaaagtgcaggaagaagtgttatggagatggagcaggcccttcgtaaaaacacgatgtgggttttctggatttggaggcctcacaaaacctggatcagactcgcccactgccctgtgtctgccctcccgaccccctctcctgcccagcagggatgtgggtggcagtggtgctgtgtggagggtggcgggaggaccgggaagactgcgaccagtgagccgggaggccttgggaacagcctctctctgactcatccctgtgcctgccgggtgtgacagaggctcctagagtcctgcctcagatggccgccttcagag

SEQ ID NO: 177522 - DNA, 571 bp, Homo sapiens
atgggcggtgaagaggatattgaaaggccagttcccagaactttatctgagaggagaacaaggaaactggtgtctgctgcatgtttttcaagatgtgctggcgtcaccaccacctgcacactccccctccccaggcttttcccacggtaggcacacagcagatgtgccatccgtggaggctgttagggttatgacatgcattttatccccaacaacccaatgacctctgtagtgatgtctctatcttacaggtgaaggaaatcaggaaaacagatggagggctgacttgggggtgggtatggagcactgctgccagcaactaagatgatggaagtgggtgaccagtgtgactctgtgtgacaggaaatgatgccgaatggacacagccagctagggtggtagttggaataaagttagataacacaggcttactgtgtgcaggtggcaggtactcactcagcaaagccacctgagtcgtcagcactgtgctactattttgatttttttaatttgagagatggggcctcactgtgccaccccagctggggtgcagtggctcttcaccggccat

SEQ ID NO: 177523 - DNA, 215 bp, Homo sapiens
ctattttttaatctaaaagcctcctcctttctatctgccaatttttaaaattttcttcccatttaaactaccaagaagcctaccaaaacttaaacagttcagcaaatgttgtctttctcccccaggacatccgttttaaccaaccaatctgtttaagaggtatatcaaaaaaagtaaacaggtaaacaaaacgttaaagaaacataatgtatctt

SEQ ID NO: 177524 - DNA, 514 bp, Homo sapiens
taccccccggcccccaccatcttcttactcattcaggtcatcgtgtcctctgatacccagtaatttccatcattttctacatgcatttctgttggtcttctgagaactgtgattttccaaagcagaaagggcacatcgtctttccggagcctggaaggtgcaggcactgatgcgttgggggagatcacagtgtgacaaggatggggtgggagtgtgtcacccccctttgtaccgaccctcagcagtggggagtgagcagaggagatagaacctgggaggaagagagatttccaattacttccttcccggtcccttctccactggagcctgttattcctctgctgctggggcctctgaatgttctctcactgagccaggaaagagcttagtgaataaagaacgaggtgtcctagcagtgcagggaagatgtccaggacagtgagtgtgaacgtggggtcctggagaatgtgcacgccagccctgccgcctggtgggctctgcaatcagcccccca

SEQ ID NO: 177525 - DNA, 524 bp, Homo sapiens
gacaaagtccctgctgtcatggagctggcatttcagtgctttgggagtgggtgggtgacaggcagtgagcaaataaacacaggatggggcaggtgtgatcagtacaaaaagaaacaaagcagggaaaggacacagagggtagtgggggtgggagcttgacattattttaggaaagtcgtctttgataaagtgacctgaaataaatgaggggaggagccatgtggctttctgtgcaaagagtcttccaggaagaagggacgttaagtgcacgagtcctaaagcagcctcttgcttggtgtgagccaggagaggaggagcgggagatgggtcagaagtggcctgtgtccgctgctgggtgcccgtttgtgccaggccttcctggtgcacttgcgcactgggccctgtctcctggagggcttctcatggcgtgttctttcacaccctaatacagcaggaagctctgccactgaaaggtattgtgagccaagaatttgaaggcccttagaagtcctgcagtagagcaa

SEQ ID NO: 177526 - DNA, 390 bp, Homo sapiens
ccttccgccggcaggtcggcggggccagccccgaagtgctccctgggccccgtttctcccacagcttcccccgcatcggagaccacgtggtgagcgtgcagagcaaaaaccacgtgagctgggcccaggcgcaggtgcgcatcgtggtgctggaggccgtgagcgggctgcaggtgcccaactgctgtgagcctggcatcgccatgggcactgagaggaacttcacagcccgcgtgcagcgcggctctcgggtcgcctacgcctggtatttctcgctgcagaaggtccggggcgactctctgttcatcctgtcgggccgcgacgtcacctacacgccgtggccgcggggctgttggagatccaggtgcgtgccttcaacgccctgggcag

SEQ ID NO: 177527 - DNA, 423 bp, Homo sapiens
aggtgtagggcctaattgtaatacatgtaaatgttaattctccaccccaaagcacacatggttatatgttacctgcatgtttgttcagtacacatgcctcaggaccaccttcatgagtatttgaagctcttcgtataacctgttgactatgtatgtttggccaacctgttcaactaaaatttctgtctaattcctctctccctcaaagtgcctatttctggtctttgctggaagctacacttcccagctggtaggatggccacttggcaggctgtaaacttttacaagaaataaagtctccttttcgaaatgtatagatcttgtgatttttcagttaaccctcactgcatatttgttcttgattagatgttgagaaaaatattttggatatatttggttaattaaaatacattattaaaatta

SEQ ID NO: 177528 - DNA, 437 bp, Homo sapiens
tgccccatctccccacctagagcttcctgcagagccgggcagagccgggtgccttctctgctggttgcctgggcgcctgtgccccttccctagatctgcagtagggaactgcttcccggtggcctaagggcttggacgctggccatgaccatggacacccccaccaccctgagagggtgccataccccagcccgaggctggagggccagctgtacggcagggccatggaagggaggaccaggcagcctcctgtggctcctgccagggaaaccctctctgctcgctgctgctcagcctttcccagccctgcccctctcgtcttgcttctcacatttcagcctctgagttactggcaccactgtctgttgctgctgttgctgctgctgctgctgaagccggcaccagccagacattaacccctgatgcgctggcggccg

SEQ ID NO: 177529 - DNA, 328 bp, Homo sapiens
tgtggtaggtaggtatgtacttaggtatgtatgtatgtacgtatatatatgtatgtatgaatgaatgagatgggggtctcactattttgcccaggctgtagtgcagtggctgttcacaggtgtgatcccagggctgatcagcacaggagttttgacctgctccacttctactctgtgccagttcaccccttgttaagcaacgtggtagtcccagaggttaacatattgatgctgaacttagtacagacaccaggtaggcatggtgcactacagcccagaactcctgggctcaagcaatccccctgcttcagtcccctccttagtccct

SEQ ID NO: 177530 - DNA, 537 bp, Homo sapiens
aaatgttccgcgcgattaccgattacggggtaagtggccgtcgttatacatgcaagaattgcagattgcaggcaggaaacaagaccggtcttgtctcctagacttaatgtttctggtccttttttcttatctgtaaccttgtcctaagtcctcttaacctattccctttttcccttttagcccttatctctctgctaagctccaagtaacccattaatctacttgacatttctacttgactatctaatggcatctcattaagtcctgtggattatttctccaaaatacatcctgaatctgatccctcttctccacctctgtagctattacctttatccaggccactatcatttcttgcatagcccattgcaatagcctcctaattggtctccttgcttccaccatttggctctctaaaattcgttctctcagaagccaaagtaatcttttaaaacttaaaaccggatttctgctgaaatccttctaatggtttcctattgtacctcaattaaaatccaaactctctataatgatctg

SEQ ID NO: 177531 - DNA, 356 bp, Homo sapiens
gctgactctactgaccctaaaagctgttatctctcctatttgctcttctgcccttcctcatccttcctgttttcccacactaacttctctctgggattatcgatgagaaaagattgacaaatatgtattactcatagtaaaataatttgggcataactcagcacggaatatattgttagactttaaaaggtgagtgtctgagtaataaggtcagttattagcaggtatttgtggagtcccaggatggttttgttatattttattgttgttaatggcaggtactagagtgtgtgtgtaaactaatggcagtgttccaatagggacgcattctctgaaggagcaaagcccagagtaga

SEQ ID NO: 177532 - DNA, 220 bp, Homo sapiens
tatgcttgccaccacagggactttgctaagttcttcactatcaggtagaaactaatatcaattccaatgaagaaactgaagttcgaacagaatggtccagtaactggcccaaagtcaccaaaccagtaagttgcagagcggggacaagagctaagaatcattaggctccacagctcattgcagtttctctctccaaggtgcaggctaattctcttgtcct

SEQ ID NO: 177533 - DNA, 278 bp, Homo sapiens
tggtgttacttcaagcaccttccaggccaaaggcaaaaatgttcaaagcaagctctgtgatttctaaacaaaatttcagctctgctaccagtagcatagaatctataagctttgaatctcctttcagccggcaacacagaattcttccactttaaaacttcaccagtgattgctgcttctggccaaaatgaagtaatccagacagttattttccaactgaaacattcaaacaaacaaaaagacaaaatatataaaacaataagacactaggctcaggc

SEQ ID NO: 177534 - DNA, 494 bp, Homo sapiens
aagccattctaagtggtttgaacctttgggtaattgagagcccttgaaggattctaagcagggaaatattctatcatagttagattttagaaatacggtgacaattgcagcgttatgggatggtttagagagcggttagattgatggaaaaccacgccaagcaggtaagacaaagttgctaaggacctgatctaggaagatggtggattcagggcagtttcaaataataaaacaaacagggcttgctaagacattggcaataagcaggaagtgggggataggggttctcggatgactcaggtttttgacttttgtaatttgtcattggatcaaaagtgatgcatgaaaatatataggaaataaaggatgaggggtagaaggaaaagtaaaggagaataataaagaatagaaagggagtttaaaaatgagttttaagtatgtatttttgacatcagttgttgatatctaataagacattaaaagtcactctaaag

SEQ ID NO: 177535 - DNA, 207 bp, Homo sapiens
cctgccctgagcctggtgctccttggaactacgcatcgtgtaaacacagcctgggcgctggcctttgtcaaagcaggcagggggccagtcctggggaggtgcacgcctcaaattcagagcagggtcagcacccccagaccacagcccatagccctactgtccacgcctccctggccatggtgggccgtggctccagcagtctcccac

SEQ ID NO: 177536 - DNA, 521 bp, Homo sapiens
attctgcattcttatttaattataaacttctcaaagacgaaatttatctcccaaaagccttgagcaaatctgaaactctcaaaatattattagctgactcaggttgacttttgaattcaatgttctttcactgccaagtccacttgctgctgaagggaaatcttaatttcaggcaaatggcaaattgctttactgtttacatttctttaaaagatttgctttgcttacatattttatgaataaaaattgctaatactgcacaataatttgaagaataattcttaaggatacaatcaacggaacttataattccaagggacctagggttgtttgggggttttgtttaacaaaaggttaagggactggccgatatgaatttggggtatggagggagagaaatgcctgtgtttgtgttcctgctctttgtaaggcaacattaccatgcctcttttctggagacatcatagaatcctgtgatccacagaagacccaagttccaggcgatacaactaggaagtcct

SEQ ID NO: 177537 - DNA, 286 bp, Homo sapiens
agtggtgctcagccttggaacctgtttcttcgttcttccttccctgtgatccctgcgtggttcctggaggtttatttggctttcgggctggcatctactgtgcttgtgagcagagcgcatgcatttcccactctttccctagagctggtgaccggaggctccggcctgtgtaactttgaaagcctggaattcatgtgacccctgctgacctaatcaagactccgaaagcacagccccatgtgctgggactctcctgaggagttattaaaaactcgcattagttctt

SEQ ID NO: 177538 - DNA, 303 bp, Homo sapiens
tgtaatacaggctgaatatccctcatatgaaaagcttgggatcacaactgttttggattttgaaatatttgcattatacttgacacaggttgagcatcccaaatctgaaaatccgaaatccaaaatgctccaacaagcatttccgttgagtcatgttgatgctcagaaagtttcaaattttatagcagttcattttttcttcttcgagaccaagtctcactctgttgcccgagctggagtacagaggctcggctcaccgcaaccaccacctcccgggttcaagcgattctccttcctcagcct

SEQ ID NO: 177539 - DNA, 299 bp, Homo sapiens
ttccattgaaggattttttacagtaaagtgacatgactctgtttttgttttagaaagattaggttagtggcagtgtagaaaataaatttaagaagcattgatccatttgttcatctaacaaatattaaatattatgaatgttcttttccctcagggagcttaattttttgagggagacaaatgacaaccatttatataataagtaatttatttatacttgggaggattgctatgaatgaggagtacagcattgaataagaatgtataatgaggaggccaggcgcagtgtctcatgcctg

SEQ ID NO: 177540 - DNA, 731 bp, Homo sapiens
tgtgtgacccttggtgcctggcaaggcgggggggtagggagcagccctcgcacagccagctagactgttttgctctggggcctgaggattgcggggccagggaagcaaccaggcccagtctggggccctgtgaagcgatctgcactgcccagggtcagggggatgggggggtcggcctcacctcggctaacctcccagcggaacaaaggggcctttctccacgcccgcccgggagggtgtgcccgcccggctgctgccgccactgcagagggcgctgattttttttttcttcctgacttttctccatttctgtctctggttcctgatctctgacttttattctccattttttcactttttatggggatggggtagagatcttccttttcaagtgtttaccaattgcagagacaagtctgcactgccaaaaggtgagggcatcctgggtgcgttaggaatactccgggagtcacgtggccttagacccccccctcccccccaaatcgagggcagctccgttctgaaagaagcaggcaggattcagagcggcagccacacagggtgggaccgggctcactggataacccccagtcaagctatgcacctggcaggtcccccgccttctattcgcccacccatttcgcagtcccctttccatccggcccatgcaccgcaagctgttcctaatcaatgcgaacgggaaactcggccctcatatcacgggatgtgtt

SEQ ID NO: 177541 - DNA, 450 bp, Homo sapiens
tagagtaaatttttgtagatagtgtgaggtagagttcgaactttgtttttttggatgtgaaaatccagttgtctcagcttcatctgttgaagatgctgttattttctcatttaatttggcagtctcatcaaaaatcaattggtcaaagatgtttgggtttatttgttggatctctattgtatcccattggtctatttgtctatattacagtgttttgattaccgtagctttgtaagtcttgaaatctggaattgtgagtccactaactttgttctttttcaagattgttttgtctagtgaaagcccctggcaatttcatattcatttgaagtttagatttttcattttggcaataaatctgttggaatttttacagagattgtattgaacctgtacattgctttgggtggtattaacatggcaacaatattaaaacctccaatctgtgaa

SEQ ID NO: 177542 - DNA, 163 bp, Homo sapiens
acaaaaataaccagaatttgatcagaaatattcggtaactttaaggagctgatgctcacatatctacaataataagatagaaaatattcaggcgtcttaaaatacgagttatctgaaatcgagagggaagagattaaagtgatgatgaaagggacagtctgga

SEQ ID NO: 177543 - DNA, 581 bp, Homo sapiens
cacttgtcaaattaagtagaaaacatcaaaacccaggcaccctgaggttaagatgccctttagtggtgggagttagtgcatggaaggagcccaggaagcatgcagctaacagcctgctaattagtagtatcaagctaccaaatgggctcatgggtagctttccttaaaaattgtaaaaaaatgggccgggcatggtggctcacgcctgtaatcccagcactttgggaggccaaggcgggtggatcacgaggtccagagtttgagaccagcctgaccaacatggtgaaaccgtgtctctactaaaaatacaaaaattagccaggcatgctggcgcacacctgtaatcccagctactcaggaagctgacgcaagagaatcgcttgaacccagaggcagaggttgcaatgagctgagattgcaccattgcactccggcctgagtgacagagcgggacttcatctcaaaaaaaaaaattgtacaaaatttcctttattaaaaattgtagctccctctctctctccctctccccctccccctccctctccacggtctccctctgatgccaccaaagttatgaaggc

SEQ ID NO: 177544 - DNA, 119 bp, Homo sapiens
ggtgtgcacttgaaaagaatgtggattctgctgcttttggaaggaatattctgtgtatatctgtgaggtccaatttggtccatagtgctgtttgattctgttgtttcattattgatttt

SEQ ID NO: 177545 - DNA, 151 bp, Homo sapiens
cagcactttaagatgccatgtcaatcaaccaggattggcacacgaagcgagacgcagttagatgatcatagagatcttattgctcaaacgcccaatggttccatcggcctaatggaaacctcagctcctatatgcttcccttctgagagtg

SEQ ID NO: 177546 - DNA, 224 bp, Homo sapiens
gcctaggctggtctaaaactcctggactcaagcggtcctcccagcttgtcctccaaaagtgctgtgattacaggcatgaaccaccgcacccagctccctttttttttctcagttgccaaaacaagagcatttatttgtctttcatgttacatgcccattggggatagaatgtatattctgctgatgttggatagagtctttatatatctgttaggtctaattat

SEQ ID NO: 177547 - DNA, 362 bp, Homo sapiens
gaaaggccacggattacatataagggttcctgttattctcttgtcacttagatgtgattttatttcttgggaacatcctactgccttttcttcaaaagattctcctcttctgctggccttgaactaagtccagtctacctgctggcctgaggtggcgggggtgtgtgtgtcagccccctcagttgtgttcctggggcaggcagaactcaccagcacccggtgctgattttatcccttccttctctgaaaactcggagagtatgtgccagctgctgtctgcgattgatgcacatttattttgtcacttgggctcagaacgtcctcaccagtgagcagcttctgattaatgccgccaccccatc

SEQ ID NO: 177548 - DNA, 422 bp, Homo sapiens
gtgacagccagtgcaggcaggctccagctcaacacgaatgactccatttaagtctaaggatgcattgctataaaatactggttctcaaattgttgtaagttatgacagggagcaaagtctcaggaatcagaagacctaaattccagtcctaggcctgcgagcctctaccattgtgaccttaggcaaataattatcttgaacttcatcttcttgtctacaaactaagatgtttattcaagatgatttctgaaggtctttgccttcagaatttttttctgttttagtattcatttttttctgttttaatattcatttaaattaaatgatgccaatttgccttttgttctttttttaattacaaaagttctacatgaatattcttgtgaaaagttcacaccttcacattgtgcttttcctcaaaa

SEQ ID NO: 177549 - DNA, 467 bp, Homo sapiens
aacactggtcatagctgttcctgaggtaacacccttatcccacagtgttgatatcataaatacccattcagaacccatgtacatgcatatatcaggttcataccctacaagtttcacaggggaatacttttttgcgtagcgatcttcgtgactcccgtcccgtactctcattctgtttatgactggatgtggtgggaacaccacagggatttcctgaagtgtagctgtagcctccccacacccagtggctgcatgcagagcaccttgccccctcacactcatccacaggtctatttacataattacataccaaccagttacttatttaaagtataaatctcggtggtttttaatatattcacagagttgtgcaacatcaccatcaccaattttgttgttgttgttgttgtttttgtgacggagtctcgctgtgtcacccaggttagagtacagtcacgcaatctcag

SEQ ID NO: 177550 - DNA, 384 bp, Homo sapiens
caggtctgacacctgtgaagggacagaggaagcaaagaagatgagattggcattgtggttcttagacacattttgtaggctgaatggaaattcccaagccaaagttgccagtgaacagactcttgagtccttagtaatgagcctgcactagtacgtcctctttgttccttcttgctggttaaagaagggaaggaaacaagtcctggtttagacccggggaatgctactccccctctgaccttaatccttcctatagtctctctcaataggctagaacttcttaacctggttccataaactgtcttgtgaaatttttttgcttgttcatttttctgtggataaggttgagtccgattcctacagggtctctcaccctaggtttca

SEQ ID NO: 177551 - DNA, 361 bp, Homo sapiens
gtctggatctcctgaccttgtgatctgtctgccttggcctcccaaagtgctgggattctgcggctgaccttaaaataaactttcctttaaagatgctccatgaagacctggcaggcagattgttttatgccacagagggacgggtgcactggctggctgccctggtggactgtctctggcagtggaggggatgataggggttttgtctgcaggggctggctgcaggtggctagggtcacggaggagcggggcttgctgaggaaagcagctgtggttcagccgtcactccatggcctaatggcctttgccctccaagtgtgtgttgggccgacctgttcggtgccgggtgctgggtgctggg

SEQ ID NO: 177552 - DNA, 566 bp, Homo sapiens
tctctagttacaggtgctggccaactgactcttacttaaaagggaatctttaaacttctttgcctttcagcccttgatccactataaatcaaaacaaggtggtcaaactgagttacctgaaaagagataatcttatcataaaattaaagtttaaatttgtcatgaacaggccttaatattgtataaggtgtaagaaagggatccagtttcagctttctgcatatggcaacccaaatgtccatcaatgatagactggattaagaaaatgtggcacatacacaccatggaatactatgcagccataaaaaaggatgcgttcacgtcctttgtagggacatggatgaagctggaaaccatcactctgagcaaactattgcaaggacagaaaaccaaacaccgcatgttctcactcatggatgggaattgaacaatgagaacacctggacacaggatggggaacatcacacaccagggcctattgtgggatggggggacggggaagggataacattaggagacatacctaatgtaaatgacgagttaatgggtgcagcacactaatatgg

SEQ ID NO: 177553 - DNA, 182 bp, Homo sapiens
aatgtatataaaggctatttctccacataaaagatcatcaacgacttatagaataataaaaaagatgtgaagtgttatttcttcaaacactggttgacaaatgcatgctccgtgagaagtacttggctgatcaaacaaacacaccaactattatctctagagtcagtagtcaattattcatg

SEQ ID NO: 177554 - DNA, 267 bp, Homo sapiens
agtaactgggattacaggtgcccaccaccacccctggctaattttttttgtatttttagtagagacgggttttcaccatgttgaccaggctggtcttgaactcctgacctcaggtgatccacctgcctcggcctcccaaagtgctgggattagattacaggagtgagccactgcacccagccagatatgatatttttattaagatcttttctattacagaatacaaaattgaaacatacagaaaagtagaaaaatataccaaatcta

SEQ ID NO: 177555 - DNA, 422 bp, Homo sapiens
gtgctggcagcaggcccacttaggttacagcgaaataaatctgcgcaggtaggctgcttatatccaatgttgatacctgttcagtccaggaaacatacctgcaaaaatgatcggggcatattctagggtttgctgtttgatgatcctgccttgtcatgtgattccgggctgatgagattgctcaagaagccggacatgacaaatttaatattcatactaaatagaatgtagttgtagctgactctcaatgtcttatacttgattccataacaaaacctgaggtcctgccattctttggaccaacataccaactctcttaactttggaagtatatttcctgcttaatcctagggaaaccaagatatcaatagtccttatatcatcattaacatcttaatgattaaaaacagagcactgagagt

SEQ ID NO: 177556 - DNA, 953 bp, Homo sapiens
tgctgttccttttgatcccttaaagcccagtgaatgagagaaggaaatgaatagactgcttgtcacaacaccaccagggtctccacagtgcctggggctgctgctgagagacagagaatgaaagctggaatggaggccgtggaggcaggaaacctttgctgggacaggctccacctcccctacatggtgtcttgagggcttcccatttccttcagtctggggattccgcccgcactaatggagctgtctcttgctgcagcatgcttcctggaggaaaagtccaactctgcctggccacacagagagaagactgatatgcagtctctccacatccctcccccgtttatccaacaaagcagcacatttcactgcgaacgcttccggagtcggctctcaacagtgcagaaaaagggatgctccctgttgcacactccaccacccccattggacgtttttaattaaatcaactagaaagatattttcagtttgaagattcacttcatcttatgtaggtttaaagaagaaagaaaaagagtagaatggtaagaaatcaaaattcacgtctcatgaggaccttagaaatgttcaacccagagaaaataagacttgagaatgagaagaaatagatgttgcaagtctcttcaaatatttgaaaaggtgtcaaatgggtaatgcatgttttatatggtccgaaggaattggaccagatcttagaaggcctaggatgtcagattgtggagttctgattttgtttggaagcaaataaaaaaaaaagaaaataagaagcagaacattgtgttttaggaagattaatctggtagctgattaatctggtagtagattaagctggtagtgtgtataaagaatagtatggtataaagaatagtatggtataaagtataaagaatagtagattaagctggtagtgtgtataaagaataagtatagggaaa

SEQ ID NO: 177557 - DNA, 344 bp, Homo sapiens
cggcattgctgatgcagcaggaggagcgtgccaagcagcagggagatcattcgctgaaggaacatgagctcttggagcagcagaagcgggtaatacccctccccctaacctttgacctcgtggtccagtcagttggctgtcatttatagtgcttagagtgcaccattcaagttttccctggaggctactttgttctcaactaagttctagtatcttccaaagctttcaatttttcttgaagttcaggaattgacaaactatgacctgtggcctgcatgtgtatggcctatgagctaaaaataactttaaaattttttaagggttacaagaaaacccaaaccaaa

SEQ ID NO: 177558 - DNA, 202 bp, Homo sapiens
cggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcc

SEQ ID NO: 177559 - DNA, 406 bp, Homo sapiens
agaaccgctgatcgcttaagctcatattcccttcaagcaccgcctccatctctgctcccctttagagcaaagccactgaaaagtactgtgtaaatttgctgtttcttcttcccatcctcctattctctccaatctacatgccattttcaaatcgaatggtcaactttcagtcctattcttaacctatcagcaacacttgacaaaactgatcaccttctgcaacacctttcagcaattttcctcccgccctgactgtgctctcttctgctggtttcttatccagactcagaggttcagttcttgaacctaatccgtttttggaacactcactccttaatctatctcacttagttccacagctttaagcaccaactgtatgctgacagctctctcttaagcggatcag

SEQ ID NO: 177560 - DNA, 196 bp, Homo sapiens
acaaccacccgggaccacactgtggcttcaatgatcaggcaaagaaccaagcttaggattgagacgctgagcccaatgcaggtgatgtagtccagaactttgtcggtcatcgatttggaggacatgagaatggaaaaagacatcaccacactggtgtagttacagcggcatttcacttcgttcctgatatccaaca

SEQ ID NO: 177561 - DNA, 207 bp, Homo sapiens
aaacataacttataaagcagcattttttcctaaattaaattcactaagacaaatttcactaagtaccaccttttttaaaaagtaatttttaaaacatgggagtgtatttcctcaacaggaagatgtactggtcattgtcaaaagtaccacaacaaatttgtttagaggacacaaccaagaaaaaaaattaactttttttttcttgag

SEQ ID NO: 177562 - DNA, 322 bp, Homo sapiens
gacgctctgagtggggtgggagggttctgagtcctctcttcgccttactgtgtggccaccaagactcactgcatccccaccaggtgcccggggcggctgtgcttccaccatttcacagagggaagacaggtacggagattaagaaccaccctgacgccccaccacaggtaagtcgtggggctggggctgctctgggggcccctcaaactcactgcatctcaaaaccaagctcagatgcaccccttcccttccaagcatggaggggagttcagcacgaaacccttattctccagccttggagtcctccccacagagagagcgt

SEQ ID NO: 177563 - DNA, 456 bp, Homo sapiens
gctcggtaccccccgtccgtccctctttgggggtgggggtgcccaaagactggagccaagtatttctagagtctgtgccctgatgagaccccatgtgtagaatatctcattaggtaatgacacagggattcataggtaggatttggaacacagaatgaagctgctcttggccagagaccacagattgctcagatcgctgccataacctcattcaacttccccaacccacaaaggaattagtgcctctcagcacattgattgggaatcactagtctggggaatataactacaaatggaactgctgtgcctaagcatgtgtgtgtctttgactatgccaaatactgcctgactcttctccaaaatattgtccaattcacagccccatcagtgatctaccagagttccagttgctccgtatccttggcagtgcttgagattaccaagacaactttttcc

SEQ ID NO: 177564 - DNA, 607 bp, Homo sapiens
attcgctttcttcctttatctcaaactcttccccatttctacaagctggtccattcagagagagacagttctgattgagagctaagttttaaaaggccaactttggggggcaacaagttcttcacatggctagattaactctttcagccagggagaacttagactgttgtttgttggttgggggtgggggtgcccaaagactggagccaagtatttctagagtctgtgccctgatgagaccccatgtgtagaatatctcattaggtaatgacacagggattcataggtaggatttggaacacagaatgaagctgctcttggccagagaccacagattgctcagatcgctgccataacctcattcaacttccccaacccacaaaggaattagtgcctctcagcacattgattgggaatcactagtctggggaatataactacaaatggaactgctgtgcctaagcatgtgtgtgtctttgactatgccaaatactgcctgactcttctccaaaatattgtccaattcacagccccatcagtgatctaccagagttccagttgctccgtatccttggcagtgcttgagattaccaagacaactttttcc

SEQ ID NO: 177565 - DNA, 140 bp, Homo sapiens
ggaagggttattagatccagagaagggaggagagctgtgtgggtgagaactgggaaaggaagatttacagacagagaatctgaggactgagagagttggctcatggagcaggaaagcgagtgtaccagggagacggtgag

SEQ ID NO: 177566 - DNA, 111 bp, Homo sapiens
tgctgggattacaggcgtgagccaccgcgcccagctacatttgccgctttcttatgtatctcgtagaggcagtccctaactatcccatttcaagtgcaccgcccctctcac

SEQ ID NO: 177567 - DNA, 766 bp, Homo sapiens
taatggtaaaagcaagcaaatgtgggagaggactaagcagcagagaagagaaggccactgtccttggggactttgtagctcaactttgagttgccatgggtgatgctcctccaagtcaaggcggaacatccaggctggggcagctggcccttgtgaactagtgtagcagacactgaaggaggaaatggaagcccgggattctgcctcaaagggcttcaagtcccaggaatttcattccctggcactgcaggcagcactgtctcaacctaaagttgcatttgcagtctcttctatgaagcagtgagcaggagaagagggaaaaggtgtaagactagaggcaaaaggacaactaaatgttcttaccacccagaaagaggacttttcgtatatgaatgacagtggttgcttgtgacagagcagacaccaatgagcaacaaagagagtgaaaaaatcagggacatcagagagaccctcagggacatcaaaagagagcccctctcctccacccccatcccctgctgttctggaaccagtctaagaacctagaaacatcaggagggccctcctccttccttttcaagcaggactgcccatcactccataactccctaactctttcttttagggaccttcaagttactgtttctacatataattttcactttctctgtcaatttattatctgcactctggcccctatccctaatttctgtattaacttctctggtataaaaactaactgacaagttctgaaacaccggtcaca

SEQ ID NO: 177568 - DNA, 240 bp, Homo sapiens
gttgtatgtgcaattcattactaagagagaatatcctgagcagttcccaatggtgggtggctggctaaaaggaatccctggagattttagtgtggtaggaaagcattttcattcttgaggatttttctttgacttttctatgggctggctgatttcctcagtttgctttgttctgggttttaggggagaattcttgggaggttgtgaattttctttgcctacagtgagatggttagatgc

SEQ ID NO: 177569 - DNA, 287 bp, Homo sapiens
atgacgagttagtgggtgcagcgcaccagcatggcacatgtatacatatgtaactaacctgcacaatgtgcacatgtaccctaaaacttaaagtataataataaaaaaaaaagagtaatgtatgtcctgaaaaatatgtatttaatagaacatggttggggctttaaaaatttaagaaaatttaatctaaaatcctaatctaagcttccagttggaagatattagaaaacacgctgtatccgcctttcctatttcctttccatcttttccaattttcattttcttct

SEQ ID NO: 177570 - DNA, 216 bp, Homo sapiens
aatgaaatttaaacagcagttttcttgacacttttcaatttatcaaaaatagctatgtattaaatctcactttggatgcaaacatttcaaacttcttatacttatttttaacattctaacatatgaaagattattattatgttttaaagggacagggtcttggtctatggccagcctgggcagcagtggcatgatcctagctcactgcagcctgga

SEQ ID NO: 177571 - DNA, 399 bp, Homo sapiens
gtcaatatattttaaattttaacttaccaacagttatttattgaacaaccactatgtgcagggatgtgctaatgtactaaggataaaaaaatggatcaagccaactcctgtactcagagagctctcccaagcaagggcaaatacatgtggatgggttctggtttatggtgtggtaaggacagtgagcttatttaatactagccatgccccattccttcctttaagaaacatttatcggctaccactgtatattaggcactgtggaggcgctggaatgtaactgtgatgaaaacagagaaggtctttaccttcatggagtctgcattccagtgtgggcacaggaggggagaaggtgacagacaaagcaagtaaataaataagtagcaattagagagcact

SEQ ID NO: 177572 - DNA, 1042 bp, Homo sapiens
gtggggtgactgctccccctggtggccatatatggctaaagcaagtagaagtccagacacacctggagaacaggtgccatcgcctgaaagcaaccgtaaccacgacaacaaggccaggtgcagaacccaggtctcccccctttattagaacctgtggagagatcatgaatgtattctccgatatgtttattttcaggggttaaaaaaaaaatctccccagtgtcacttctcccaggaacgtgtgtatgtgaatggcttaaaaactgttgcccttgacaaagaaatgtaccaatctccaatgacagaatatttaatcgaggaaaggtctcattaacagatgttaattaatctccttaacagatgttaaggagaactgcaaaccactgttcaatgaaataaaagagaatacaaacaaatggaacaacattccatgctcatgggttggaagaatcaatatcgtgaaaatggccatactgcccaaggtaatttatagattcaatgccatccccatcaagctaccaatgactttcttcacagaattggaaaaaactactttaaagttcatatggaacaaaaaagagcccgcatcgccaagtcaatcctaagccaaaagaacaaagccagaggcatcatgctacctgacttcaaactatactacaaggctacaataaccaaaacagcatggtactggtaccaaaacagagatatagatcaatggaacagaacagagtcctcagaaataacaccacatatctacaaccatctgatctttgacaaacctgacaaaaacaagcagtggggaaaggattccctatttaataaatggtgctgggaaaactggctagtcatatgtagaaagctgaaactggatcccttccttacaccttagacaaaaattaattcaagatggattaaagacttacatgttagaactaaaaccataaaaaccctagaagaaaacctaggcaataccattcaggacataggcatgggcaaggacttcatgtctaaaacaccaaaagcaatggcaacaaaagccaaa

SEQ ID NO: 177573 - DNA, 521 bp, Homo sapiens
taacttaggataaaaacacttcctattaaacctcaggtaccactgcttaaagagtatcattctcacatttccttgcaaaagtggaaacccataatccaaagatcctttttaagaatgagtcacaggggccgggcaaggtgtctcatgcctataatctcagcactttgcgaggctgaagaggatggattccttgaggtcaggagttcaagaccagcctggccaatgtggaaaaaccctgtttctacaaaaataccaaaaatttagctgggcatggtggcgtgcgcctgtaatcccagatgcttcggagactgaagcaggagaattgcttgaacccagaagtcagaggttacagtgagtcaagatcgcgccactgcactctagcctgggcaacagagtgagactgtgtctcgggaaaaaaaaaaaaggccaggcgcggtggctcacacctgtaatctcagcactttgggaggccaaggagggcggatcacaaggtcaggagtctgagaccagcctgaaccaca

SEQ ID NO: 177574 - DNA, 271 bp, Homo sapiens
atttggacttggtagtggatgccctggcaaaaggctggaaactcttccctttaaccaaaagttatcaatttctcttccttgacttgtgttcagcctttctgagcccttttgtttcttagcataaagaactggagttttctgagtttctatacattgtggaaagcttatcttcccctgggaaatgtggccttgaacctttcagggcactatcaactgtgattcacaccagacaatcactccccacaaagaactcaaagaaccaaagctgttt

SEQ ID NO: 177575 - DNA, 556 bp, Homo sapiens
gagaactctgaggttccaattgagttctcagtcaatctattttggtcagaaaataattaatagatgaaaaggtgacccagatttggggtcgggcccaagtctgccacccacactgcgtgggcaaatcacattgcctttctgggcctcagtttcctaatctgacaaatggacaggttagacaggatgcttctgagttggcttccaacccaaaagttctgtaagtacgtgtgagcagagccgtggactcagccacaccaagttttaatcagagttgtctggtaactggtggagatggggggaaggagagctcattaaacacctgcgggcatgcacagactcttctagaaaatcaagacacagtctccattcatggttttgccctagtccattttcagtgcggttggtgaagccagttcgccacccgagaactcgtgaggcttccaggaggagcgtactctgctttgcttcgttagccccagcatgtgctcagatcacagaggaaaagtcccagggcagcaaaacactggggagggccctgcgctttggagactgagag

SEQ ID NO: 177576 - DNA, 236 bp, Homo sapiens
ctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcgtgagccactgtgcccagccaaggatattctttttataacattttcaaaaattaaggcatattgtgtat

SEQ ID NO: 177577 - DNA, 390 bp, Homo sapiens
cagagacccagaaaggagatgcttgcttaagattttcctgagcaataaaggcaggcctggggtcagaagcatttcccttggctcctggcccaggactctcccatcaccatatgctgccatttgcagaaatgccagctgcaggactcgtgacatttgggtggctttttcctaaagtgtcggtagcgtgtggggctccattctcctgcccgaggctaaggtcattcctgtctacctcctggcctcaaaacacagcctaatggcctttgggctgtgctgaaactgccctgtgtcctgtgggggatggggagggctcacctgccaaaaaccagccgtggtctcatggtcaagatgtgtcagagatttctagagcttggagaactgtgttggagg

SEQ ID NO: 177578 - DNA, 576 bp, Homo sapiens
cggtgtggtggctcatgcctgtaatcctagcaatctgggaggctgaggtggaaggatcgtgaacctaggagttgaagaccagcctgggcaacaaagccggaccctgtctccttaaaaaaattaagttcaattaaacatttttaaaaataataaaccagtcattagaaccataaacctgtactgtttttgacaatgtaatgcactgccctgtaaaacactacaattaagactgttattttaaggaccctgaagtctgtgaagatcaggcacttttttgaaaccctaagataattatcccccagttttctccattctttgtttctacctagaaccaagttcaccaccaaaacgcagtcctgctgacgtcaagtattcattcatatgacatgtaattactggggtcgttaaaatttgggcagaatctttgtcaattcaccaggaccttaggcaaaaaatcaggaaaatgaagtgactgactcagtctgccaaaagcggatattctgaaataccactttccaactttaagaaacacttcctgccaggtgcggtggctcacgcctataatcccagcacttt

SEQ ID NO: 177579 - DNA, 201 bp, Homo sapiens
gatggaattgaattaaattagggaaagtaagagtaaaaatatttaactctcagtctcaaattcaataattcctgactaatggggcctcagtttccttatcaatacattgaaattagtaacagctgcctgatgctccacagatcatttctatgggtggaaaacctacacctctaccctgctgtgaataggatacgtctgaga

SEQ ID NO: 177580 - DNA, 346 bp, Homo sapiens
aggtgggaggaccgcttaagcccagaatttcaagaccaacccgagaccccatctctacagaaaaaatttttttgagctagccaggcatggtgacgcatgcctgtggtccctgctacacaggaggctgaggtgggagggttgctcaagcccaggaggtggaggctgcagtgagccatcatcacactccagcctggatgacagagcgagaccctgtctcaaaataaaaaagttattttatttacatggtccccagttttatttgtataatataccccttctacttttttctcagaatttgaggcagacaatatcctattagtttggtactttcccctaagcagatctc

SEQ ID NO: 177581 - DNA, 422 bp, Homo sapiens
gtcagggctcaaacacatccaatttaagcactgccaagggacaaggcaggacagcgatcagggctggactcagaatatgttctctttgccatggttgaggtattcattggatttttttcttctatcctcaaattggaaatagcttatgattccactggtgtcaaagtagaattttccaaaagttaaaaacataattctcatacaaatataaacatgtgtcaaagatttctttaattcactaatgagagaaccaacaaaatgacaaagccagtgcgtagagcatttgaatgaacttagtatttgtaggaactgatgaaagaatgttgcattaagagtgttaggttagatctaaaagtgttttacaagttattaaatccataaccttggggttacagtttataccagatacaaataatttgcat

SEQ ID NO: 177582 - DNA, 563 bp, Homo sapiens
tatatggattcagtgatgtgaccatatacttcctcttgctcctgcctgcttttcccctttaaatatcaaagccctcaaaatcatctttggagaaaggcacagacttctctctggggcaagtccttaaccttggtaaaataaactaaattgattgagacctgtctcagatactctttggtttacatgctgttctaaaattgaagaaaggttttacctacaaagccccagcaattgtcccctcatcacagttgcctgaatggggtcacatattcattgctgaaccaatcactgtagagggaggaggatggtggactttaccttagaccaagcaggccctgcctctaagtctaagtacatgtggtccaggatggagaagtggatctacctggtcaaaagcatgtgctgcattacaaaaaaaaaatggagaacagatgctgagtagcaatatccaccacatcttttcagtttatatgctgttaatatattttgttagacttttttttgttttgtttttgagacggagtcttgctctgtcacctaggctggagtgcagtggtgcaatc

SEQ ID NO: 177583 - DNA, 757 bp, Homo sapiens
gggagggtggctctgggtgttacagcaagaccgttggggagctcttgaattccaaggggttgggtcgttgtcctgtggcatgacaaaatccaggtgtttccagaatattaatccagcagaaggatagactgaaggaaaggaatcagaaagccaggagattggtttacagtcctttgttgcagacttgtatgtacgttgcatgagtttctaaaccctgtgatgggaagaaaggtgtgaccgccaacagccttggtcgggggtgaaaggacacgagctggaccacagtgagggtgctgcatttcatcctggcaagaattctgcccagctgtggctttctgtcctccgtctacaattgggagaatactggagacatcagatgtcgtgtaaggactaagaacgaaccctggagaggctcagcatctgggtgctatttgtagaggtctgctgggtgacatgtactagagtctttcattttgaagaacctgctggatatgactagaaaagtaaaggagaaaaaaactccaggactgatggatgagagaactgaaaagtggcccttgatgtcacagtgggcactgggactgcatgtccccaggggctgcaaactccagagctcaccttcccttgaatacacatccagtatggcccaagcccacgcatactacagggagtccagcctgcctggagtgccccctcactagtatttaggacaccccagggaaggttggcctgtcctctatttccagaggcaggcctt

SEQ ID NO: 177584 - DNA, 195 bp, Homo sapiens
aattgtcttgtgacaaaaggatggaatagacctagcccctatgtctgttgaaatagagataagctcatgggggtgatgtctggaatgaagctatggtggtagctaagagtcttcattgagaaaacaatcaagaggtagagtggccaggcacagtggcttatgcctgtaataccagtactttgggaggctgaggca

SEQ ID NO: 177585 - DNA, 532 bp, Homo sapiens
ccatgttatcaaattgtactgagactcttgcagtcacacaggctgacatgtaagcatcgccatgcctagtacagactctccctgcagatgaaattatatgggatgctaaattataatgagaacaatgtttggtgagccaaaactacaacaagggaagctaattggatgaatttataaaaatatgcctcagccaaaatagcttaattcactctcccttatcataaggataatcttgcctaaagggacagtaatattaaagacactaggaataacctctgtactttggacagtagacctgcatagcccattaggcctcaatgaagtcttatgcaagaccagaagccaatttgccatttaaggtgattctccatgtttctgctctaactgtgcttcacaatactcaaaacactaaatcaggatgtttcctggagttcagggagctgtccgtgttactgagcagttctcagcaacacaaagatcctactgactcctcatcagacttctttctcactggaattttacacctgggctg

SEQ ID NO: 177586 - DNA, 852 bp, Homo sapiens
cgcctccaggcggtgcccgctggtctctagagtgtcagtggcgctgtcttcctgcgttaccggagcgcacaaaatactcggtccccaggccgagaacgcacctctacctgggtcctgggtcccatttcacagactgagatgcgtgaagcgcctcctttagaagagctgacaattcttagcaaaccaagttttgcgtgattttggggaggcggcgctgccccaggaacgcctggagggcctgcaccaccaaactggacagccatgggtgtgtaacctctttttgggcctgagaaacagacctttctctccactcagagctccggcttcagctattgtgcttccgaatgccactaccatcagatatgccatctacagaacttaacacctgagcacccacccttcagggccacccatgggcccaaaacgggataaaggagccattccctgacataggaggaaaacatttgctgagaagctactgtgtgccagacacaatcttggactttcacttaatcctcaaaacagccctaggaagaagtacctaccgttaacagataagaaagctgagacccacggtttacacagctaaggagagcaaaggttttaacccaggactgtcctgactccacaacatcaaagttgttgttttgtttttggtgttttgtagaaacaggatctccctattattacccaggctggtctcaaactcctgggctgcagcagtcctcccacctcggcctcccagagtgctgggattacaggcaagagccaccacacctggctgatgaataggaattgggtaaacatttttgaaaattaaataccaaattaccattacacaatgccaaacag

SEQ ID NO: 177587 - DNA, 864 bp, Homo sapiens
cgcctccaggcggtgcccgctggtctctagagtgtcagtggcgctgtcttcctgcgttaccggagcgcacaaaatactcggtccccaggccgagaacgcacctctacctgggtcctgggtcccatttcacagactgagatgcgtgaagcgcctcctttagaagagctgacaattcttagcaaaccaagttttgcgtgattttggggaggcggcgctgccccaggaacgcctggagggcctgcaccaccaaactggacagccatgggtgtgtaacctctttttgggcctgagaaacagacctttctctccactcagagctccggcttcagctattgtgcttccgaatgccactaccatcagatatgccatctacagaacttaacacctgagcacccacccttcagggcaatatggtgaaaccccttttctacaaaaaacttagccaagcatggcatatttgtgtaatgccatttgcatgacccacatggtcaccctggaccccgtggatcaggccctgcctggtgccaccaccgccacttctgtgccaggcccccagtgtgatgcaagttgcatgatgctctttgctgtagtgccttttaatggcatagctttggcaggtttggagatgttcagaataggcaaatcctgtggtggatttgtggttgtctaaggccctggtggaagggagcataggtgaattggaggggatgattaaaaggtgtgagatttcattttggggtgatgaaaatgttctaaaattggttgtagtaatggttatacaactctgaatatactaaaaggcattgaattgtacactttcaatatgtgagttatatctcaataaagctattttacaaaaaaaga

SEQ ID NO: 177588 - DNA, 819 bp, Homo sapiens
ctgcatgggtccaccaatacaacccttgttttgttttgttttgttttcaataaatacagtcagccctctctatcagagggttccacatccacaatgaaacatggttggaaaatacagtatgggatgtgaaacctgtgtatagggtgggctgacttttcgtttccataggttctgcagggtcaactatagtacatgagtatactcacattttagtatcctaatagatcctcaaaccaacacctggcagaaaatggggaacaattgcataacagtattcaagggactgggtatgatggcttgcacctgtaatcccagcacttttggaggccaaggcagaacaggagttcgagaccagcctgggcaatatggtgaaaccccttttctacaaaaaacttagccaagcatggcatatttgtgtaatgccatttgcatgacccacatggtcaccctggaccccgtggatcaggccctgcctggtgccaccaccgccacttctgtgccaggcccccagtgtgatgcaagttgcatgatgctctttgctgtagtgccttttaatggcatagctttggcaggtttggagatgttcagaataggcaaatcctgtggtggatttgtggttgtctaaggccctggtggaagggagcataggtgaattggaggggatgattaaaaggtgtgagatttcattttggggtgatgaaaatgttctaaaattggttgtagtaatggttatacaactctgaatatactaaaaggcattgaattgtacactttcaatatgtgagttatatctcaataaagctattttacaaaaaaaga

SEQ ID NO: 177589 - DNA, 835 bp, Homo sapiens
cgcctccaggcggtgcccgctggtctctagagtgtcagtggcgctgtcttcctgcgttaccggagcgcacaaaatactcggtccccaggccgagaacgcacctctacctgggtcctgggtcccatttcacagactgagatgcgtgaagcgcctcctttagaagagtgacttttcgtttccataggttctgcagggtcaactatagtacatgagtatactcacattttagtatcctaatagatcctcaaaccaacacctggcagaaaatggggaacaattgcataacagtattcaagggactgggtatgatggcttgcacctgtaatcccagcacttttggaggccaaggcagaacaggagttcgagaccagcctgggcaatatggtgaaaccccttttctacaaaaaacttagccaagcatggcatatttgtgtaatgccatttgcatgacccacatggtcaccctggaccccgtggatcaggccctgcctggtgccaccaccgccacttctgtgccaggcccccagtgtgatgcaagttgcatgatgctctttgctgtagtgccttttaatggcatagctttggcaggtttggagatgttcagaataggcaaatcctgtggtggatttgtggttgtctaaggccctggtggaagggagcataggtgaattggaggggatgattaaaaggtgtgagatttcattttggggtgatgaaaatgttctaaaattggttgtagtaatggttatacaactctgaatatactaaaaggcattgaattgtacactttcaatatgtgagttatatctcaataaagctattttacaaaaaaaga

SEQ ID NO: 177590 - DNA, 530 bp, Homo sapiens
gtcatcatgtgtgcacagctcatgtgacgtagagtattcttagtatcctaacacacaatagagtacctaaagccagaacttttaagagatatacctgtaagtttgggcattacatcagatagtattttattaagttttgaaagttctcagcttactgcacccttgttgttagtgggggttgatcataaatccacaggtacatgcattttctcaatttgtaaatttttttttgaatgtatataatttttatttgttaactatatctcaacaaagttggaaaaaatgaaagagaagtgaaggagcaggaagagcaagatggagagggagaaaatccaataaagagtccacaatgtaggttgcagctgtgaggatgcctctcagagctgaagggaaaaaaaagcacacacacaccagctgccatccgccactgcctgagagctgtccctaggagtattaattaactcccttgtgtttcttcttagctgtgcctgcctctatctggggctgaaaagggcttctgtttcttacca

SEQ ID NO: 177591 - DNA, 1694 bp, Homo sapiens
agcgggccatcgcgcactggggctccgggcggctgggaccggcctggggtagctgcgcagcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccaggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggcctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcaccc

SEQ ID NO: 177592 - DNA, 803 bp, Homo sapiens
agtctccaggtctccagccagatccggggaatgtgttctctcagtgaagccagcccttgcccggattggaaatacaatcctcttgcctgtgcatcttcagactgccagcgagcacttgagttaattaagttcgcctgagttgggcggatggcacagtccaggcggcctcagagaggggatggaaggaaccctggctcctgttaagaatgacctttcctccccttgactcaccacccatctgttctataaattggctttttttcagcctgaatctcattaggatcctgtgtcccagggaaggagaaaggaagagaggcattttccctaaccgtgtcccagagaatggggagaggaggggcctgggcagaagcagcacccacatgagagagttccagaggtgggcgctcagcaggacaacagtgtaactgccaataccactagcaagggtcagaagcgaggagcagggagaggctgaagatgggtggcactggtagggacccccatggccctaaagcactttgggcttccctaaaatcccaaggatacctcaagatccttcagcccctagccaggcacaatgactcacacctgtaatcccagcacttcgggaggccaaggtgagcaggtcacttaaggtcaggagtttgaggccagcccaaccaacatgacgaaactccgtctctactaaatatacaaaaattagctgggtgtggtggcaggtgtcggaggtcccagctattcaacaggctgaggtgggaggattacctgagcctggagaggtcaaggctgccatgaggcgtgat

SEQ ID NO: 177593 - DNA, 344 bp, Homo sapiens
gaaacaagagggttagtaagggaaatcatttggattatatataataaagaactctctggttggtaaacattattgaatataagaagaaaagcttcaaactttttggccctaaaaaatttgcccataggataaaaataacaagactaggcaaacacattccctataggttacagaacaatggaggaattaaaagacaaataaattccatttcataatatacttgtcatacttatgtaaaagttgtcattcttctcacaagcccctgcatcccccacaaaggcaaacctgaacaataattctcattaaagtatacttccataatctactatgggcacggaagatca

SEQ ID NO: 177594 - DNA, 419 bp, Homo sapiens
tgccatgattgtaagtttcctgaggcccatccagtcatgtggaactgtgagtcaattaaaacgtttttcttcataaattacccagtctcgggtaattctttatagcagtgtgaaaatggactaatacaccatcaaaggtttttggtattttttgtttatttgtttatttgtttgtttgtttttggtcagacagagcttctttatgttgcctaggctggccttgaattcctggcctcaaatgatcctcctgtctcagcttcccaaagtgctgagataacaggcgtgagcaaccatgcctggcctcaaaagattttttaatgatgcctgtaatattttgactctgaaactattggggtcaatataaatattttttcaatatggttggttggttggtatatggatgttgtattttcccaaat

SEQ ID NO: 177595 - DNA, 311 bp, Homo sapiens
gagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagtttattgtagattcacagatctaagagaaataacaatcaaa

SEQ ID NO: 177596 - DNA, 268 bp, Homo sapiens
tcagcaagggggaggatgtattaaaagagggtaaactggagggtaaacttataaggcacactgcttaatgggccagtcaagacatgagcaatacctaatgcaggccaggcgcaatggctcactcctgtaatcccactctgttaattcttaaagagaaggccaagaaatgaaatggacactactgccagcatgaaagtggagaaggaacactataaaactcatttatccttcaagcttcctaacctctctcacagctgatttcctggaa

SEQ ID NO: 177597 - DNA, 454 bp, Homo sapiens
taggggtatggggaatggacgcagtgcacctgggctgcctcagggctcagctgtggggcaggtccgcttcaagcctttctgggttgacctgatggagctcttcctgtcctggccctaagaagctcctcctgccagctccttcctcccactaccccctggggcacagccagggctggggcacccactcccaggcaagaatgcacccctggagaaaggggctaggcctgtaggagagccaagcctgtgctttctcccggtcctggttttccagggagccctgactggagggggatgggaggagaagcccaggagggagggggagctggggaagcagaaccaggaactggaaggggaagggtgtgggtgggcccagatccagcctgcctcccgctctcccttgcctgccaatcccctcctgggccctggcacactcaaggcaggggcttggcggccg

SEQ ID NO: 177598 - DNA, 342 bp, Homo sapiens
aatgagaggaatgtttgaaacatcataaataaggatttatttatatatgtttgattttctttttttcctctctctccctccattttttgcctctcttccttccttccttctttccttccgtgttcctcttcccctttccttttcgactgggcttttttagtaacttcatagagtgatataattattctgtcacctttacattcattagagtaggctcactcccattctttgaggctgtattttttaaccattcattataaaatgaaaggtacagaaaatcacataaaatgtagcatttagttggttattaaaagtttggcatctttttaacagtggtgacag

SEQ ID NO: 177599 - DNA, 289 bp, Homo sapiens
cacgttccttaacattcttggctgtgagggaaagaaggcaaagacaagagcctttatcctaacaactcaattgctggagagaagattcatgcatattctatgtggcatcacatgccatagccctgggattgaaagccatgcaatttaagggatggtgttaatctcagtccaaataggtaataagatcttgcactttgctatattttaggggtaggaatgagattgggggtttgatctataatttgtacccataggaccagtgatttgcccagtcatctgtgagtaaatg

SEQ ID NO: 177600 - DNA, 312 bp, Homo sapiens
gtcaaaaatgctcccccaaaatagaacaagaccaagacatgacaagaaaatatacttaaaatcagaaaactaaatacaggaagtccaacattcaactaaaggaaacggaaaaggagaacacagagaaaacagtaaagaataaactgtcggccacacacggtggctcacacaggtaatcccagcactttgggaggccgaggcgggcagatcacttgaggtcaggaatgtgagaccaaactggtcaacatgacaaaaccccatctctactaaaaatacaaaaattagccaggcatggtagcacgtgcctgtagt

SEQ ID NO: 177601 - DNA, 247 bp, Homo sapiens
ctctgcctgcactgttgccttagacaagcatatgcctcactctctcacctttttccgttctttgctcagatgtgccttctcagtgaggatggctttggttatcatatctacctttgcaaatcactcctcaccccttacagtccatatatctccagtccctgctttatttttttatagcatttaccatctgacttacttgtgtatttattatcttgttcccttacccgaatgcaagcagagattttaa

SEQ ID NO: 177602 - DNA, 196 bp, Homo sapiens
atttaacaacatatccctaaaaacatttcccatatagcgatgtttattaaatccctttttttacactgcattttgttacatattggaaactatttgagaaacgagaggtaattgcaaacatgacttgacctggttcaaaccctaagagcttttaaaactccaatgtttaaatggagaaaattgtagttttctggta

SEQ ID NO: 177603 - DNA, 678 bp, Homo sapiens
ctagagtatctggaagaatggagttgccatttagtgatagagggaacgctggggaggatccattattggagtgagcattagcagcttggtctggggcacatcaagcttggaaggcatgttagtcatccaagtggagatgttgagtagacagttggacatgggagtctagagtttcaggagattggtctgggctacagaagtggatttttgaatcaacagccatgagacttgataagattaccaagggagtgtagagagataaggccttgagtgttccaatatttagagtttggaaagatgaggaataatcagcaaaggagactgcaaaagagggccaacaaaatggtagaaaatgtggaaagcctggtcacctgggagttaagtaatgaaagtgtttcaaggagaaagtaatcagctgtatctaatgctatacatgtgctaagcaagataagaacattggatctagcagcatagaggtctctggtgatctgaaaaaaggcaactttcatgtagttgtagaagagaaagttcagttataatggatcctgaagagagtgacagaagagcgatttatgactcaaggaaagaaaaaacaaatgggctggtagttaaagggaaattgagtcaagaaaaggttcaatattttttaatggtagaattgaccgtatgtgtatgtgc

SEQ ID NO: 177604 - DNA, 589 bp, Homo sapiens
caaggaggtggggctaattgggggtgatcttggtggctggctaccacagatgaagttcgtgattagaattattggggtcaacagatctgaatatataaaaatctcttaaaacattctttcaaattgttttctagaaaaattcttttgatctgcatactaaccagccaagtttgagactatcttgccattaagtagaattattgtttcacttttcagataaaaagtgacacttcatttaaacttgggaagacatttcacttattagccatttgttcttcctcaatttattcatttattaaagattcactaagtataaaaaaaagattgactgaatatcttctatgtgcaaggtaagtactcatgccaatgagcaaaaccagagagttcttgctctcatagttattacagtctaatggggaagccaaacaattggataaccgcacaaagaaatataattatagccaggtgcagtggctcacgcctgtaatcccactactcgggaggctgaggcaggagaatagcgtgaacctgggaggcagagcttgcagcagtgagccgagattgcgccactgcactccagcctgggcga

SEQ ID NO: 177605 - DNA, 616 bp, Homo sapiens
aaagtccatgtccttaaccaccaaccattaaatttaattctacatgcaaaaaccttattttcccaatgacctacaacccaaatactaaaacaacatgatttgtctctttaataaataaagaggacagaggagaaaggaaagaaaggacaggtaacaagattacttgctcccaggaatgaaaaaatatgatgttccatggatacttagtttggtccctaatccgcaacatcacaaaagatatctgtttggatcaataccatttctgctcacacagtctggtattgtcttttgtagacaatatttctttgtgtcaaactaaaaaagaaagaagtgggattcacaactccatttagaaagagaaaatattataaacggacagaaactacttatgtgtcactcaacgtaagtgacttaccagtatgcaacagaaaagtccatatttcaaagaggagctcatatgcaaagtttcaaagacccatggtgataacccaatataagaaaatttggccctctccctctcccctttctacggtctccatctccctcatctcccgtttccacagtctccctctgatgcccagccgaggctggactggactgccgccatctcggctca

SEQ ID NO: 177606 - DNA, 620 bp, Homo sapiens
cttcgtttaggtgttaacaaaatccaggccagacaaatctaaactttaatctcatacccagttcctagatgagtcccttctccagctcaggttccgcctaagcctcagggttccttacttggtgggcaccacctgctcccttccccacctttgtcctctttttcctctgctggctcctccggggttgggtgtgttcagaggcagagacaggctaaaggtctttggcttttaggttctgttggtgggtgagttccagatatagctttctcttgtaggatatttcatttatttatctattaaaaatatttatttagaacacaccattcatgtgccagaccctgtccaggcactggggctagggtgataaatgagatcaacaaaaatacctgcccacattaagctcctgttctagggaaagacagaaagaaatacacgtgtccttagtatattagaagattccaagtactgtagagaaaaataaagcaggctggactcggtggctcatgcttgtaatcccagcactttgggaggctgaggtgggaggattacttgagctcaggaatttgagaccagcctgggcaacatggcagatcctgtctctcccaaaaaaaaaaaaaaaa

SEQ ID NO: 177607 - DNA, 661 bp, Homo sapiens
cttcatatctctgtggtgttaagcatgaaactctcttggcctgaaatgtgcctctcctatgaatccctccaggacagtcatccacctcaggtagaaagtttctgccctttccccactcacaccatttcataattccccatctccagtgtttatggtcttacaggtgaatgctttgtcgtcttcaccaccagaacatctgcttattgggcagaggaaccccatatcttatccctcttttattcctactactaggcccatccctcagcctaatgcctgcctccccttaagtgtttctggaacattatgtgaatgaacaaatgtcagaggaattaggcaaatagctgcaagaaaatcagcggtacttaaaactgtctttcttcaggatgtttttttctatacgaacccacttctaaactagcacaccgaaattacttgttcagtacgtgtctccctctcattagaatgtaagctcttgaggctctggtttctgtccctttgttccctgctgtgtccccagaatcttagcacaatgcctagtttatagtgaacactcattacatatttgctgagtaatatatcagttgcacccatggggtttccacaattgaaactccttttgaacccagggagctctggtcttttgtcagtcatctctatctta

SEQ ID NO: 177608 - DNA, 325 bp, Homo sapiens
gttttcctctctactaacaataaccagtttaaaaatgtaatggaaaaaattgactttagcaacaaaatattgaaaacagaataaacttaaaaaagatctatatggagcacttcagaattgtatgaggcatataaaagatttaacatgcagaaatatgccttgtttcttccatatggggatgataatagccaacgtgtatttattgcttactctgtactagatactgcggtgtgttataaacattatctcatttagaatgagaattataaacttgtcagttcttccccactaaacaaaatcataaaggcattattttgggaacttg

SEQ ID NO: 177609 - DNA, 410 bp, Homo sapiens
gagtgaatgctttgcccttaagacgggtccagatgttctccctgtacataactctgtgcatgtgtgcgtgcgcgcgcacacacacacacacacacacaaacacacatacactctcttcccctctcacacacacatacacactctttctctctctcccctccccccttacacacacacacacacacacacacacacacacacacacatattcacagtgctggtatctttatgtgttagtgaacaattatacagtcatattagcctgtgtgtaaaagaattatttcccttagaaaaagacagaagttcctcttctttctctgtagtaagttggagtgactcattattttttacattttcgtgaaaaccacacacaacaaactcactgtgtgagacagcacatatcctctcag

SEQ ID NO: 177610 - DNA, 376 bp, Homo sapiens
gccaccctccctgcctaatctgaggattttgctagcaaagctgtcaggcttaatttcagcaaattgttttgggtaattagtcccttttaattgctcatggaaatagtaattttaagtgacaagattattatatgctgctcgctagtggattctccagggtcaagaaaacaccactgagattgctataacctgttcttttctatcttgggcattccccttgaaatccagaaaagacatttagtaaagtcggttcccactctgtaaaaagtatagagcactggtttccttttatccttctgccaaagtgaaggattagagaaggactttcaacttttctgtgcgactgccagcccatgtcaggcttcacagatttgct

SEQ ID NO: 177611 - DNA, 475 bp, Homo sapiens
  misc_feature (14)..(14): n is a, c, g, or t
gggtctgtttctgnacttctgaaataataaaagaatgtggctgggcgcgatgactcacgcctgtaatcccagcacttcggcaggtggaggcaggcagatcacctgaggtcaggagttcaagaccagcttggccaagatggtgaaacctcgtctctactaaaaatacaaaaattagccaggtgtggtggcaagcgtctgtagtcccagctactcaggaggctgagacaggagaatgcttgaacctgggaggcggaggttgcagtgagccaagatagtgccactgcactccagcctgggcaacagagtgagactccgtctaaaacaaaacaaaacaaaaaacagttacttgatattagtaaaatgcaatgaagacccttactgctacttacaggtgaatgatcaaaggtcattcctgagatgtgagtctaacaaatgggagggttttggccgccgtaatggaaacagggctgtccgt

SEQ ID NO: 177612 - DNA, 432 bp, Homo sapiens
ttcaccgtggtctatttccaactcccaatggtttgacaactgcttatggatgaagttcctcagttctgaccatcagctcactgaatgtgctccagtaaagttgcaaagcgagtcattaagcttcgtccaccacagtgagaacaacttttcctcagtccatttcccatcaacccctggggaaatttctgagttgcccaccttgtctgttaggcttctttccctagttttatcaggtatgaccaggggaccatgactacattgtagacgcatggttgttgggagtctgcaataatagatcggggcaaatttaggggttaatgtgtgctggaataacatcccagtcataggttgggtctctccaaagcagagcctgagacaaagacttatgtaccggaagtttacttagaaatatgattctggaaagcagaagtg

SEQ ID NO: 177613 - DNA, 456 bp, Homo sapiens
gaagtcctgggctcaagggatcctcccacctcagcctcccaagcatctgggattacaggtgtgcaccaccacacaggccccttcattcttgaagcacaacttactctctgataaacacagtgttccaggctccccttatatgttccctgaaccaacctagtaactagccattccttcaaggatccctaattccttttggtggaagatggtatttcaatatacagatctgaagtgtacaattcaatgagatttgagaaatgtatgcaccactgcagacaatagccccaaagtataagccatttccatcaccccaaaaagtcactttgcctcttgaagattattcctaaccccataagtaatcactcttctgatttctctcaacacagattcattttgcctgtgaattcatgattatagtcaaatgaattcatttattcttcatttgaatagaaatat

SEQ ID NO: 177614 - DNA, 285 bp, Homo sapiens
agtgatttagaaaacaatgatgtcatgattctagacaagaatctagcataatctgtatggggtgcttagatgctacaaaatgccttcaatttatctgttattgtttgttgttgttaatgatcataaagaatgaggaagaagattaaaatttaaaccaagtgacttgtgtggagattcaagcatctctatccaaccaatcttccttagcctaatatggaatattaatctttatatttatctccttactttccctaacacagcattaattgcaacattttcttcatt

SEQ ID NO: 177615 - DNA, 701 bp, Homo sapiens
atttctctgaagtttttttaaaaaaatataaagagttggggttgttttgttttgttttgttttgaagcctcgctctgttgcccaggttggaaaacatgagctgagatcaccattgtactccagcctggcgacagagcgagactccgtctcaaaaaaaaaaaaaaaaaagtgtagacgtgggtgctagtggactgtgtgatagtacatcatcattaattatgaggttctttctggactatgtggacttgagttagccaggctctactgtcctggaggagttggtttttatctttttatcctttgagaagcggggggaaagggtgtataggtgcattttttcccccattctgttcctggaggtttgtagacctcctgaaacttatccatggtctctagcctggaaggatttgcggcgacagagaaaccaggtcagatgtttataggaatgggatacaggttgaataaaaggatcctgtacaagaataccaattttccatatacaatactaattgggtttagttggagcaaaagttttcagcaagctggttagatgaaggttgtggtttgccaatatacaaagtaaactaatgccacaaactcagggacaggccctcttactttatttgtcatgggaccatcattgaaggagaacgtactctgaacctggtatagactaatccatcagtcatttggtcatctgc

SEQ ID NO: 177616 - DNA, 372 bp, Homo sapiens
gagcccagcgaagtgccaacacctaagagacctcggggccaaccaaagggaagcaaaaacaagggtgccgccaagacccggaaaaccaccataactccaggaaggaaaccaaggggcagacccaaaaaactggagaagtaggaagaggagggcatctcgcaagagtcctcggaggaggagcagtgaaccgtgcgtgccgcctgctcctcactggaggagcagcttccttctgggactggacagctttgctccgctcccaccgccctcgccccttccgcaggcccaccatcaccaccgcctctggccgccacccccatcttccacctgtgcccacaccaccacactacgcagcacaccagccactgcagggct

SEQ ID NO: 177617 - DNA, 264 bp, Homo sapiens
tactctgatccagtttagttttaatggaggtgttgctgacttaggcatttgggccttcaataaatccctttatgaactacacagtgagacccccatctcaaaaaatacatatattcctgttgaaaagaatatttaggggaaagggtaaaaaacggagaaaaatacattttaaatacctatggtcagtatcagaaaaaaaatttaaatggtctagtgagataaaagttgcagggaattggatagcagaatatttaagggaaaaaa

SEQ ID NO: 177618 - DNA, 345 bp, Homo sapiens
aggggcggctccatggaggtgctttgtaacatttggtggtaaagttctccacactcaaatcaatatgtttcaaacaatatttcatgtcataacattttttttcaatgaaaataatttgatcagtctggaattcattgaatccagattatacatttatgcacggacacgtgcaaacacacagacactcacacatactcttaagtagatgtactctccaagggcatcctcgaggaaatccatgagtccattaccaggtattttatgtttcgttgtcatgggcagcttatcccaagggtaactggaacaaagtgtttaaagggaacatgaaggcgattaggtgaaaat

SEQ ID NO: 177619 - DNA, 238 bp, Homo sapiens
atcctagctacttgcgaggctgaggcaggagaattgcttgaacctgaaaggcacaggttgctgtgagctgagatggcgccattgcactccagcctgggcaacaagagcaaaactctgtctccgggggggaaaaaaaaaagaatatggaaccacatctacagaattttgaggataaagtgtttgtgaaccaaacatttttgttctatgtcaaattatctttcacatttaaagcgaagag

SEQ ID NO: 177620 - DNA, 591 bp, Homo sapiens
tagcaaccaaaatttttgagcacttgcagtacccacttagtgcttagagcctaaatggggaataaggataagtaaataagcatttaaaacagtatgaagactaagggatagagacctacagaaacaaagccaaacatatgaaaatgatgaaagatgacttgttctagctggggaagtacaacagactcaccctgacacaactcttcataccaagcagttcctgaaatcctcgctaagacactgaaatataacttcaggtccctttgttctaatgttctccacatatagagcagttatcctaaatccagtctcaaaaactcaccacaaacatgaactaagtcactttcccctgttttgtaggctaaccaatttaaaatgttagcaagtcctccaaaatcctaccgtcaactgttaaattacatttctttatgtctgctccagtttcttcacggattttaaaataaagggacctacaacaaacataaagctctgtataggagtaggaataattaatacaaagtatagagaatactctagcactggcggaaaagagttgtggtttatgtctggtttaggaggcatgtgagtctg

SEQ ID NO: 177621 - DNA, 177 bp, Homo sapiens
caactaagagactacagtgacaagctcagaagtgtagattgcaggtgtagattaggaaactgttttttggggatttaaaaaccactggagtaaatgagagtttgtgaggacagtgggccaagatggaaccccagggagcaatttggttggcaagatggaagagaacatacctataaa

SEQ ID NO: 177622 - DNA, 520 bp, Homo sapiens
agctgaaatgtaggaggtggatatggggcagaagatgaggctcaaaaagaaaatgaaaccagattgtgaagggtctaagtctctcactttctgtggtagacagtggagagccacgaagctttagccatgactaggaagttcaggctgagtcctcagtgaaagaatgagtagctcttgcaccaggagttttatttattcagaggaatagaaacgattttataaatttgtttatgaagtattctgctaagcaagcaggaggcctgagtagtgtttataaggggacaagagaccgaaaactcaggaattaaaagcacgagataaacctgaagttctgtatcttgtcagccttagtctagcgtccgccaggtcaaatctaccgtctattataaacatccgccttttcataatacataacactactgcagtttttttttaagccttttttctacaattagaatgtaaactttgagagagcagaatttatgtctcttcttggttatcataaactcctcaaagcttg

SEQ ID NO: 177623 - DNA, 419 bp, Homo sapiens
ccaaataatgtcaacctcaaactcatatactggcagttttatttccatttttatcttgtcaattttctttattgagagagaattcacacaccataaaacagcttgtccagtttccaaaaatattaattttggagagtattaccatcttaacaatattaagtatcctcatccataaccatgggatatcattctatttatttaggtcttccttaatttctttcaacctgttttgcagttttcagtgtacaagacttgcatttgtcttgttaaatttattcctaagtattttatttttgatgctatcacaaatgcaataattgcatttcagatcattcatttctactgtatagagaattgaattttgtgtactgatcttttatcttgcaacctttctgaactcattttttagttaatagttt

SEQ ID NO: 177624 - DNA, 274 bp, Homo sapiens
tttttaaattcaaattctgtataggatcctatctcaagcatctaatgttttcagttattgctatactactgatcagaacattaccactgaagctattataaaaccaatgaaataatatattattcacatttcaaaaacattttaaaaagtagatctgatcatagaaagtacccaattatattagaaatttgcttttctgtgtaatgatactttgttaggaactggttgaacactttaatccatagtgcattgcagggttggctactaatccgaa

SEQ ID NO: 177625 - DNA, 215 bp, Homo sapiens
gtctctttttggaaagaagaaattttctttttcaacttgacttgatttttttttttgaaattacactacatttaatttgtgtatgtctcggtaccagcagacaacatagtttctcatgaacttgaaataggtaatttattacaaaaacaaagctaattttgataaaagtaattagttgagagtccaatatgatttaaacctaagttttaaaaagt

SEQ ID NO: 177626 - DNA, 384 bp, Homo sapiens
ctctacaacatgcggtatgtatgatatcggtcctacttacgaggtaaccaggactaggcacatgaaagatgactaattaccccaggacactgtctccctcaacctcaactgtgggggtaatttttaaaataaaaattaaggccaaatacagtggctcaggagaagtgctcttaactcccacacgtgtttaggttttttggtttgtatttgttatttttacttttttccttttgctacatcaaaatgagtcctttataatttctgccctagggaattctaataatttatctttgtggtccaatataaaatcattttaaatgtatgccatgaatgtagtcaagtattgataataatgtagtactagtagtttgctcagtcagcaca

SEQ ID NO: 177627 - DNA, 498 bp, Homo sapiens
tcccctccacaccctccaactacccgcaaccaccattctattttctgtcactatgattttgacttaattgatatttgaaggactctgtacaacaaaatggccaaccaccttcttttcaagggtatatgatacaccttataatagtccagataattaaagggtctgaaattatggagagtatattctctgatcacagtggaattacattagagcttaagaaaaatcagataattaaaaaaacccaagatatctgaaaattaaacaacacattctatataatccataggtcaaaaaagaaatcacaaaggaaattggaaaatattttaatctaatgataacaacatattaaattttatcagatgcagctaaagcagtgctaaaaaaaaaatttatagctttaaatgtttgtttatattagaatgaagaaaagcctaaaaccagtgatctgcattcctacctcaataaattggaaaaagaaatgtaaattaaacctaaagt

SEQ ID NO: 177628 - DNA, 709 bp, Homo sapiens
ggacaggaaggagaggtgaggaaagaggaggtttccataaacaggaaaccaccaggtggccttttcacctcttaaatcttgagggagacaagcggagaaccccactcccaaccaagagagaggacctaccgtttcccaatcagcggaatgtggaaatgctcaacaggactgaagtgaggttaaactctcttcctctaattcttccccgagtggcaaggtgggttatcaggagggagaaagagcagggtggatgggtgggttgatgggaagggacatgggatgcatccgtgggatttcacagatgctggcaggacataggatggagtggggcagtagtcaaggcaagagctgtggctgtgtagaaatatcagcgatcaggacactcatcaaggcattgttcatgacctgatcacactgaagactgcctcgatgctttcatttggagggtatttgtgatgtaattcagggttaaaagcaaattttaaaacaataggacactgtaatttcactcgtagaaataaacacacacacacatataacacctacagtcacatgactggacagatatttattaaaacaaaaagggaagtgatgggactagagatgtttgctgattttccttttagcttacctgtattttccagagttttcaccagtgagctcatattcattagcaataatgtggagggggtcacagatttctctcaca

SEQ ID NO: 177629 - DNA, 450 bp, Homo sapiens
atggggcccacagtgagctcaaaaccctcatcccttccctagggtggccgggaatctgccgtccacatggagccggggaggaggagagactctgatttgctggaaggacctcattcatttccatccaacccccaggcttccctgcctgccgagctgactccacccagccctgagcctaggcacagtaaccaccttcacgtctgggagaacacacagtccccgggggccagcatgcaaaagttctttttgaagctgggtggatggagccccctccctcctgagggtgctccccagctcctgttgagcagacagcccaccccgtcgtcttggcaccagggttttgctagtggcagataaagatgatgttccagcagacgctccagtgctgccgaggttggtgtgtttattagacctgaaatgagaactgtgactctcaagctcatgggcact

SEQ ID NO: 177630 - DNA, 329 bp, Homo sapiens
ccagtcttttggtttctcaagctaccaatatgacggcgaccagcttgtaatgtccccggagtgttagccagtgggagctgctgccctgacccggcacccgctggctggctctggccctgagcaaggctgatactgctaaggccacagggcaaacggtgccctctgtgggcccctagaacagcttgtcctgtgaggggcattgtcatggtgatgagagcagtgctagggaaagtgtaatttttaaaaatgtctaaacattttgatctagtcttttcaatcttttttttttttttttttgagacagagtctggctctgtcacccagaccga

SEQ ID NO: 177631 - DNA, 652 bp, Homo sapiens
aagtagaggcctaaggtgggtcacaaacacaccaagtatttgtttgttctgcccttctgttctaaccaaggttgtagggcttcctgcactgaattcttcctccacagctctctggctctctagcttccaaccaaggccagtgttggagggaaaggaagaaggaagtgagggggaaagtcatcacggccggcatgcccatgggaactagtcagaaatccacggtggaaatggggctcagcctgcaggtgggagcagtgacgaaggaactgaatggctgatttagcgcctattatatgtcaggcatttaccaggtaaaggattaacaaaatctttaacaactttaggaagccataatctggtaatacaaatggagaagttgaggtttaaagagataacttacaaaagtccccacagaaccagcccaatgacctctccaccatccctatacagagggcaccaatctgcctcttgaccctgacgtcagaccccctcctcccaccaccccctctgcctcttcctcatctctctcaagatccatctccaagagggtcctagtgagggaccaacccaaggtgaggacccaaccacagtgtctgagccagtgtctacaggacacacgacgcgtccatcactggagctttaactagaggat

SEQ ID NO: 177632 - DNA, 218 bp, Homo sapiens
tgctgggattgcaggtgtgagccactgtgcctggcccatgttgattttaatacttagaaagaatcaaagaagattgacactagtcactgttaatgatgttttttgggttactacatcttagtcatctttgtttcctctgagaacatatagacctctcagatatagacatgggtttgttaaccttgcagtgcactaatgaggctgaaagatcatcagct

SEQ ID NO: 177633 - DNA, 402 bp, Homo sapiens
ttaacacgcgcattatccaaaccccatgagcaatcgcagggtacaggatagagtgaatctttcagggcaccaagagaaagaaaggtcagcgagtcatacattttagctcctgaaatgaatatccagcaatgccaatatattcatcaaagtgccacagtattctcttagattacagaagcaggtctcctaagagctttatactataccatttcactacttagtatatattatcttcatgatggagaagtcatttattgaaaatactccaggtatgtctggggaggggaacagtttaaactgattgaagaagacatgtttaaaaataataataagaacaacttaagaagagggacctgccttatttatctttgtaataatgatagctaggtagatatttgctat

SEQ ID NO: 177634 - DNA, 827 bp, Homo sapiens
  misc_feature (2)..(2): n is a, c, g, or t
  misc_feature (6)..(7): n is a, c, g, or t
gncagnnggattgcttgagccaggagcttgaagccaggccgggaaacaaagtgaaaccttgtctctaaaagaaatgcgaaagttagtgccaggcgtggtggtgcgcacctgtggtcccaactactcgggaggctaagcaggcggatcatttgggcttggtaggtcaaggctgcagtgagttgtgattgtgccactgtactccagcctgggtgacagagcgagaccttgtctctaaaaataaaaaaattatacccatctagtacatttttggataaagggtccttggctaggtattactgtctagtctaagcaagtatgagtgaaacataaaaaagcacagccagccgggcgtggtggctcgcacctgtgatcccaacactttgggaggccgaggaggatggatcatttgaggtcaggaattcaaaccagcctggccaacatggtgaaactctgtctctactagaaatacaaaaattggctgggcctggtggtgggcgcctgtagtcccagctactcgggaggctgaggcaggagagttgcttgagcccgggaggcggcggttgcagtgagccgagattgcaccattgcactccagcctgggtgacagagggagactcccatctcaaaaacaaaaagcatggccatgagaggtggatacatagtggcagcatctttaaaaaaataagaaaccaagtaagagtaaacaacagtcaagtggctattcaagaatgctccgggttccactgaaaatttttgacttacgagtttaacataaactctctgctcaattttttagtcagtgagaaaggcaaactgataaaatggat

SEQ ID NO: 177635 - DNA, 117 bp, Homo sapiens
attggggagctgctggccggcacccccccagccctggcaccatcaagtcagggcacagagttgcaaaggacagttgtgctgggtgttcctggttacgctgtagccaggctgtaggct

SEQ ID NO: 177636 - DNA, 174 bp, Homo sapiens
gcaggtatacctaattacattcaactagagggattaaataaacaccaaagggtcctcatttactgagatgaggctttattttttcttagtgatctcatttatctaacaccctgactttttgatttttgagtccaactagattctttaactttgccctagttctgaggtatctgt

SEQ ID NO: 177637 - DNA, 423 bp, Homo sapiens
aaaacctatgtctttctccactggaatgtatactccaagaaggcagagacttcattttgttcaccagtgcatcatcagcatatatacatgcgcctggcacatagcaggcaatcaataaatatggcaagaaagaatacctgacactgaggcagaagtacggaaaattgttgcatctccctccctgaactcccagtaagcatattctgaattaagtcgctgagactgagcatctccattcaaggacctgtgtgcttatcaccgtgcaaagtatggcaagaggaaataaggttgctctgtgtccatgagtcctcatctacctgaagtgtaagaagtcacatccctgcccagccaagctgacctgagtgcatcaagtgagaagagagacctcccaggagagctggtgggtcaccctacaatgcccca

SEQ ID NO: 177638 - DNA, 234 bp, Homo sapiens
tggggctccagcagccactttagaccatgaaatgaaatcaccttggaaacataagccaaacacagcagaacaacaacttagaagtaactgacaaatgctcatttattcattcaacaaacatccactgagctctattatgtgccaggcattgtccaggctccttggaatagatctatcggtgaactaatgagacgaaggcaggccgggcgtggtggctcacacctgtaatcccag

SEQ ID NO: 177639 - DNA, 464 bp, Homo sapiens
gtcgatctagaggatctactcctaccccagcaattatctgtgtttggttctctaccaaacgtctcatttatatgttttaaggaagttagagattcaattcaatatggtgttttttgtttttttggtgatggagtctgcttgtctggagtgcagtggcaccatctgggcccactacaacctccacctcctaggttcaagtggttccggttccattggacttttcatgatggatgttaaaagcagatggcttttgtttcatatgttgtttcatatatcatatgtcatttgtttcatatgaagatggcttttgtttcatatgtcttgtgactcaggcccatatagctagggctaaaaagagctacaggggtgagtctgaagtgagaccccaaagtaaatcactttggaaagttttgctttcatttctctaaatagctaaggacttgggggaagtcaacagttttgca

SEQ ID NO: 177640 - DNA, 413 bp, Homo sapiens
acgttgacacttcagcttctgcgacagagcaagactctgtctcaaaaaacaaaagaaaaaacatttcccaattcatgttatcaggccagaattaccctgacaccaaaaccagacaacattataaagaaataaaaaaccagaatatcttatgagcctagatgcaaaaatctctaacaaaatactagctaatcaaattctacaacacgtataaaagacaataatacagcttggtttttcccaggaatgcaagattggctgaatattcaaaaatcaatcaatgtaatttaccataggtcagaagggtaaagaaaccacattatcatctcaatagatgcagaaaagcacctgacaaaattcaacatacactcacaatgaaacctctaagcaaacaaggaatagaacatcctcaatgg

SEQ ID NO: 177641 - DNA, 598 bp, Homo sapiens
acggcagtgcacctgttgctgaagtcgatctagaggaccccggtatgctgtcggccagcattaccctgataacaaagacagaaaaggacactacaaggatgacagagatttttaaggtacaaatgatgtattgttggaattgaaaatacaggctttgttagtacaaagatttgtgtgtggataggtggatgtgtactggtgtgtgcatgcatacatatacaagcttaacttgttttattgcacttcactttattatgcttctcggatattgcagtttgtacaggttgaaggtttgtggcaaccctgcaccaagcaagtctaccagtgccacttttctggtagcatgtgcttattttgcacctctgtgttacatctttgtaattcttgcaatatttcaaatgttttgttattattatatctgttatggtgatctgttatcagtgatcattgatattactattgtcattgttttggggcatcacaagccatgctccaaaagacaatgagcttaattgatacatatgtgtattcgaatggttccatcgatctgcccttcctccatctcaccctctcctcaggtctgttttctgagacacag

SEQ ID NO: 177642 - DNA, 1071 bp, Homo sapiens
gctcttgggaatgggagtcttcctccatgtaaatacatcttccatgtaaatgcaagtcttcctccatgtaaatacatcttccatgtaaatgcaagtcttcctccatgtaaatatgtcttgttttaggcatttgaacactgcctcctccgttggttttgaacttgggcatcttctagatgcatttaatgtgctgaggccctttagtagggtactttactatgttgcttttctaaatattattacatgttcattataattttctagcttacctagaaacctgagtttaaaatgttactggtgaactagagtgtttttgttgttttgttttctgttgttagatgaacagtttttattatgattagacactgattttcatatagggtttatggtttttttccctatgatctaaatgtaatatataaacatgataatattcagtcggttttgctttctaataatcctgtttgctccaggtgttttaacattgtgattttttttggaggtattttatgtattagtgctttcttttattttttgtttttctcagtcagacttgctatatagctttgctttagttatcatctcttttcaaggaaccagctgttctacctttcttctaatcattgtatctttcatcactattcctttttaagaaggttctaaagaaagaatatgtcaaatactttgattaaagattgaaaatatgtccctatgtaaatgaactgtagaactctgaaaacaaacatttaaataaaactattaataaacagtgagaccctttctttttttattaaaaaaaaaaacactaaataaaactatttatattgggtagcatagggtaaaacacagtaatacttctgattgtcctcactgggaatttgaatacttttcatgtattacagagaggaacaagtaacctggctgaaaataaaaggatgtgagtcaggaaaataaaataataaagcaagagagcacccaaagccttggcttgcaagaaattgtgtattagatactatggtttttatatgtacttattgacagagaaagtggggatctattgcttaggtaaca

SEQ ID NO: 177643 - DNA, 171 bp, Homo sapiens
ttttgttttatctatttttttatatgcaaagttttactgttacccaagctggagagcagtggcatggtcatagctcattataaatttgaattcctaggctcaggtaatcctccagcttcctcagtagctagtactacaggtgcatgccaccatatccagttaaatactttg

SEQ ID NO: 177644 - DNA, 546 bp, Homo sapiens
aaacctgtccatatcgaatggtaatacacacacacatggaataaactcacctacctttaatctcattatgatatgttaaatccctgcactagaatacctaattataatgaatctaccacaaagtacccattgattttattcatgttgcacgtatgaataagaatgatagccatgtttggctcttcagaggaataaatcatgatttttctagtgtgattaacattttaagtcaaaatgattatcactctactggcacattttaatttgggctctattacccttcttcgattttacaggatatcttaataactagtggagcgggtgcctttcatgatacaattttattatattgtaaatttttaaaatcacttttgagaataacaagtgattaatttaagaaaactgtatgagaagctcaaagatttgcatcttttgcaatctttttagtatatttcactgagtaagataaaggaaatacatcatgtagccagaaattatcagtagcttacttctctgatagtaggtaattatagtgggaatgataaa

SEQ ID NO: 177645 - DNA, 176 bp, Homo sapiens
attgtagtcctcctaacaggcatgaagtggtgtctcattgtggttttgatgtccactccatcttaacgggtaaacttgctctaactccttacccaaatctctaaaccatttgtcaccctctggatttgttcatctgtccatccatccatctgcacacacatacacactgtatacac

SEQ ID NO: 177646 - DNA, 275 bp, Homo sapiens
tttgcttttgatctttactacatgtatgtactttaaagactggctggcttgccttaatccttgaggaggtctgagaaagtcatttagactgatttttatcctatgtttatgaagataatgggaatgcaggaactaggataattatatatatttggttacgtgcatcatataattgtcttggatgtctatatatagaatttttcttaatggaggggggggcttcttttgtccctttgaagagtctgctggccttaatttaagtagtagaggtgttg

SEQ ID NO: 177647 - DNA, 942 bp, Homo sapiens
  misc_feature (290)..(290): n is a, c, g, or t
  misc_feature (381)..(381): n is a, c, g, or t
cctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaanggattttaaagcagctattgatcgggaaggaaatcaccggtatcacttcaaagcactggatcctgagtttggcactgtcaaagaggagatnttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaacaattctgtccaaactgtagaccatgggttcatctggagtaccttggtccgtgggacaccacagtgttctatactactcttgaggacaacaaaccgaaggccttaacgatgcggattggttgatcccgcctctgtaggggcatgggctgctattatctggacacttcggactgggtgctccttcctgtgtgtacacgtttattttaattgcctccatggtgcgaatcagaggccgcgttgtcctcccgacaggcaggtaccgttctgtcttgacctacgcacagaatctctggggcccgct

SEQ ID NO: 177648 - DNA, 293 bp, Homo sapiens
tacctttataatgaaaaaaacagaaccaacacttgagattaaactctagtaaaccactatttgaaccaaagcaacttacatcttgctgtcctagtaaccatctactcaaatattctgtatgtaatgatatagctatcaccagttggaagctgagtgagggtgttatatgacttaagatctttacgagctgggcatgatggctcatgcttgtaatcccagcactttgggaggccaaggcaggcggatcgcttgagcataggaatttgagaccagcgtgggcaacatggtgaaac

SEQ ID NO: 177649 - DNA, 367 bp, Homo sapiens
cagccagcagaagatgctgaagaacagcatggtacaagtcactgttctatgagtgccttttccccatggctgcctgcttgtcacctgtggatgtgattaagtgacatttattcatcctcccaagatgttgctgagcctatcctaacttccccaattgcccaacctcattactccttttcaacggccctggacaggaataggtcctaggaacagagagggaatcctgtaagtatcaaatgagcacatgctgtgggcagagtccggctctacctggcctccagcagcaaccaaatatctacagccatgcatgggttcccactgagtgctttttgtaaatactttttgtaggagtccttagctatggccg

SEQ ID NO: 177650 - DNA, 473 bp, Homo sapiens
tacagtttttcaatatatttttaatgaagttatttatagcaagtgttatatgtattgaatgaaaatttagttatgtataagtgaagacgaaagaggctggtggatcttaaaatatccataaaccagattgatatactatatattttagatattagaggttgatgtacttcttttctcacaaatttctgtaatagtatgtgaaaagatagagtaatattttctaaaataagagaaaaatttaaaaatgggagaaaaatattagaaaatgtaaaatagaatgccttggatataatttttagtgaagtgaataaactttgtatttcctccttctgatatgttatcattctagaccatctttagctggtcagattcatcatactccaatttataaatgtttaatttaagtcttctaatgcattttaatgaacgattttcttctatttgttgtcaataaaaattctgattgatatgaa

SEQ ID NO: 177651 - DNA, 226 bp, Homo sapiens
gtacttagaataaatacttggatgtgttgggaatggtagggttgaattccctagaggaatacaaatttaataaattggagagcagtcatagaactcttatcatgcctgctggtttactttttttctgtaagcctctaattgtaagcaagtgttgattttgtttcctgagaatatatcttctataaagaacaaaactatgatgtattgagcacccttatcccagact

SEQ ID NO: 177652 - DNA, 267 bp, Homo sapiens
taaaggtgcattcttgaaagaaatttagagcattggagaattttcaaaataatgtcaaataagatgtaagctccccatagaaagaaatgtattgtcatgtttagagtccacaggactatattagcaaattaattactgttttaatgacttgcttccctacagcgggagactggattatttctcccaatttttcacttgcataggattttacatccagatcctctgttttgtaagtctgtaccgcctcctgctataaactgagtatac

SEQ ID NO: 177653 - DNA, 230 bp, Homo sapiens
caggaggaggtatggcgaaagggaaactagaatatccaggtagtaatgcaagtataagataattagagggaggttgctgatgtaagtttccaacaatagaatagaagaatgctaaggaaaaagaaatgaaagcatttgattactgatggatggtgacacattcaccaaaattcagaatttgaggagagttctgtctcagacataatgactttattaaggtctccaggtgg

SEQ ID NO: 177654 - DNA, 112 bp, Homo sapiens
gttggccatagtaaaaaatcaatacaaattcaaagaagcaatgtgtattttataaaaggaataagaagcacttacttttctctcatagctttggcgtttttttcattaacta

SEQ ID NO: 177655 - DNA, 420 bp, Homo sapiens
tatccaacatgttgggtgcaaacgggcaccttttagccttttcttaaatttgcatgacctgtaatgtctatacagattatgaatgagcctgaggagtctgcatgtctaacttgtcatcagcctggaaaaatcaaaatgtgtaggtaaagtgagcacaagatttggaaaagcaaggtgtttggatgtaagagaataaactcttagcccttttgagcatgagttcctcagctgcagaacaggattgagaatcctcacctgaattggccactctgaaagtgaaagctagctagataaaagtgctttgaaaaggtaaagaaaggtgatgatttaaagctggttaatgctgaattatggaggagctctttggaaattcttttttatctatataaatgacagaaatttagtgtgatccatgtggct

SEQ ID NO: 177656 - DNA, 624 bp, Homo sapiens
ggctacctagaggatcccctcgaatcgacggtttctcaaaggttgtcccacaatgagaccactgtagcttgacatgcaattgtaagaagtagcacagagactccgagtacactttgcccagagcattaatctcctgcagttaccttaacaaagtatcataaattggttaacttaaaacaacctaaatttatttttatcttttcgcagttctggaggccagaagtgtgaaatccggctgctggcagggcgtggtccctctgaaggctccaggaaaagagcacttccttgcctcttccagctccggtggtgtaggccatcttctcactccctggttcgcaacgcttggctcccacctctgcctccgctgctgtggcttcttccctgagtctgtgtcctcttatggacaccagtcactaaatctagggcccaccctaaatctacgacgacttcatctcaagatccttaattaattacatctgcaaagatcctacgtccaaattaggccccattctcaagtcatgggtggatctgaatttgggaggacattttttgtttgttagtttagtttccatgaatgcagtgcttacactgctctattatttgctcttgaaaggaaaaaaaaaa

SEQ ID NO: 177657 - DNA, 182 bp, Homo sapiens
ctagtgatgtaaactccttgttcacattgacagatgaacctttctcctcagtatgaatttttttcttcatcttgtcttttttaaatagaggcttgtttttgccctcagatcctggggtttgggagagagtgatatcaaataggaaaaaataaaacctttaaggcatcactacaaataataaa

SEQ ID NO: 177658 - DNA, 470 bp, Homo sapiens
tgggctccggtgtgagccacatgctcttctgccttggcatcatctctgcaagtgccacacctcaggtccagcccagagctcctcaggtcgcatggctggggctccggtgcaggtgtcctgagtccttgctgtggacctagggcagtgccctaacctctctgctgtctcctcgcgtgcaagcaagaatgccgatcccagtgcctgtctcagaaccgaagggttgagcacattcctgggacagggcaacggcctcctgagcaggaatcattactgccttccaggttatttctggggtcaccaacgcctttccgaggggacgcaggcagggaccggtgcgaacggaacacaggagcccgtgtgccacaggccgcaggcagtttcaggtgctttacaggagcccctgccatacccggagccccctctgcctgcagcccgaggcctggctgggggctgggtggaggccgcggccg

SEQ ID NO: 177659 - DNA, 418 bp, Homo sapiens
accaaaatgtttaaaatgtacttcccttccttttgacatgtctttgaacaatgatcatgcatgttggttgagtctttgactttgctggccctatgccatttgttgagatggatgccctgtcaccaagatgtggcttaaatcacactgatgaataaagtttacacttcgaaggctctcatttgcagatgtgactaagcggattcacatgatcctgtgcaacctaggctaccaccaagtagcagagaacaggaagagacaaagaaaaattagacaacaatgtcaaaatgttaagcccctgctgtcttgagtggctggaggcaccattagagacttggagcctactccaggggccaggtattttgtcaacaaacttcttatcctgttcagttatctctcatagatgctggcttcatatatg

SEQ ID NO: 177660 - DNA, 332 bp, Homo sapiens
tttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttct

SEQ ID NO: 177661 - DNA, 527 bp, Homo sapiens
agcagtcggggagcagataggagcatcctagctctctgtgattgccctggacaggagccctggacctcccaatgagaaaatgacttccggcaggcagggatcctcctatcatgaagaatattaggccacctcacaccccctcttctcctaaatcaggagactgtccttaaatccagctccacctgggacttcctcagtaaccttcagcaagacgcctctcctctctgggtctcacctttcccatctataaaatgggctgacaacgaagccaccactaaagggccactggagatcccactgcaatattgcaggtgagagcgccaatgtacaatagcggggttcagcgggtcactgtaggttttatcattcattcagcaaatatctacaaggccttccttcctcaagcacttcgattctccggggccagtgctttgaacaatagcaaaaacgaagggctcctgaccccaggcgtccacctcctcccgccctcctagacctcgaggatgcagagaccctctagcggccgc

SEQ ID NO: 177662 - DNA, 402 bp, Homo sapiens
cttgaagtggtattggagatggagagattttgagtagctcccagagctgggagtgatattttggaatctaggatctgccaaagaggagacatggtaaaccactacattttggtattggtagcttaaaggactgtaccctgtaagaaagagtaaactggaaatagatttgctttgagaggattgacatataactataaattatttcagtcctgaaattgagtgaaggtgattcaactttgctagttttctaggagcttgctaaaagcaaatgtaaactcactctaacagaagattatatcttcctagacctcacattacctcagttttcatgtgttgtgtccaggacttgttaaaaaatgagtacacaaaaattcaacactatgtggccaaaataatagagga

SEQ ID NO: 177663 - DNA, 559 bp, Homo sapiens
aactgtgatgagaaacgcttctgtccattaaatcgttcagtcagtggaagagacatgtatgtaaataggtaagttacctaccatacattgtgccaagacctctcacattatgtgaacagaatattaaagaattataaaagagggagcaattgcctctgttaagtagacagcaaagatgccttataggaagtagcatttgagacagattaagtttctttttaggtaaaaatatgtcccctagagataataataaaataatagcaacggatacctatgtacttcttttactaatgcaccagagtctgttttacatatattctctcatttaatccttacagcaaccttatgaaacagtactgttatcaccttgattttacagagaaggaaagtgagccaaagagaggttatgtggcatgcccaaggtcatataactattaaatgtcagtgctgggatctcgtacattttcactcttaggacatctgtgctatccctgcttagtcactttggcatcccagtggtgctgtacttttgctttcataatacatggaagccctggaa

SEQ ID NO: 177664 - DNA, 483 bp, Homo sapiens
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccg

SEQ ID NO: 177665 - DNA, 468 bp, Homo sapiens
tcagcacttgaaatagattgtcttagtggcccacagagaatcagccaggattaggacgttaatttcctgatacctgtcctagggccagttacccaccaggcccgtctgcaccccactctaacattgttagttacataaataggaaccagtgttttagactgttgggggaggggggaaatcagatgcccctttgtacactaattaacgcaggcagaacaaaaggcccagcttggttttcaagttcaagtttggctcatatgtggtcctcagtgaagattatgatcttgaataaattaaaaacaaatgttaaagaagtcataatgaggtaaaaaaaggagttcaggattctggcctttaaagactcagggtaaacagacttctctttaaagctgatgttcacctcccctcctccactttaccagtccctctttggaacttctgtgttccgtcttcgtgataattgttcat

SEQ ID NO: 177666 - DNA, 173 bp, Homo sapiens
atgttgctctctcaattccttctctgagatcatcaagggtgaatgtcagcgttaaacttaagacatgcacccttgatgatctcagagaaggaattgagagagcaacatcgagaatgattgacagaaagaatgaccaagataacaacagttctatgattgatataagttacaaa

SEQ ID NO: 177667 - DNA, 176 bp, Homo sapiens
taatttttctaagtaatattagtagttgccagagtacaattcttgtaaaactttcactaaatttattcctaagagtttgatgggggttttaatgtgatatttcaaattggttattgctggtatataaaaatacaattgatttttgcaaatgcacctgtttagtttgtgacaatctg

SEQ ID NO: 177668 - DNA, 292 bp, Homo sapiens
aggagcaaacactgggagcaacatctggcccaggcaggaggctggctcagagaaggctttcctgaatggcctctccctggagggtaaacagacttgaggaaaatagggtgtgggaaggggctggatactagggaacagaccttgccaacaagaggtacagcattcacgctggctggcagcaagatggtgtgccagtggagacagcagaagctggataggtctagagcgcaagaggagccagagaagagacataaatcaaaattgcattttttttttttggagacggagtctt

SEQ ID NO: 177669 - DNA, 238 bp, Homo sapiens
tcaaagtttgcactaaaggatagcgccagattatcaaatttatcaatatatcaaagatttatcaaatataaccatactgtaggccattttgtacatttatatgtaaaatctagaaggcataagtattctgaagtttgtaaagttatagttggtttggtacaatgggctctgtcatgtaaaaataaaagcaagtgtttccaaattttttatcttgtcgccatgcaataaatctttccct

SEQ ID NO: 177670 - DNA, 582 bp, Homo sapiens
caaaagacgatctcaaacagaacacaagccaaacaaaatggtatgaaaaccatcatttggaacctgtgaattccagattattactcagatgatttccatactcggggacattttattacctgaagaatttcattatatatggacatcacaaaaagtatgatgtgtaagttgtccaaattgcaaacatctaccagtatttataagagatctgctgtaaagaaacccaccttcttggcattttctattcttttcttgatgatgattcctccttagtgcaacccaatcgtcccttctgcctggtaaggtgacgatctcaaacagaacacaagacaaacaaaatgggatgaaaaccatcatttggaacctgtgaattccagattattactcagatgatttccatactcggggacattttattacctgaagaatttcattatatatggacatcacaaaaagtatgatgtgtaagttgtccaaattgcaaacatctaccagtatttataagagatctgctgtaaagaaacccaccttcttggcatattctattcttttcttgatgatgattcctccttagtgcaacca

SEQ ID NO: 177671 - DNA, 461 bp, Homo sapiens
ccccaggggtttagtgtcagtcattaacgaatgacttggtgggacctctgctgacatcctccttgagcctcaatcaatgtaaggagactgtaaggatctccacactcaagacttgcctgtgctcctttccccgtagcctaacccatcatctggcctctaggcatgtgtaaggatgatgagttgggcagggcaagtcattctggagggatgccatgaagtcgtcgtccaggcaaaatggatttagacagaaagcaaaagtcagtccctagagcaggagagaatgtggaaagagaccagtctttcagaaccgcacacctatgcctgcctgcctaggtggaaagtccaactgcacggagacgctgaaccgaacaggcaacgggcccacacaccaggccaggaaacagtcacttcccttcctttgtctcctaagacctgcacgtgttttccctcatttgaaggga

SEQ ID NO: 177672 - DNA, 488 bp, Homo sapiens
tcactttctaacggtgtgagatgatatctcatagtggttttgatttgcatttctctgatggccagtgatgatgagcattttttcatgtgttttttggctgcataaatgtctaccattcgacccagccatcccattactgggtatatacccaaatgactataaatcatgctgctataaagacacatgcacacgtatgtttattgaggcattattcacaatagcaaagacttggaaccaacccaaatgtccaacaatggtgtagaaattgaacgttcaatttctacacattcctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgttt

SEQ ID NO: 177673 - DNA, 335 bp, Homo sapiens
tactgaataaacaggaaatcatgattctatatataaatgaaataaattgaaagttttattaggaattggatatttatataatttcaaagtacttcgccacaaaattcttatttgtcaggaaggggaatagagcaactttacataaagaaccttgcagaaatcaccttggtcaaatgatcagagtaagcatcaccagccaatgagacaaattaaaatcatactccatctgatagaatgaatgggatgagaaaaacagcatcacttctataatattcttgctcatgatacatatcctaaatctaatcttaaggaaccaccagtcctgcttatctcct

SEQ ID NO: 177674 - DNA, 651 bp, Homo sapiens
gcagatctgacggtttctcgaagctgggcccatcaccaacaagacagtgatggtgaaagcaatgatagaagaggtcgaatttagagtaaggatcaggatggacaggtgggtacatctatgcaaccctaacctttctgaaactactaggcatagatattcctgaagactagtctcagcctgcatggatggtccctcatggctactgtctcatttgaaaagtgaacctatgaaaagaggaaaacactatgacatccaccactgtttggtcacaccaattcttgacattaactctctcgaaggacattagtatgaccttcaaatcctagcccgcaggaaagcttcactttagttgtttgtttcctgggtgtcccttcctacaacccacgaggcaaatgccacacaccctccttacatgcataaaacagtgctgataatggatgaaacacacaagtatcagctcatgcctgcactttcagagaaaacactcttgcttagaccatgggtatgtcaagctgccaaggatacaaaaggtaaaacaatccaagggcaacagatggttcatgacaaagaactaagagggcagcactgcgattccaaaaatttggatatggacgtcaatgagagtgaatgagagagaaggagagagacaga

SEQ ID NO: 177675 - DNA, 278 bp, Homo sapiens
tctgcccgtcttctgttgccatcacgcttgtccacaccctccttaccccttgtctgggtgattgcggtggtctcccagctgccctgccagcgtctgccctggtccctcttcttgactattcttgacccagcgccaccatgttaaaatacaaatctgatcgggtaactcctctgctccaaactaggtttccttgtcactccgagtaaaagccaaagtccttacaataacccacagggccctgacctgccttgctctcccctgtttgcctctttctgctc

SEQ ID NO: 177676 - DNA, 891 bp, Homo sapiens
taagcattacatgcaccttccaggtgatacagcatcctagatatccagagagattaaataactcactcaagtacacatctatgataaggggcagggtgctcacagctgtcaatgaaaccatcttcacagggttaataagaatgacattaatcaggtgtactttggcccacttccttgtaactgaaagtcatgtagctctagatacggaccatttgcatcgtcacttttcctatagataggatcactgttgttagaatcataaggctttcctttaagaattgtttaagatgttttccagatcctgaattccagctgacacaaaccagttttaggaatcccgcagggacattaaattggcatgagaatgcagttttttcatttccccatcccacgattttgtcttgcattcttagagcaatcaatgatcttcatgccatggcccattccaatccccttaaaattcctatccccgaactcctcagggaggtgtatttgaggtttgctcctatctcctcattcagcagccttatagttaaaactcttggccaggtgcggtggctcacgcccgtaatcctagcacttcgggaggctgaggtgggcggatcatgaggccaggagatcgagaccatcctggctaacacagtgaaacccccgtctctactaaaaatacaaaaaattagctggatgtggtggcagcgcttgtagtcccagctacttgggtggctgaggcaggcggattacaaggtcaggagattgagaccaccctggccggcatggtgaaacctcctctctactaaaaatgcaaaaattaggctgggcacggtggctcacacctgtaatcccagcactttgggaggccgaggcgcggggatcgcgagatcaggagattga

SEQ ID NO: 177677 - DNA, 234 bp, Homo sapiens
gtgggaaaaaactggatgacactgaaaaccttcatcagcaccagaagcagcacattggagagaaactcgagagaaggggtgccagagaagtgtcatttgtaaacagctgtaaagtccatgtgtcacaggagccatttatctcttatgaggttgggaagaacttcttgcccagcttgggattacaccagcaagaggctactcacaatgtagagaagacaaacactgaaactaagc

SEQ ID NO: 177678 - DNA, 143 bp, Homo sapiens
atatacaatcagccggtaccctcgtataaggcaatgatgctgaacatctcatgtgcttgctggccattcatagctcttctctgatgaagtatacattgacgtcttttgtggttttcttattgggtgttggtccttttattgag

SEQ ID NO: 177679 - DNA, 190 bp, Homo sapiens
tgaactattcttgaccagttaactaatgccttctggtaaatgagagctccctcgcacattatttgtattgactcctcacaaagatcccacatgaaaagtgagatgagaattattatctctgttttacagatgaggaagccagaccaagggaggtgagatcatttgttcattcccaaacccagtcagtcag

SEQ ID NO: 177680 - DNA, 555 bp, Homo sapiens
aagaacccatcagctagtaacattctggcaacccagatggaactggggttcccagacccctgacttaatggacaattctccatagtagtagacaagaagccccctgagcactttctgtggtgtctctgctacctagtgagttctctgacagctcagagattacaagggcaccccttgagcaatgctgttcaccccttccctttcctccttatttgtaattgctgctctgatatctccttactctacttttccccttttcctttccttctcctgtagccccctctgtccttctccaacaaccctttctcttttactttctacttatttggctgaaatttaatagccattggctcctgggttctttctgttctggtctggtcagttatggctgaaatctgacagcctttagctctggaatactctcctatttggagagcaagagttgtttgaggaaaggaaaaggggaaaaggagtgaaaggggattccgtagcagcaattttaaatgaggaggaaagggaaggggtgaacagccaatttgaaatctgagctctcaa

SEQ ID NO: 177681 - DNA, 410 bp, Homo sapiens
tcatcagctcgcaccgttaaggtgcagtgcagagctgagcctaggttcaagtcctgaccatgctgctcagtggcctgtgagcttttggtgactgatggatcctctttgcctcagtttcctcctccataaaaatggggatgaccacagtgttctgagcactttagagagtgccaccggacggccgactcatttaaacccgagaggctcctgctaggtatttatattagcacttaatagacagaaagcacctcacacagcactgacatagcgccgtgcttagtacatggtaatgggattgcatattgtcttacccaccctacacaataggatgacttccattctacagatggggaaagcaaggctcaggagtgttaggaacttgcctcttgtcacctggccagtgcactgga

SEQ ID NO: 177682 - DNA, 331 bp, Homo sapiens
tagctctcaccctagcattaagaaatgacagcatcactaggtgttaatcaatacccaacagagaaaaagtagtattaacaaggtagactaaaactaccctgcataggttaatgcaggaaccaagagtgaacaagcctttcccagcagtaggaactgtcacaaaccctacaatttgctgtggtccctttatttagtgtactgggagtttttgccattagcttgggaatgacctttagtaatgaagatgactccaggaaaattacagaaaattattctttaaaaagttatcacattggatctatctttttattgtcaaacatctaccatcaga

SEQ ID NO: 177683 - DNA, 165 bp, Homo sapiens
aaaatatggaatgagctttctcttcctccagaagtatgacctgagcagcaaggggaaggccattcctggggacgttggttgcagagcttctggtgctcagggctggagggtggtagatatttgacctctgtactcatgtgaccccctccccgccaagacctgggg

SEQ ID NO: 177684 - DNA, 473 bp, Homo sapiens
ggaggatctatcgcttaagtccagaagttcaaggtctgcctaggcagcacagcgagatgccatctttaaaaaaaaaaaaaaaatagatcagattaaatcatttcactaattcgaagactttcgatggctccctgttcacacattgtaagtgaagtctttactttggcctgtaaagccctcaatgacacaacttcccatttcctctctgacctcgtctcctaccactcttcctttcagctccaatcacgttgtcctccttggtattcctcaaatactcaaaacacagtcccactctggggccactgcactggctgcttcctctgtttggaatctcttcccccagatatcccataattctggggtccccagcacctgggccacagatgggtaccaggctgcacagcaggaggtgagtgcttcagcatcaccgcctgagctctgcctcctgtcagatcagccttggcattaaatcc

SEQ ID NO: 177685 - DNA, 401 bp, Homo sapiens
tcagaggttcactggagaagggggctcagtatcttactgttctgagaatgtgttttcactaaatcactttgtttttgtatggctgtgcctggttgtccccatgttctatttaactttgattgaaactggtgtcttctctgagggttgggcaatggcagtcacttggctatacatatagtaggtaggttctaaggcacccagggcacctaaactgccttttatttagactttcaaccaattcccctctttgcagcccccgtgcaccctcattttctgagatagccagtaactctaattcttgagccctgctaggattctgtggcacaaattttcttctggcgttttgctagtttgggcaactgtctttcaatcatgtgctttccagattgaaaaaaaaaata

SEQ ID NO: 177686 - DNA, 551 bp, Homo sapiens
cgtagcatgattttaatcgacggttctcaaagtgaaatcaggccaggaacattagcatcaccgggaaacctgttagaagcgcaagttcttgggcctatcccagacctcctgaatcagaaattttaggtcttttaaaggttctgtatgtgattgtgatgaatggttgatgtttgaaaacatgattttcagcaatgaggaaatgtaaggatgttttcaaaaacaatgaaataattcttcattagacaggtaattcagaaaaggaccaaggaggaaccatgaattcatgtataatatctggatgggtaccaaccataattcccttgatgtgcttggcttttctttgacagtagttaatcaatgtaataggttactctacttaaagatccaatttgccctacacttcatcttggcaaaatactctgaactaggcttacattttaaatcttaaaaaaaaaaaagaatttttttaaaaaaaacaggaatcttctaagttttatacctcattatggactgaatgtttgtgtccccccaaattcatgttaaaacctaat

SEQ ID NO: 177687 - DNA, 221 bp, Homo sapiens
tggcacctgagcaatggaggggtagaatgaccagagctccagagcgtgagcattcagagttgactgggccagcccctctgaggaagctttcctggagccagctctgctgccttcagcctcgacaacctggatttaagtgcatatcttgtactggaaagtgacttaaaccccttccctagctaaatctgccgatcagaagttgctatccttggcgttagcag

SEQ ID NO: 177688 - DNA, 590 bp, Homo sapiens
tgtttcctttgtctgattgccttatctttgttgtgtgccactctgtatgaaattgggcaccatgattcatgtccctgccaggactactttgaagtaaggaaaaagttcctcaaaggaaccagagaaagggaaatgtgaaattatgcttgccagagaaaagtagtagcaaccataactaatacattgcctctaagggttgcaacaaaaatgaaatgagtgagcacacttcgacatattctatatactgtatagctttctaatagttttgttttgaatttttcttttctttttgagaggcagtatcttgcatggaatcaggtagacttttggtttgactcaggtctgtcagttcttgggcttatgatcttggtcaagctgtgtaatctttctgacctagtttctgtatctttaaaatgagaataacagtaccagtttcatagggctcttggaatatttgaaaataatgcccagcacatagtaggtgctcaccaaatgcagttttccttctcagaagcttacagtctgatggaaacaagactcatataaagataactaatactctagacaaagggaaacaccgggtacgagct

SEQ ID NO: 177689 - DNA, 212 bp, Homo sapiens
tgcccattacatgaaataatgctcagaaagcagtggtacagggtaggaattcagtatggtagctgctattgtttttgttactattattatttcatctcacccctactgccagtgccccgcatgcagtaagtgctaataattgtccaatcaagaaacaagtgaacaaaggccatgttcttattcccttgctcttgtgggttggccccttcctc

SEQ ID NO: 177690 - DNA, 204 bp, Homo sapiens
attggtggtggtgtgggcaggcagataacgcacaggcgcttccattgtatggaacaaatataatctcttactggcgaattaaaataaattactcctgtctccaaaggggactgctcatttctttactttctaaataactagcgcgtcaactactgttttaggctaccctgaaattgtgtacaggctaacataaaaggtctcctg

SEQ ID NO: 177691 - DNA, 156 bp, Homo sapiens
aaattttctatctcacggggaagtttttattgtggattttatgttcaccagattaactagcttttgagacattgacagggatggagatacacagaaaatctcacaaaaacaatttcataagtcacaggtatttgtttgactctaaaaattaatttt

SEQ ID NO: 177692 - DNA, 260 bp, Homo sapiens
aaaatggaatttcaggaaaaatcactgaaagaagattattcattatgaagatagttgacatttgaggacacaaaagtcataaaactttatgttccaaataacatgagcaaaggacacaaacaggtaattcacaaaataagaaatatggttcagtcttgttgatatcatagaccaggagtggctgtgggcggggcagtagccacattgcttctgcaagtctgagaacactactgttgcctggtttgtctcacaggcttgga

SEQ ID NO: 177693 - DNA, 399 bp, Homo sapiens
tgggcagggtgaggggtgaatgaccatcacaagccaggaaaagatgggtggcaggacctctttcaacaagaaaggtgccaaaaccctgcctagttatagaatcaacttttctacttcacactcagatcagaatttattaatctttaagctgaatgttttgacccagagataaagggatgcttctttttgccagaggattggctttggccccctctctcctgctaggatattagaggtgggtggaagatggacggtctcctggtacctgcccaccctctctccgccctctctttgacctggctgagatgggctgagattgattacagctaagtcctgtttctgtcagagcctaagcttgggctgccatgcgcgcgcacgcgcacacacacacacacacac

SEQ ID NO: 177694 - DNA, 372 bp, Homo sapiens
ggagctcagtggaattcaactctgcttgctctgcccagagctccacgtcaatccgctggtcacttggaaggaggaaggccctgggagaggggtgcaaagccatacaaagaaactggtcaggcagaacagagaggcaggggctctgagaccctgatgggcaggtggaggcttcttccatgactcccgcacttcatgcacccatttggcaaactgtcccatgtgtgcctgagcaaatgtggctgttgtggattctcgtttcataatggccccaaaacccaggaacagactctgggccacggcgactcaagaagtgaagagtggggctcccactgtggatgccaggagtcaaggtgttgcttgaatatggggcca

SEQ ID NO: 177695 - DNA, 469 bp, Homo sapiens
tgaaaggtgaacttgggcactttgcagcaaattggagggggttcattctgcttctgggcggtgcgcccttggattccaatcattaaagcttttttgaggtacttgtcccagatcacctgattttggctcaggtgttctctgagcttacctcacacctcaggacacatggttttaacatctgccctgttttctggtctcttcacaagatggtggtttcccttcaactgagggcctgtgcctcagtttccccactgccacctagaagaggtgcctgatcaatgatggagtgcatttatttaaaacatttcaatagcatccaggcctgatttcctgtgtttaatgacatcattgctgctccccacttttccttaatattcagcgggactacaattttattttatttgtgtctgggactagcagtcatgttggaaagaccattccttcattacagataataagccaggggcca

SEQ ID NO: 177696 - DNA, 442 bp, Homo sapiens
atccttaagaaacacaaagatgagattgaagagggaatctgcagtccttgactatgaatggcagagttctgctgtagagtgtagaactggtggaatcccacaacaggaaggaatatgaagacaagcaacagagtcattatttggagaataacagtgaaaacagccaagcagataaactctgtgcaccatggcccactcacccaaacttaccctacacacactaggatatcttctaggtgaaagcagtaaatggaggaggttgggcatgagaaggaaggcagtgcccccagtgctagtgatgcccagaaggacaaggaagcatccccactactgccctcaaagtcctctcacctctcctaactctcactacaatgtgtggagaagagcactatcagaggtggatacagtaccatcttccctccaacatttccttgaacatcaa

SEQ ID NO: 177697 - DNA, 547 bp, Homo sapiens
ttagaagaaatacaaaggggcgctttctcacaaaaactgctaagtacccctagtctgtctgacactcatcttctgatattcatgttacggctctaggaacctaagttcccactgacccctaatattccgcattggcattgtgacagttttgctgttaggagcctgcatcgtgaggttggaagaggtcctgcctccataacatcgcccaggatctctgtgcaggagttgcagtttgggtttctgaccagagctgttgtattctggttcctaaatgctttatctgtctgtcattggtctcagtatgtgtgcgcaagtgtatcagtgtgtggtttgagtagtcttttgtgggctgtggaacagctttgctgcatttcactctggagtggattttattcctctggtggaaatactcattcttgttagcagagggcttagtttttcaacactaaggtaccctctctgtgagtgatcatcagactgcagctgtgaaacctgtcatgacctttacaccaagagcttactatgtgcctggtgaattctataccca

SEQ ID NO: 177698 - DNA, 339 bp, Homo sapiens
aatgagttgacatgtaagccctctttttaatttattggagagtttgtgaataattgatgtttttttcttaaatgttcagtagaattcaccaatggaatccatttgggcctggaattttctttacatgaaggttataactaaaatttctttagtagatataaggctatttaaagttttcctattttcttcagttgtttgtcttcaaaggagtttgtccatttcatctaagtcctcaaatttatagacctagtgtttcatgatataccctttttaccttttgtaatatttgtagattctgtagaaacatcatatctcccatttctgatatctctacctaga

SEQ ID NO: 177699 - DNA, 479 bp, Homo sapiens
ccaccctcaggcaggtccttgttgcagagctgctcttgggcttcctttcatcatggcgggtggcaggagcgactgtgcctgctttgtctgctgctgtttccactccagatagtctagaactctggcttcaggaggctttgcatcccataaaagacttgccttgctgggcttgcactcccaggctttttaagggagtgatttaagggactctcaggacaaagttcacggggctgccttctgtgagcccctccatgggaaatcacctattcttaagcacagaagcacacatctcttcatgcagctgcatgcaggtgctccttctgtgttctggcacaactttgcaatctcagcttccagcatgaaggagcctgctcctatcacagctccccctcttggccccactctgtctggactctcctcccacctgaattgcattaaggaccctgcaaagctgaaggtgccccctgctatatggccca

SEQ ID NO: 177700 - DNA, 579 bp, Homo sapiens
aatcacttgaacccaggaggcacaggttgcactgagctgagatcgcgccactgcactccagcctgggagacagagcaagactctgtctcaaaaaaacaaaaggatgttatttgccttttccgctaatagagctgctgacaccttagcacaaatcagggcagtgggatgaaattgtactagtcatcactgtgttcttcacccctgtgctcacacaaaaagaaaaaaatgctgttttacagaagaatggccttgatgaagcagtgaaaaatatctgatgtgaagacatgggaagggcatgttagccctgctgctgcacacctagacacgatgtcttatcttgaggaaagcactatacagttgagttgcaaagctggactaaacactttttttcatggaagaccagctttacttgaaagaacagctggcagacatactgttcagagttgcatatttggtagacattttctcaaaagagaaagaggtgaggctgtgactttgaagaaaacaactgtttgttaccggtataaaattcgagttttcaagcaaaaattagaattttgaaaaacttattaccgtgat

SEQ ID NO: 177701 - DNA, 253 bp, Homo sapiens
tacacactaaagctttcagaatcatttgtagaaacacaactgctttcagatgataattcttaattattataaaggacacaaaaattagcatactgtttttctgaggttcttcctggtttttaacttactgcacaagttgggcgtaatgtgaaagacaacaaatatgggtataatcatacacctgatatatatggactttaagaaaacaccaacatgtatacacagatcaacatctccactagggctggttatg

SEQ ID NO: 177702 - DNA, 221 bp, Homo sapiens
gtgctgagaatagactatgtgggagtaagcatgggaagtagaaaaaccagttgggaacttacttcaatacatcaaatgaaagattgttgtggcctgaatgaatctggatatactatggagaaagcaaaaaatatttgtttatttacggactggaatacaggatgtgtaaaagagatttaaaagcgactccaaggccaggtgtggtggatcacacctgtaat

SEQ ID NO: 177703 - DNA, 835 bp, Homo sapiens
tgcagtgctgctgtgggtgacctagaggatccgcgcgtgttgtttactattcgggtaaggggtaccctagaagcccaaagctcaccataacatgatacatccatgtaccaaacgtccacgtgtatccctgaatgtctaaagattaacaacaacacaataataatacaacttctcctcctcaaaataccccagagggatctccaagaaaacaagagacaaaaatgatgcatactctagtggcatgaggccaaaactgcacggggcgcgcgcgtgtgtgtgtgtgcatgcatatatgtgtgcgtgcatgtgtgtgtgcacgtgcacgtgtgtgtgcttgtgtgtgtgcgtgcttgtgtgtgtgcgtttgtgtgagggggcttttttaacacaaagaaaagtacagaaggatccataccaggctgtgaaatagttacctggcaatgaggaattccagatcagcccagtcaacaaggtgaaaacccatatttactaaaagtacaaaattagctgggggtggtggtgcatgcctgtaatcccagctactcaggaggctgagttggaagaatcgcttgaacccaggaggcagaggttgcagtgacccaagatcacaacactgcactccagctggggtgacagagcgagactccatctctaaaaaataataataataaattaaaacaatgtattcaagcagctgaaatcaggcactggacagatatttgccaaaccttgttcatagcagcattattcactacagccaagaggtggaaggcaccccagtgtccaaggatgaatgaatggtaaaacaacgcgcgggatcctctaggtcacgatg

SEQ ID NO: 177704 - DNA, 713 bp, Homo sapiens
tgctcactcaatattaatcacaattttttttttcatgaccatttgtacagtgtattgtcatgtatatggaaagggtttcagttctgttttagggatttctcttagaaatctccagcaatttcacttagggagcttttgaagccatctgccttagtgagctgtcgctagtgtgctctttttgaaaggtaagcaatctttgggccagtttggatatgactcttttacatgtccagtccatatattcccagaagaatccagaagtcatggccatcaaagtaaaatacccagccttttaaaaccactacatttggataggaagatgctctccttgaaattaccttttacctttgagatccatctagaaaaaaatctaaagagttgattgtgggtcaggcccatcagagtgtaagaatgaattcgagctgtaaaaaatgtgattctttttctttttttttgaagagccattgggcaggagtaaatgtggtagaaccattttggggagctgtatatattcagtaaagttgaagatttctatgctgttaggatcaggtaatttcatttgtaatttagagaaattttgatacatgtaacctgggtgacatgtacaagaatatttgtaacagcagtttgtaagcggaaaactggctacagcctcaatgacattcaccaggcagtaggtgaatttgatgttgtttattcataccttgggagac

SEQ ID NO: 177705 - DNA, 343 bp, Homo sapiens
ctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatg

SEQ ID NO: 177706 - DNA, 629 bp, Homo sapiens
tctagaggatcccagtcttgggaccacaaactcattaagccaaagggaaaagtcaagccgggaagtgggtcacgcaaatctgcctcccattttgattcctaaataagatggcgagatcccctctccacaaaaatacaaaaattagccaggcgatgtgggacgcatctctactcccaactactcaggaggctgaggcgggaggatcgctggagcctggaaggtcggggctgcacggagccctgatcataccactgcaccccagcctgggtgacagagtgagacttcacctccaaaaaaaaaaaagtttttaaagaatacccacccaatagagctgctgtgaggtttgcatgagtgctatctgtcaatcaagccaaatgaccgaggcaagtctcaatcattttaggaggtttatttgccattgttaaggatgcacacctgggagacacgtctgtgcctttctctgaagataattttgagggcttcaaattttaaggggaaaggatgggatatcgagaaatgcacaattttcatgtgaagcggggtagggggaagagagtcatgtatgccttcatctggctcagtgaatctgcgtttttgcataacatagacaatagagcagaggaaacaat

SEQ ID NO: 177707 - DNA, 513 bp, Homo sapiens
gaagtgaattagactgtctgtgtaatcagaatacgatgtgtatggacatcaaaacctcacactgcgtatcttaaatataacaatttcaacacaaaatgtgaaagcaaactgtaaggataggctggtgcactttgatctcttgttttatgctctgccttcattgttctgtacccttaatcgggtttttagtttcagtacgcaacagaatgttaataaccgtgttctccatgctgtgtgttagatgttgccaaccttaataacagacagtggctctctaaaagaaaatgtttatttgcgagtagagcattgcaatgggaatacatgtgccatagtaaactatgtatatattcaggagataaagacagaggtgtttaaagaaaaaaatgaggaggattacataattgttttgcaataattattcttggccacaagatcaataacaaggctgaacggtgttccattgtagatatatacacatcacgttttgttcctacagtccgaggttggacaggc

SEQ ID NO: 177708 - DNA, 313 bp, Homo sapiens
gttttgagaagtgaatgggaagcccttagagctgaaagtagcttggagagcatctcattcattcttttcattttatagatcagaaaattgagacccagacagggaggttatgacttcaaggtcatagttggtggcaacgctcagatgcagacccaggcttctgactcccattgcatttccaagtgagatggtttttgcaagatttttatatccagaacattttaaaattggccatctataggatgatggtgctgtactggagatttctaatgcagtttgcatgtgtacgaggagcatcagagagagatcttgc

SEQ ID NO: 177709 - DNA, 308 bp, Homo sapiens
gtttttggtctcagggggaccactatgatcttcagtcatttgccactaagtatgatgttagctgatttttttttttttaagatggcctttatcgggttaaggaagttcctttttactcctagttttgggtgcatttttattaagaaagggtattgaattttgttaaatgcttttgctgcttctattgagatgatcatctagtttttgttatttattctactgatgtggtatattacattgatttttgtatattaagctaactttgcattcctgggataaatcccacatggtgatggtgtataatcctt

SEQ ID NO: 177710 - DNA, 376 bp, Homo sapiens
ctctaagttatcacccactagccttcaaatgatgtcacagaaagaacatcacccttggagtggggaggggaggtttaagtctaggcatcacaatttaaactggtgggacctggggttggtcacatcccttttcagggtcttcagcctctcagccataaaacaggatgacagcccatgctctgtatgccgcaaggctgttggctggatcagctaaactcttaagaggatgtgtgggctctaagaataccccgcgcactgggaatttttgacctgatctgtccaggaagcattgttccagcctagccccgactacccttcaaagcagactccctgaggattcttacatttaaaagactacaggctatacagaatccaa

SEQ ID NO: 177711 - DNA, 711 bp, Homo sapiens
atctttctttcttcctagaaagccttcctttttatttccttttgttgagatatgtcacacacagaagagcattctacaaagagtgataattttgcatatatgttttgcgtatctcctataacgtccactcagattgagatacagaactttccagctcaccacttaccaacctcctgagggtggacaccatgtctatgtggctggtagttttatcagccatgctggacacaaagtagccattcaataaatatcaaattgacaaagaaagaatcaatgttggtgaggttgtatacatcatacaactatttaaaatagatactgtgtaacaatatggataaatctcacagacattatgttgactttaagacaaacacaagagtacatactgtatgattctacttacaagacattcaacaacaggcaaaactaattaatggcactgaagtcagaatcatggctatctttggcatagcggtattgagtagcgaggagctggaaagttctgtatctcaatctgagtggacgttataggagatacgcaaaacatatatgcaaaattatcactctttgtagaatgctcttctgtgtgtgacatatctcaacaaaaggaaaaaaaaaggaaggcattctaggaagaaagaaagactgaaaactaagtatcaataagaaatatgcccataagactttggtaaatgaaaagaccactttgca

SEQ ID NO: 177712 - DNA, 234 bp, Homo sapiens
ctgcctttactacatttaaaaagagtttcacaaactcatataatatctttctctagagttcaaagtgagcttactagtccttactgatactattcaatcaccactcacctcttccctgtttgatagacaatactgaatatgcaaataaaaagaaagttcctacatttcggctgtggttagattaaatttttaaaaattactaccctgtaacactttaagttgctgtaagaacac

SEQ ID NO: 177713 - DNA, 254 bp, Homo sapiens
cacacacaacacatacacacaaatgcacacatgcatatacccacaggtgcgcgctcacacacacaactcagtgaagggagaggccccagcatgaggcacctgctggggatcagttccacaaagggtgcagcataactgctggagcaggaacagctacacagcggatggcgatcatctccattctctctctctctttctttttttttgtgagacagagtctcgctctgtcgcccaggctggagtgcagtggcgcg

SEQ ID NO: 177714 - DNA, 437 bp, Homo sapiens
acaggcttcaaacttgtgtggtttttggaaatcaggcagaggaaggaggcagagaacaagatgattttttgaaggatggaacagctgagaaagttaaacacctccttcaccttcatcaccttccctattgttccctaatctaaaattagaaagccagtctcttaagaaattcatggatctgtagtgatgaccccccaagaaagccctccccattttggtgtggagttgaggaataggcaagtgtactgcctgctcaccctgctgcctgtctcccacccgaggccttgggtgaagtctgccagtgatcatgccctgttatcctggggaaaaagtggttaagaaaacatagtgctataactcacaccagctacttgtattaggcaacctagttctttattaataaatgtaaactgataactagggatcattgacatctt

SEQ ID NO: 177715 - DNA, 521 bp, Homo sapiens
gagaccctgattggagcagatgccggctgcgtgaactatgtctagacatggaaattgtgctcttaatctctcaatcctgctttctctacattctctgacaacgcgcctgtttctgtaaacattctcaccacgggagtggagctggaaacacatgtgcaatcagcagccacagcagctacaaagggggttatgaaatccgcgcaaaaatagcctgcttgccccataggcatgcaaagcagccaactagccagggagaacgtgtcaggcggcagatttcgctcagtgtttcaagaggcttccagtgacctgtcatacttaggggcaaaggagcttagtgctggacagaaacacccggaggggctctgggcctgcggacagagcctcctgtgcagctgtgagcgacaagacctcctcccagggaggcagtacaacttccaagagatgccagcctcctgtcctacctgccccgcaactcctcagccctggtttaaacttttacttgagccgggcacggtggctca

SEQ ID NO: 177716 - DNA, 381 bp, Homo sapiens
aattccaggcatagatatattctccacataatttatccttctgtaaatttgtttgatggattaatgacacctactgggcaagtagcatctttttgaaactctccatatccaagctgaaaagaatgggatagcccagctcacaaatgccaagcagatgtgcacagaattgctataccttcatgcagtctagggtgatgggacttcgttacatgttcattagcagtgacataactgtggatcgttattttcctaattagccattaataacagttaacactgtaatgggatcacaatttcagaatttggagcatatattgttgacagtgaaatctaatgaaaaacaaactagcttcttatattttataaaagatgttaatctaa

SEQ ID NO: 177717 - DNA, 374 bp, Homo sapiens
atacctcttactaggcactgggctaggacaggtagaatgacaataagacatgtcccctatgcttaaggaattgtctgtcacaagtaactggcaatgccacagaagtggctgtcggtggctctgtgaaagtgctgacagggcagaggcaagagagagatgaagtatccagagcagcagtggcctggggcggttgtcataacctgggaacgctttgtggaggacctggtcactggttttccgaaggccagcccaggtctcggagtctcagagttctgagatgtgactgcaggatgctgctgagcctggggaagcaggtagggagcttgcagcccatggagaaatcaattccatggcgggcaattgtggaggtaggg

SEQ ID NO: 177718 - DNA, 137 bp, Homo sapiens
ctccttgtccttcctcctctccttcctcctcctcctcttccttctcctcctcctcttcttcttcttctcttatctcactctcttcctttcacttctctgcaattgctatgagaacgtgcatgagtgagcctgaaaat

SEQ ID NO: 177719 - DNA, 603 bp, Homo sapiens
tgccagacatcatgttgtgtacacagtgatctcctcttattctcaagaggagaataaggcactaaaatgcttagagtgttacttctcgctctctgggggtaaggaaagaggtgttaagtacaaaaataaccctatctcaaagacagagagtctgccagaagaatcatttttggaacatcctctaaatactagtgcatataactcaatcctttcaaagaaaaagcctaaatccacatatccaaaccctgcccatccttgagagttaactgaagatgcaccttcttaaaaaatcattcttcgagctgggcaaggtagctcatgcctataatcccagcactttgggaggaggcaggcagattgcttgggttcaagaattggagaccagcctgggcaacatggtaaaagcccatctctacaaaaatatcaaaagttagccaggcatggtggtgtgcacctgtggtcccagctactcaggaggctgaggtgggaggattgcttgagcccgggaggagaggttgcagtgagccaagattgtgccattgcacagcctgggtgactgagccagaccttgtctcaaaaaaaacccccacatcattctttgtc

SEQ ID NO: 177720 - DNA, 404 bp, Homo sapiens
gggccactttccccagtatttggatccctcagctttggagggcaagagctgtttccaggctatggacaagggacggggtgcatccagaggagggagctggaggtgtggcctcacgtgtaagccagcagaagttggcgtttctaaatctgaataagaaaaccaaggagaggtgggactttggagcctgccttataagagcccagcccttgcccacagggccacactccacgtgcagagcagcctcagcactcaccgggcacgagcgagcctgtgtggtgcgcagggatgagaaggcagaggcgtgactggggttcatgaggaagggcaggaggagggtgtgggatggtggaggggtttgagaaggcagaggcgcgactggggttcatggggaaagggatggatcg

SEQ ID NO: 177721 - DNA, 453 bp, Homo sapiens
ctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcagaacatatgtttgtcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatga

SEQ ID NO: 177722 - DNA, 469 bp, Homo sapiens
gatctttaagataatttattacaaatagaaattgttcccccttagtttcaaactgtcatctgttaggcagtcctggtatttcattttaatgtaaaaaaagatctcttagtgatatactctgataattattgaaatctgtcacctatcacagggagaacaatattggcagtactccaactcttactggaggcaaagcacaatggggcaagaaggtaaatatttaaagtaaggaagcttggtttttacagtgaacaacactgaatcatacattgcaaaatgttaataaaattagcagcctgtttatcagcttatctgcgtcatggggtgtggaggggtattgacaatgaaaagcctcatttatcttcatgagttaaattgcctgtataattcatgaaccaaaagcaaagcaaaaaccagagctgagacccaagttggttatataggtcagctctaatgagtttaaatgcct

SEQ ID NO: 177723 - DNA, 104 bp, Homo sapiens
taagtgccatgaaggtgttggcttttatttacctagtgcctagtctctaaaacttaatgggtactcactaaatgcttgttgatcttgatctcctccctttcctg

SEQ ID NO: 177724 - DNA, 268 bp, Homo sapiens
ctgcctgcaggatccctcagggtcttagggagatgatagacacaaaatgttacccacatactctgaaaaatctaaagaaagcccatagtattacattttacccaaccagccatttataattctaactttaattcccaaaaagtcttaggtagattataaacaggtgaggccttatacaaaatccttatgtttctatttataaaatgaatcttatgagctactcactgcagctcccctcctttgccaaaagcctgtagtgaactcatca

SEQ ID NO: 177725 - DNA, 517 bp, Homo sapiens
ggtcaagaactggcacattgtaggtgctcagttaatgttacttcttttttctctaccagaagaaagggaagtgttacacatttattttggttttggtgactgatttaaaacttatgtgggttttaatttagtggaataggatcttgcaggaacaaatttcatttcactttttatcttccaatttaatactctcacacaaaaacagtttttcactttagtatttgttaagcagatgaattatttgtgggtaaagaaatgagcattgcttaaatctcttattagtatgcaaactgcccactgttaaaacctttcttagaggattatacaattagataaacgcctttttagaggtattttaggtaagataatcttactttttaatgaattaaatcatccactcatttagttggtcatttaaacatttgtttgtcatgtttgggtaaggaattgtgctggagtctgtgtgagacttcaggatatttttggtgttcagtgagaggcagtgtagaatactggt

SEQ ID NO: 177726 - DNA, 322 bp, Homo sapiens
ggaccttatgtaacctggctcagtccccaggctgacctgcctgaggcctgctggtctgtggtctgtgatttttttgtctaccttctctcctggccgctaaacgcatggcagctgcatttgctaaagaacacagcgccacctggtggaaagataagagtaatgccttacttttgtaccttatttttgttttctgaccgctgattgattccacataattctgtaaaggtgtattgagccccaattatattcaagacactgttacagtcactgtgtatgtcacagtgagccacacaaagtcccttacctaatgaaacttataatt

SEQ ID NO: 177727 - DNA, 478 bp, Homo sapiens
gcgagactccgactgaaaataaataaacaaataaataaataaataaacaaataaataaaaaaccttctctgggcacgatgctgaagtgagtctttggtattttgtcatccataatccacctgatactttaatctacccaccaccttttctcaatttcctaataaccctacacagccattctggtaagatggaggtgaccctttctttttgcctccagggttgttataggagccaaataggatcaacatgaggacaccattctcctggtcacatggatgagcatgtggctcaatctggaaaatatctattttcccagggaaagtgagcatgtgactaccaatgggtgtcttaccacccaaaggagagagcaaaactgtgggtgaagcctagagaagaagagggagatagagtcttgattacatttcaactgttactcccagtcctgccttcacatccacttcttggctttacagtttta

SEQ ID NO: 177728 - DNA, 616 bp, Homo sapiens
gaaaaactttcatagattatgattattacttattaaatgtgagattttcttgatgtttaagggggtgggagcatttgacagagggaagagtgtgttggcaattattatgttcattttatgatgaagatattgaaagttaagaggatttctcagtcagtggtgaattgaggaaagaaaattgggaggtggggagcatttctaggaattttctcttatgaatccttaagcatattttgtaattattgctttttttgaatcacccttttcagggattagcacagtactttgcatgtattaagtactggagttacaattgaatttatgtgtgtaagaacaataaggatgtggaaggaagaggtatttccagctatagataatcttgtgtttaagcctattctttttatttttctacattttaaatagctgatttcaattcagaaatagaaaaccaaggttaccattgactttcctttcacctctccaaagttcaaatcctgaacttcgatcttttcctagagttttctcttctcctgctgttaaattcactgggtatattttctgtcagtgttacctccccaaagtataggacttggtacacatgccgttgattgagact

SEQ ID NO: 177729 - DNA, 290 bp, Homo sapiens
ttacactaccttctttccatcgaggacgtatcttgcctactgccacagagatatctttttactgtttgtcacccccaccagaatgtaggcttatgagcacaatcagggccactggtgacttcagaacctacaattgtgcctggcatatggcaagtactccgatactggttaacatatgggcaactcattgagacgtggaaaaaggcttctcttaaactcaaccttttctccccacccgcctctgctggttaactgaagttcaaagcactgagtcaagttctcatgacaga

SEQ ID NO: 177730 - DNA, 452 bp, Homo sapiens
aatgtacaaccatagagggaggtttaaaatacctctcttagtatcagtacaaatatagaatatttggataatgagaataacaaacctgacttaataggacatgccacccacccactgcagagtacacattcttttcaggtatacatggaacaattaaaaatttctccgtattccaggccttaaagcaagtcttaacaaatttcaaagggttataattacataggaaatgttctgttaccatggtggaattaagccagatatgaataacaaaaagattttattatttccacatatacttggaaattaagaaactacttttaaatgccccaagagtcaaagaagaaatcacagtggaaataaactgaataataacaaatgcgtgacctatcaaagtttgtggtatgcagaccaggcttggtggctcacacctataatcccagcactttgggagg

SEQ ID NO: 177731 - DNA, 637 bp, Homo sapiens
ggtctctcaaaagtagtgtgtcttctttcagaaaacattcaagatggctgaggaggaaatgaggatcagatttttatttatgcttttctgcttacctgtatatacaccactaaaatatgataaaaatgtattacgattagatactatctaacagaagccacgtgtctggtgtttagctaagtgctatattattgaaagtcaatagactaagttctacagtctaataatgtagaagcaatttggatacacatgcccttatgcaaatacattgaaaaaaggtaagtcctgggtagagacacaagtaagacacacgaaaggttctaaatataggatgtatacccattgtctaagcttgtagtcctcaacatcttacacataaggacgatggacaatttaaaccttagctctattttagtaatgacatgtttagtatgagggtggggcaaactatccaatttttaatgcagtactgtgtggcgaaaagaccaaagatttttttttagtaaaatggagtacttaataactaaattctaagacagagtgcttcattcctctgagtcttgtttttctcattttaaagttcctctctgtattcatctgcttcggttgcccttaaaaattactacaaactgtgtgg

SEQ ID NO: 177732 - DNA, 422 bp, Homo sapiens
attggtgcttctctgaccacattttccctatcacactctttggcaattaaatactggttttcacagatagaattctagtgccattaacatgaatgtcaacttctcagagacgtatcacttgtctgatatttcattactgaggacccaagcacatcagtttcctgatggaataaattccaaggaaaggatttattcagccaatctagcaaataagcctatatatttaatttctaacttagaattcaaagacactcgccttttctatcacttcccgctctctatttttttttttttttagagaacgggtatcacaatcttccccaggttggcctcaaactcctgtgctcaagcaatcctgccgcctcagcctcccaagtagctggaaccacaggtgtgagccactgcaactggcttcacttctc

SEQ ID NO: 177733 - DNA, 161 bp, Homo sapiens
attagaaaggtcataatagcttgctaggtttatttattttctcctcattcctcaattcattgctgtaatttattcttatgtcggaagagtaatcatcatcatccttgtatccagatgttatcttttttacttttcagtgatctgtgataaaatattagtta

SEQ ID NO: 177734 - DNA, 810 bp, Homo sapiens
tatctgagacaggtctcaatcagtttagaggcttattttgccaaggttgaggacacacatgggaaaaagacacaagtcacagtaggatctgtggcccacacatttttccaaagaggattttgagggcttcagtatttaaaggggaaagtgagggtaggaggagtaggggtagaggaaaaaaacaaaaaggagtgtaggtagtgagttaagtggtcacattcttgtgaggctttgattagtgctcactgaatccacatgttacatgtgaagtggggtagaggaacagtcaattaagcatttgtcaggactcagtaaatatgcatatgtctgaggtgggcagagggatggtttctagtcttgactttgtgctgtatctgtgaagataagctgtttacattgtcaaggtaagggaggccaactgaggagatatggaatcttctatcttgcggctgtgtttaggcaaaaggaaaggcagtttttttgcatgactgagtttccaggcttcacttttccctttggcatagtaagtttggggtctgacttgtttgtttgtttgtttgtttgtttgagatggagtttcgctcttgttgcccaggctggagtgcaatggcacgatctcagctcaccacaacctccgcctcccaggttcaagcgattctcctgcctcagcctcccgattagctgggattgtaggcatgtgccaccacgcccggctaatttttgtatttttagtagagacagggtttctccatagtcaggctggtctcgaactcccgacctcaggtgatccacccacctcagcctcccaaa

SEQ ID NO: 177735 - DNA, 587 bp, Homo sapiens
  misc_feature (77)..(77): n is a, c, g, or t
ggctcggtcacgcaatgcactctttcttcatgttccattactctgcctcacacacggcacctatattcaacttcgtntctccctgctgcttccatggccttgtttctgtagaagagtggagcaggatgaaattgaagcagagacagagtagtgaggcagtagagttggagaagacctgagtgtggacctggaagctcccctgcagagggcaggggagaggaaggggctagcatcactgaattggagtggagagggaaatgtatcactcccctgtctttgctgtcatcctctcctcttccttctgccacaaactggaagttcatttgtgaaggggctgcttgaagcccagaaacagtgctgtaaatgatagacgatcacttccctgggacgataatttccctgggagagtccacaaaagtcttttgtaactgacaaggtaggcagaacattgtatatgatcccatgtttttgtaaaatggacaaatccaaccataaatatgtgtttgtgggcaaatagaaaaagattttagcaaatacacagcaaactattaacaatggttgccactggagaggggagatgaggctgg

SEQ ID NO: 177736 - DNA, 571 bp, Homo sapiens
tagattaaacaggattttgcagaccggcctactagaaacagacccaccatgtcgaaatgccactgagaaatgtattgacatctaaaacacgaactcaagtgaatcttgagactataatacactttagtaaatggggaatgtttctatttcttcatagcctacataattagaaggcatgaagtgattaaatcgtaaactcctgggctgctattgccaaagggtacatttaaaggtataatacagggtcttcttagtaagggggatctgtttttagcatagaccccataacaagcttactgttgttagcacatgacggagtggaaaccctctccaccaccacagcccagcagaactgagaggacaagagtgacaagcacacacacagagctcctcagagtcatacaagtggaaaatgagcctttcctggggaaacaagtaactggcggctggtcatttagcagagcattagaggaagacagccttgcttggtgttgataagcagcctgcatttagagtgaacttcaaataatgtctgacaacatcaaaaatatccagaattagtcgtagggat

SEQ ID NO: 177737 - DNA, 324 bp, Homo sapiens
acagtccttgttcttcctaatattgggaggaagagagaataaggtcattgctttctggagtaaccgtccagtgactcatacaagctgaagtagaagcaaaagaaccatagctggttaacggtaactgcagcaagtgaaaaaggggacatagtatccaccatatatttattggaaacccatatactgtctaatttttataaatcattcattcatttataatcggtgcactcactttttaaattcaggtctacattcatttctttgccagtcaatacccatttaaccaccagatcctaattttttaacctctttaataataattac

SEQ ID NO: 177738 - DNA, 201 bp, Homo sapiens
aagctctggggctgcagaaattcactaccgggggtagaatgtccaggtgggagtttggactggtactagctcaacctcaagtaaattcctgaagggtttagaaaaatctgaaacagacgctgacatatgtgaaggccgggctacataaaacatggagatgatgaacttctcaaatggagcagaacaccacaaaatttggag

SEQ ID NO: 177739 - DNA, 458 bp, Homo sapiens
aggtcgagctgagaaactgtctgaactctcaggtgagaagggagctcagagcccacatccaccaccgcgtgtagttgcctggcctctaccactcgcacactgcctctgtcggggagctcactacttccactgcgagcagctgggccactgccactgccttgtgacacacgctgcagcctcagccacagggaccctggcctcccctcccgagagaagggactgggaggcagggaacaggacttattaagtgtcctttccattccagacactggacccagtgatggtgggatctgctcattgattcccaccacaaccccatgaggtaaagataagcgctctcactggctcctctttttaaaagatttttgaaaatgtttaattgggataaaatacatgtaaccaagaatttatcttcataaccatttcttttcttttttttttttttttttgagacaaag

SEQ ID NO: 177740 - DNA, 394 bp, Homo sapiens
tacacctcgcgcccgtatttcactggattgatattgaccctttttcccattgaattgtcttggcacttttttcaaaatcccagaagacttttaacagaaattgataatgtgggccagtcacggcagctcacacttgtaatcccaccactttgggagggcaaggcgggaggattgtttgagcttgggagttcaagactagcctgggcaacatagcaagaccccattctctacaaaaaacataccaggcatcacaggcacacacctgtggtcccaggaggctgcagtgagatgtgaccatgtcactgcaactccagcctggacaacactctccctctctcaaaaaaagaaattgataaggtgattataaatttaagtaaaaatgcaaagtgcctag

SEQ ID NO: 177741 - DNA, 579 bp, Homo sapiens
cttagtggcttaaaatgacaaacattttatttgttcataattctgtgggtcagaaacatgagctggtttcaattgaatggtttgtctgctgacctcacattaggtcactcatgcagatgctgtcatctggaggtcacttgggatgcatggtccaagatagccttactcaaaagtctgctgagttggtgacagctttggctggccttctgtctccatgtggtctcctcatcctcaaggagactggctggggcatcttcacatggtgatggcaacattccaagaggataagagcaaaagcttcaaaggtttcctgatgcctaggcttagaagtcccaaaatattacttccattgcattctattggtaaggcaggtcagaacgccagcccagttttaagggtgcagagaaaggatttcaccacttgatgaaagaagtagcaaaatcacagttgcaaagaaatgtatacagatgggaagccgggagctgtggctcaggcctgtaatcccagcactttgggatgccaaggcaggcggatcacgaggtcaggaaattgagaccatcttggccaacacggtgaaac

SEQ ID NO: 177742 - DNA, 412 bp, Homo sapiens
ggaaatttggaagaaagatgttctcagggagtgctgatggaatagtgtgaacccaaaatatctgaggcaggtctcagtcaatttagaaagtttattttgccaaggttgagggcgcgccgtgacacagcctcaggacgtctggtgatggtggccggggcccagcttggttttatacattttagggagacatgagacatcaatcaatgtatgtaagatgtacattggttctgtccagaaagatgggacaactcaaagcagggagggggcttccggttataggtagatcagagacaaatggctgcattcttttgagtttttgattagcctttcactgaatgcacaatttactggaatagttacgtatgccttagtctggctgagtgaaacaacagggcggaggaagcattccgat

SEQ ID NO: 177743 - DNA, 321 bp, Homo sapiens
acgttgacacttcagagggtagacctcataatttacaatttcccaacagttcctgcaccttagaattttgcttcgatgtgtgtagactcagcagcatgttgtaggcacgttgatgtgttccagccacccacttatataaacactattgtcttataggagactatacattctgactgcagtttaccaaaaaaaaaaaaaaaaaaaaagggggaaaaaggggggaattggccctcccttgggttttaaccaaaaaaaaaatcccctggggttttcaacacatccaaagccttgggggggggagggtttttaaggttggccctt

SEQ ID NO: 177744 - DNA, 611 bp, Homo sapiens
cacagaggcacccacacctctgaagatgactccttggattggaaaccaattgcagggcaaccctgggagccatgtgttaaggatggaaggtcacatgatgcaaggagcctgggtcattacatcaccactgagagctccttatatattctggttattaatcccttgtcagatgggtagttgctattttctcccattcatgggttgtctctttactttgttgattgtttcctttgctgtgcagaagcttcttaacttgatgtgatcctatttgtccatttggctttggatgcctgtgctatgtagggtattactcaagaaatctttgctcactccaatgtcctggagagtttctccaacgctttcttttagcagtttcataatttgaggtcttagatttaagtctttaatccatttttacttgattttgtatatggcaaaagatacgggtcttgtttcattcttctgcatacaggtatctagtttttccagcaccattttttgaagagactgtccttttcccaatgtatgttcttggcacctttgttgaaaatgagctcactgtaatatatggattgtttctgagtctctatgtgttccatggctatgtgtgt

SEQ ID NO: 177745 - DNA, 1196 bp, Homo sapiens
tcgcacttgagaaattattataaaagtaactcagtatccctttgcctacaagagttttagaataatttcagatagggaagctatgcactgattacccctaaacaagtgggatcacagcatgggcaaaaaggagcccaagaagtttggcattgagctggggtagtagtatcccagacccagaccatgagccaaatgaggtatagacaggccaactagagccagaatattccacaaagatattttcaggcctgtggtgcgtagacttttggcatgccgaagtgccagtttattatgggaatcacaggcattgccatcccatatcctgcaatagtctcccattcaatacctctgtaataaggtggttccagaactggcttcctgtctaagaatgttggtactaggaactaacttaagatttttctttcctctttggaagaaccatacagttgtgtatgtcaacccaggcagagagactaagaccttcatttcctatgaagagggatctccagttagcagtcctttaaaaccatcatattaggaaaggactttggcagagaccttctgcatagtcttagagggtgagggccctcaattttctgtgggtcccatcctgttacctactttcaacctaggctcctgtccaccgtggatcgcaccaatatcaaatgaggaggtgtcgttaagtgagggggattctgtttgggtattatagactcatagatggaaagtatctcattttgaggctagaaaggggacaaaggaagcactaattgtgttttttcagatgtcatacaactaaggcaatcggcaaaagagagatcaatttaagagaccattgtccatttagtaagtttaagagagcattgaacaagccattatgcctctattaggcctgctttctgtgaacagtacaacagatgggccaggcactggctcacacctgtaatcccagcattttgggatgctgagacaggcagattgcttgagccttgagcccaggagtttgagaccagcctgggcaacatggtgaaatcctgtctctacaacaaataaaaatgtttgcagggcatgctggtgcgctactcaggaagctgaggtgggaggatcacttaagtactggaggttgaggctgtagtgagctataattgcacccctgcactctagcctggggaacagagtgagaccttgtctcaaaa

SEQ ID NO: 177746 - DNA, 641 bp, Homo sapiens
cgaggcagccagggcgccggaagaggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagggacatggatgaagctggaaaccatgactctgagcaaactattgcagggatagaaaaccaaacactgcatgttctcactcataggtgggaattgaacaatgagaacacttggacacagggtggagaacatcacacactggagccagtcgtggggcggggagaggggggagggatagctttaggagatatacctaatgtaaatgatgagtaaacgggtgcagcacaccaacatggtacatgtatatatatgtatcaaacctgcacattgtgcacatgtaccctagaacttaaagtataataaaaaaaatttataaataaaaatgtttaggcaatta

SEQ ID NO: 177747 - DNA, 808 bp, Homo sapiens
cgaggcagccagggcgccggaagaggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggggtctcactctgtcacccaggctggagtagagtggtacaatcacagctcactgcagcctcaaactcccaggctcaagtatcctcctacctcagcctcccaagtagctgtaactacagtgactgatcaggcttttgtcacactggccacagatgacatctactgccagggcgccctggtcctggggcagtcactgaggagacacaggctgacgaggaagctggtggtgttgatcactcctcaggtgtccagcctgctcagggtctcactcgtcgcccaggcttgagtgcagtgataccatctcggctcactgcaacctctccctcactggcccaagtgatcttccctcctcagccttctaagcagctgggaccacaagtatgtgcccgcatgcttggctatttttatttttattttttgtatttttggtagagacagggtttcgtcacattgcctaggctgatcttgaactcctggactcactcagtccacccaggttggcctcccaaagtgctgggattacaggcatgagccacggcgccctgccaaggagtctttttaaaaataatttccttttacaattccctttgtctttaattctcaaataaagcaaatacataaataaatgcatctaatgaataaagca

SEQ ID NO: 177748 - DNA, 662 bp, Homo sapiens
cgaggcagccagggcgccggaagaggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagtctctccaaaaggtgcaagatatcatccagccacttggactgagagctcatcccaatccagttcctgatcagatggggccctgccactcgttccagccaggtgacctggtgttcgttaaaaagttccagaaagaaggactcctgcttagaaaagacctcatactgtcatccttaccaccccaatggctctaaaagtagaaaggaatgcttacattcatgacaccccctagtacaaagcatgtttaactgtaatctatgactaactaccctaattactggattggcagaaccctttttctccttctcttgtttagtcttccaaccattatatattaaaattagtttcttaaatttgt

SEQ ID NO: 177749 - DNA, 597 bp, Homo sapiens
cgaggcagccagggcgccggaagaggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcaggtggatccactagatgctgtgattcatggtagatcttcagacgtttggtgggcacccacacaggtacctgattgtcacctggagagacaaaagcaaatcctcttccccataaaattatctttccttttccccagctctttgtatgttcatccctccaccatatatcttgtccagcctttttcttatccttttgtcccatcaggtgttgttcagctgcagtcatgggttgatctttttgtaaattaaaaaaacttaatgttaataaagctaaatgcaattgcaaaaaaaaaa

SEQ ID NO: 177750 - DNA, 421 bp, Homo sapiens
  misc_feature (354)..(354): n is a, c, g, or t
  misc_feature (356)..(356): n is a, c, g, or t
  misc_feature (359)..(359): n is a, c, g, or t
  misc_feature (368)..(368): n is a, c, g, or t
  misc_feature (373)..(373): n is a, c, g, or t
cgaggcagccagggcgccggaagaggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagaatctgcagcctcaccggtcctctccatggtttcctgaaggccatagnangtntctgcgtcnctgcnttgtctgtgtacatgtactgtgttgtctttctctttcgtttgttggtc

SEQ ID NO: 177751 - DNA, 305 bp, Homo sapiens
atatattctaaatccctctgtggctcccctcctcagtcacccaagacacttgacccagcagtgacatggtgaatttggcattgaagcaggaaagacaggagagccagagacatgccactgttaattccccatatgtgcataaaattcagatacctctgggtctatatttacttgtgtttagcatctgcacgtaaagaaagggaagttaccccctgctacctcccatcagtcaagcatcacctgattcaaggacatactaagccacagtcagcccatcccaactttttgccaaaatgcctacccca

SEQ ID NO: 177752 - DNA, 339 bp, Homo sapiens
atcgagggtttctttgaggggataaaattagtgatgatgattggaaactaaaaaacagaattgtgggcagatgcggtggcagcactttgggaggctgagacaagtgaatagcttgagcttaggagctggagaccagcctggacaacatggtgaaactccgtctctactgaaaatacgaaaattagctgggcatggtggcacacgcctgtaattccagctactcgggaggctgaggcacaagaattgcttgaacccagaaagtggaggttgcagtgagctgagatcatgccactgcactcctgcctgggtgacggagtgagactctgtctctaataataa

SEQ ID NO: 177753 - DNA, 451 bp, Homo sapiens
ttaaacaaacaaaaaactgctttgctaaatgaaagctgtatggatttcacaatttgaatttctgaatttctgaaatcttgcattttataccagaaggcagtttactcatgtgtctgatcattctaaaccaatggagagttaagaatgtacatttcatttcggctgggtgcggtggctcatacctgtaatcccagcactttgggagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgcataataaagtaggtctgcagtaaaaaaaaaa

SEQ ID NO: 177754 - DNA, 399 bp, Homo sapiens
atactcaggcagagaccagaatgcatacagagtctagctgtcattctctgtaatctggagcaagtcaggtttgtctctggaccttctccagttgttttacaactttctagacatgcagtgtatcaacccaacacttttattaagcagctttgacagggtttttgagatgacagctagtcgagattcaacttagcattgtacagttttatttcacaattggaactttcggttttaatacttttaggactttattcattaatgcaacactttttgttgaacacctactatgtaccagggattgatatagctgtaaatatgacatacttagtctctgtctttgtagtactttaattcctgtaacacttgttaaattggattatttttatgaccgtagagaat

SEQ ID NO: 177755 - DNA, 339 bp, Homo sapiens
cacatatgagctactcaaaatgtgcaaatcgtattgtattgtattgtatttgtaacatatctattccttgcaaaaaactgggagttctttgaaggcaagggaagatcttgcttatttttgtatcatctgtgtatgatgcacaaaataggtgaccatttaacgtttgttgagtgaatgaatgtgacatgtttatgaaatctatgattttagggtaaaggacactaaaagggaaaggatatatatttggataatataacgaacttacaagagctgaaaagctgctaatagaaaatccgttccaacctgaagcacattgcaaattcctagaactttctggag

SEQ ID NO: 177756 - DNA, 1511 bp, Homo sapiens
aggctggggaggggcgggggagggaaacaaccaccaaaaaataacattgtctgacaactttgagctaaaatccaggatcttaatttgagattaatgtaagaaatctgtcaggtatttttaaaaagtaactcatcactatttaggagttgactttttctgttgtagctttcattgaaggactattgttttagtcattctctcctaaattccttttcctgagactaaaagattgagctcatacctttgcataacgatctggagagtattttaaacttggcatgttcaaacctggcagactcgattaatatgtggacaaactagcacattagaacattttttaagttccaagccataaatgttttaaatgaacatgggcatgtataaaattaatacttaagccttcaaatagcacagactttcaaaatgcctgttgccttgggtgactgattttcagtgaggctctcgcttaccctacacatttcttcctctgcgtgaagcagtgccaggcacagagtcaggagagggtttgctcctttggcgctctactaccctctgctttcggcagagaaaaggctgctgttttacttcttaaactcctaccatatggaaagcttctaaaaataaactttggatttgtattggacttctaaatttgtaaccttctttatccatgactaaagccaatgtaaatacctttagctactctacatacaaagctgtggcaccgttttagtaagaaagatcaccaaccataatatttaaattatcaactgaattagtttacctttcatttatgtcttagttggcatggataaggacctggttgtgttgtcaagcaaaaactagttggtggtttttagtgaatccactttaattttttgttcatgaattgttggtgtaattacgtagcagacgtattcgtgagaatgtagaagtacactagcttttgacacaacagattgtttaaatggatcgttattcactttgtaaattctggtcagttgggccttctatcagcaagtatataatgagcacctgttacttgccaggcactgctaggtcttgcgagatacaaagttgtataaaagatgattcttgttcagacaagtaagagagaaaggaagaagaaaacctggggacaaccaaatgttttaactgtgttaacagagaaatagatgctatgagagcatgagagcatggaggagagatgagtagagtaatagttggctttttttttttgagacagagtctcactctgttgcctaggctgctggagtgcagtggtgtgatctcggctcattgcaacctccacctcccaggttcaagtgattctcatgcctcagcctcccgagtagctgggattacaggtgtgtaccaccactccgagctatttttttgttgttgttgtttttgagatggagtctcgctctgttacccaggctagagtgcagcagtgagctgtgatcatgccactgcactctagcctgggcaacagagtgagaccttatctc

SEQ ID NO: 177757 - DNA, 622 bp, Homo sapiens
atccattcaactataagaaaactaaaaatgaaaccacttttaagacgggggatggcatgtaacactgaactggagtgaagagcacttgaactctgagccttccttgaatgagagagattacaaacccccacagccttcactctccacattgaaaattcccctccctggggttcaggctgatgtaagccccatctggctttccttccctgttggttgcattgcagagccccaggatgttctaatgatgttccgtgagggctggaggagtccatggttgtgaaagtgatggcactttcatgcctttccataaattcccagaggttatggagggcttttgtaagtcagggctgagaggttaatatttcagcctctgaagcctctgctgtcttggttcaaatcctgctctggtcacttgctagctctatgaccctttgtgcttccatttcctcctctgtaaaatgggttctctcttgaagtatggtgaggattaaatgacttgatttatggtgagaaaataaatcactgagggcttagcacggagcctggcaccaagaaatgtttcgtaaatattagccgcttccataattattatttattattattagaaggttgagtggaggta

SEQ ID NO: 177758 - DNA, 213 bp, Homo sapiens
aagaatctattaggcaatcaatgcaagattatttaactcacaacctctcacttgaactaaaataacttacaaggctcttgttattatctccaatctataggtgaaataaggccctagaaagattagtagctgaattgcctggaattgcttgtatgaagtggaatagagattggaatctttctccactcttccagtttctttcaaagaataata

SEQ ID NO: 177759 - DNA, 223 bp, Homo sapiens
accagtgaatgctggggccgccttggtgctaggccacactctagaggggagctcttctccacactccagatagagttctgtcctggctccttcctaaaacctgcacactgagcaagtccctctacctccctaagcctcagtttccctatatgtaagcatgactgctctcatggtccatgagccctagaggttactatttacaagctgaggtgtcactatcccc

SEQ ID NO: 177760 - DNA, 501 bp, Homo sapiens
tatattcacacatacatctgtgaataaatatacacataaaggtgtcatgcattaatataattattcttatttttaaagttctcagaatgtcatctaaacttaagatatcatttctagaattcttatctgataaccctacttcatccaaaattcattaatttgatcataattcaacttgggataaataaaagttcacatttccattgaagaaaatatttgttaggcaagtactccatgagattgcagaagccaagaacccatgtaacaaaacatttcaaagtttactgttggtaagtaaacccagcagcctctcttatctagaacatgggttagcactaagaagtaagaaaaaatactctaagcagccaaaggacctgtaacaaaatatgtgctttgaagcactttgattttacacttagtagagttcccagggcatttgctcaggattgatacttatttcagatgttgttcatgcagtgttgttcatgtggtgttcctaac

SEQ ID NO: 177761 - DNA, 475 bp, Homo sapiens
gctacatataaaaatttatagtatttaatggaatatgtcttaccacactataatcaaatgtttttttgaattaaaaaatgaaaaccaatcctgttttacttagtttgataaagcactttgttcatcacacttggatcccaataacttttaactgtatgtaatgccaatttctatttttaaaatgtaggtaagccctcatttagccaaaggagtccctacaagttagtaaagaaccagcatacaataaacctagagttccagaaatgtttggaaggatagcagctttactaaagtgctcagttttccacaggagctccttggaagtgatagctcctgtttggatgcattgattctggttgagttacattccatgcttcatgtttatctattttatttgtcagagagggcattgcaaaatgtgggtctacctcaaccttacacatacaagaggttcaattaaaaattaattgaaact

SEQ ID NO: 177762 - DNA, 518 bp, Homo sapiens
cttcacctggagccaggcagagtcagaagagcactacagagtgggtatacagatacccacaggcccccactcagcccctcacacgattcttccccaagccaagggagttacagggattctccatgctgctgcctcgtccacgaggccaggccaggcgccctgactccccctggggattagtcttcagggtggagagagcgcaaagttcctccatctggcagtttctccaggggaaggggaggaggcagggagggaggctgcatatctttgggactagtgcgagatgccgatgctggtgacccagacgggcaccaacactcagccacttcccactggaggccattcagttgacttcctctctccttctttctttccctgacctctttcttctctgtcgcttttcttctctcatcatcctcccgtttcggccactcctctattggcagtctgccttagcatggcagggtccctctggttcataggcagttctggcaacagagctcaaggaaggtgactta

SEQ ID NO: 177763 - DNA, 340 bp, Homo sapiens
tcacactagtatttcagccttctgggtggggattgtttcggggacattttaagttcaatccaaattaggcacttggggattggccaggaaaaatctataaatatctgtcgtttcttctttccctttgcctcagatgaagaggcttttttctttttttctttttttttttttgagacttaactcttccatctgtgttcctagttctatcttggcttttaaagaagtacttctttgtaaaacagcttcagatacttagtagttcctttattcttagtttttgaggtagctccctaccttctccagttatcagataatcagaagacttcacttttccctctgc

SEQ ID NO: 177764 - DNA, 502 bp, Homo sapiens
gtttatatgtcatctttgatttcttttagccgtgttttgtagttctccttgaaaagatctttcaccttcttggttaaatgtattcctagatatttttctctgtgtgtgcctattgtaattgggattgtgttcttgattttctctcagcttgaacattattggtgtatagaaatgctactgacttttgtacactgattttgtatcctgaaactttactgaattcatttatcagtcccaggagccttttggcagaatctttagggttttctaagcatagaattaagttttattttcaacatttcggtgtcaaaagctgaagcgttccatctcagctggctgacctgaacaacattatactaatatttacacaatgaaaatgaacattaatagtcaaaaacacaatgtcaatataaaattgagtttagtctgatgctccttcttggaaagctgacatgaaccatctgcctttttgattatattaaaacctatttttaactataga

SEQ ID NO: 177765 - DNA, 138 bp, Homo sapiens
tgtatttttttccctcctttaagatttaacaatgtttatataaaaagaaacttgctagcagattacatacatgctcaagtactagaactgaatctcaactacttcagttcctggtagaataaatgaatgagtgtaaca

SEQ ID NO: 177766 - DNA, 517 bp, Homo sapiens
caggtgttaaaactaccaaacaaatcttaaaattagaagtttcaaattgttgctttggtcattaaatatttatttactatccactatgtgccagcagttatatgccaggccctgtgctggattaacatccaagatgaacaaggtgtggtccttaccttccagaagctcttggcctactgaggagatagttatgtaatcaaacaaataattccatgtgctaagtgctggtcagagacatgaattccctatcatgggaaatgcagaaagccaagggatcagctattcctggagagtagggtaggtgtaacctaagggtaataaggcaacgttttacctgaatcttgtaggaaaatagcgtgtgacagaagtgaaaaaggacaatccaatccctacaaatcacggaccagtgtgtagagccaggaaagggccctgcgtgtctgaagcgtgtgcagcagcaacacatggtcgtgtggggaaagcagggagtgggaatggaacagaataatttggggagaca

SEQ ID NO: 177767 - DNA, 396 bp, Homo sapiens
taatttctaaacatatgtttctggaaagccttcttgaacaaactttatgccattcttaaccatttatttattcctttgccacctcgggactttccttctttccatggtattactgtgtacccattgagggtactttccatggtattactgtgtacccattgagggtactttccatggtattactgtgtacacaatgtgaatatgtaattataaattacatattcaagttgctgtctttgtatatttacctcttcggacttgagtctaggttgtgattcagatcttttgattgtttttgcattctcccattaattctttcctagcctctgcaaatatactccctggtttacatagctactcactaagaacaagaaccccccgagaaaatataaaagc

SEQ ID NO: 177768 - DNA, 217 bp, Homo sapiens
cttactgttcccagtaattgatagcttttaatatttttaagtttctgttggttattttcatcaatagtataagtatccctatactttttttttccatcaacaatagtatcttgaatactttttatgtaagacaagaatattaggcaccctatccaaccacttttcctcccctcttcctcttttcacttcctggcagctgtatttttacttttatatc

SEQ ID NO: 177769 - DNA, 112 bp, Homo sapiens
ctttttcaatggacagagctaagaaataaacattttttaaaaagtaaaatacttcaacttcagatttatcttggttctcaacaaaattgtttctcattttatttaccccaca

SEQ ID NO: 177770 - DNA, 272 bp, Homo sapiens
  misc_feature (13)..(13): n is a, c, g, or t
gggccggtacccnggtagactaactaacctcagtgtttctgcaagggagtctggactgcccagagtgcatccgtgtcatcctgcatttggacatcatcaccaatttctttccaagggacgcttgtgcccaaacaaaacttgcacacatcagatacatgctgccaatcctgaaaagtgaacatttaaaaccttaaaactgaatttgaatgtacctgatcaatgtaatcacgtttattctgttctcagctctgtgatgtgttaggtctacctgg

SEQ ID NO: 177771 - DNA, 474 bp, Homo sapiens
ccaggttcctgcccgcccagcgcctgcctgattgctgaatgcctgccaagctcctgcctaatctggggagagctttagaagccgccctagggcaggctgctcttttgtttctggaatccaggccactcagcagaggggctggcttcctgcactgcgctgctgcggccttcaagtggacttaggtcaagagtgcctggggaggaatgcagtcccttagagcaaagcccttgtaatgaatgccttccctgcaccccctaattgggttagcgaagtgatcagctagattctcaaactaaacaggataggcatgctgcagtcctacattgttatttccatgacaaagaatctcccttttcccagtgaggggaacaagctgaggctcagagctgctaattctacttggtttgagggctctgcagaggacacactgacagaggcacctcagctcaaaggtagaaagcctcataaaaaaga

SEQ ID NO: 177772 - DNA, 1897 bp, Homo sapiens
  misc_feature (85)..(85): n is a, c, g, or t
  misc_feature (1363)..(1363): n is a, c, g, or t
ggtaaacatgttgcttggaagtatgcttttccagtttcacaaaatgacaccagtggccacagaagttagtaccctttggcctctnaaaatttcgctttatgaagagaaggctactaaaagacatgtaggacttagggttcaaggtggcagactagaggagctagtgtgtactgctctcgtggagaggaaatagtgacgagtaaacatggactctctaagtggatcatctaagaaaccacgtcaggattcaggatgcatcaagggagtaatgggacatggagaacagagaaaatcgaagctgggcagctgcctgcctgggaccagcatgaagacaggagaagctcctcaacacagggaaagaattagtgagtaagagtcctcaggggatccatacttcccacagtgacctgtgcaatcctgagaatgtgaaaaaccccatgactcccttgggcctctagactgatacagagagctacccagagtttttgcagaggcaacactcaagtccgtggggacccccacaggccctggactctggaacagcctggttgaggtgccatggccctgacagaagctgcagtcatggtgctggagatggacagattgctctactccctcttgacagaaaacctgctaaacccctgtggtttaggagagctttgtgttcccccaggaagcacttcgatggtgaattgggtgactccactcatcctgctcctaactgggcaggattcaacttcaccctgctcctaacttgggcagagccccaagcagggggtggggaggacgccctccctctcagaatactgaaaagggtgagatccctgggctctcaggatgttgggggagcagggcatgtctccctctgaagggctttccagaaagggtatagtcttgtctaccagccacagtctctgccttagggagctctatagcccagaacacctaagaaagaaaatgtggacgtggtgccagtgatcagaaggggctcctccaaggcctaggagcaaacctggtgaggttgtcagctctctctcccctgaccacagagtactactgtgcgtatgccaaaatacaacagagctacatggctgagttagaggctatctgccagccaccactcttaaggagcacctactggattacagcccaaatgaaacatcaaaaacattatgccagcatacagcacctgtgaaacctaaggcaaaaatccagacataaataaagattatgtacagagccttggctctctgcaagcacccagaaatggagccaactgactatactcaacttatgtcacagttaaaggaacatcagccctcacacatgaaaaagaatcagtgcaagaaacgctggcaattcnaaaaggcagagtgtctctttatgccgaaacaaacacattaacccatcagcagtagttcttaaccagattgtaatgactactggacagacagagaattcagaatctgggtagcaacaaagctcatcaagatccaggaaaaagttgaaacccaatccaaggtattcaaggaattccgtaaaacagcccaagagctaaaagacaaaatagctattttaaagaagaaatcaactgaacttctggaattgaagaatttacttcaagaatttcataatagtccaggcacagtggctcatgcttgtaatcccagcactttgggaggccaaggcaagaggatcacttaagcccatgagtttgaagtcagcctcctgttctctacaagaaattagccaggtatggtggtgcacatttgtagtcccaactacttgggaggctgaggtaagaggatcacttgagtcagggaggtcgaggctgcagtgagctgtgatcatgccactgctctctagcctgggccacagagtgagaccctgtctcagg

SEQ ID NO: 177773 - DNA, 222 bp, Homo sapiens
cccggctaatttttgtgtttttagtagagacggggtttcgccatgttggccaggctggtctcgaattcctgacctcaggtgatccgcccgcctcggcctcccaaagtgctggaattacaggagtgagccaccgtgcccggcctgcatatatgtatgtacgtatatatgtgtctatctatctagctagctagacactaggcattttggattaggcgcccacct

SEQ ID NO: 177774 - DNA, 314 bp, Homo sapiens
tgacagtgggaacccaggagattcgggtatggacaggcctcgatctatgcacagcaggagactagcatggctgacactaagggtgctgagctgacatacaaaactattcagctttataaacgtgtgataaaaataccgctaagtcactgacattccacaggacaaatcataatagaaatgaaaaaacagccaggcgcagtggcttacgcctttaatcccagcactttgagaggccgaggcgggtgggtcacgaggtcagcagatcgagaccatcctagctaacatggtgaaaccccgtctctactaaaaataca

SEQ ID NO: 177775 - DNA, 434 bp, Homo sapiens
ccaggcatggtggcaggcgcctataatcccagctactcagaaggctgaggcaggagaattgcttgaacccgggaggcggaagttgcagtgagccgagatggcaccagtctgggcaacagagcaagactccatctcaaaaaaaaaaaaattgcactcaaatggatgtggggtcaaaggagcgtcttattctttagggaggtcaagagcaaagtgataagggggtatcactcttcctcatactcaatcctctgtggctcctttgacacttacactacccgccccccgccccatgctttttcactcccttgacacaagtctaaagcagaaacatctaatgagaaaaactaattggtttttttagagatcgattcttgagactttgaccaggttggagagcagtaactattcacgggcacaatcagcatgcactgcag

SEQ ID NO: 177776 - DNA, 165 bp, Homo sapiens
tcagataaaaattgagggagtttatcaccactagacttattctataggaaattctaaaagagcacctacaagtaagtgaaaagctgataaactccctcaatttttatctgaaaaagtcttaatttctgtttgtggaggtagcactctgtttgtggaggtagcact

SEQ ID NO: 177777 - DNA, 733 bp, Homo sapiens
aaaaagctgggattacaggcgcatgccaccacacccagctaatttttgtgtttttagtagagatatggtgaaaccccgtctctaccaaaaatacaaaaattagctgggcgtggtggcaggcacctatagtcccagtgactcgggaggctgaggcaggagaatcgcttgaacccaggaggcagaggttgcagtgagctgagatcatgctattgcactccagcctgggcgacagagtgagactctgtctcaaaaacaaaacaaaacaaaacaaaaaaaaactctggggagtatattctttcagtatacatttatgcatttaaaaaaagaaaaaagcttaatacttcagaaatggtaaatcatttgacaaatgagaaaaccaaattctgggggcatcactgattatagagcctagaccttctggattcaagtctaggttgtactacatattagctgtttgaccttgggcaagttacttaaattttttgtgctatggttgcctcacctgtagagaggacgtaataatacacctaatttaggattgttatgaatttatatatatgtgtagaatttagaacagtttctggcatagactaagtcctattaagaggtgctgttgtaaggatttaactactgttgttactgtcattgccactaatcatcaattatcaatcagttgcctgttataaactatttagagacagaagtgattagaaaccaaactcactccaaaaat

SEQ ID NO: 177778 - DNA, 608 bp, Homo sapiens
cgagtagattaaatgcaaagcaaccagcctcaacaagcaccacacaacatgtggattatgtgaatgaaacacttgtcttctgtactgacacactctacccactagcaatgactgtataatttctaaaaaagaaaaaacgtcccacccaacaaacatgcatcactaaaaagaactgcaagtccttttaaggtagacagtaaggctttcggaagtggcgggtgagggtgttcttaggaagatttttttcttctacttttctgttgtctgcattttcttattcaccacttagggcacaggcaacttgacactagtttctgtaaccaacctggtccagcaggatttctcacacaccctgcacaaaaggctaaccccttacaaaatacttatttcagatttacgtcaaggttcaatgaattgcagccaggaaactgagctccaaacctaatataaaagtctcctctgctaatcactaaaccgatggttagccagaaggtggggaaattaaaactttatactgtttcatttcctctcatgcaaatgtaaaaagagaaacactatcttagagaaatttatttttcttcattaatttatatggaaaatctatgact

SEQ ID NO: 177779 - DNA, 253 bp, Homo sapiens
atattgaattaatagatgtgtatgatatgaggtggggagttcagattgatttttatccttttggatatcagttattttagcaacatttgtggaaaagatcttcccccatgagattgctttggcacttttcttgaaaatcaagtgacatataggtgtgaattcatttctgggctttctttttctgtcccattgatttccttgtctgtccttagccagtctcaccttgttttgattactgtagctttgtagtaag

SEQ ID NO: 177780 - DNA, 469 bp, Homo sapiens
tgtaaaggttaggttaacgtcattagagcccataattaatttaacttctaaacgattcaaaccttccaactttagttagtcaatctctgtttctataagtcactcgtcaagatgccatctgtggggtgctatagtgtcagatcttcttgtgggtaattgtaaacatccatcctttctgagggttgcccacagcatcaacttttccaaagtacgtaaatctgtttaagttctataaacacaaatgaaggtcaaggctgaaattaataggccccacactgtgactatttattgtttaacaaatgtttggttggtgaatgcctttagtggagccttgtctaacctaaattgggggagagcctgagatgggctggagctgggcatgtgtgtttgacccatttccacacacacagaaagattggtgtggcagagtgttaaaaagcttaaaggctgggctctgttctgttgggta

SEQ ID NO: 177781 - DNA, 564 bp, Homo sapiens
tttgatctatcttcaagttcacttattctttcttctgccgctgcaaatctagtgttaattctctctagtgaatttttcagttcagttattgcactctagaattcccatttagttcttttcttacaatttctttctcttcattgatattctttatttgatgcaacattgtcatcttacctcatgttccttctttaatttggtttcctttaattctgtgaacatgcttattatggatatttgaagtttttcctgataaagccaacatcttgtcattctcacaggcagcttctgttgcttgcttttttctattacagttcctgtcttattctttgcattcctcttttttgttgttgttgttgttgctggaaactggacatttcagacaacatattgtatccttgctaggtactaatcttacttcctcctgttattgttattggcttacctgtctgattgctagctggattattttaatgaagtctgtttatccccaacagagttaaactcctgatgttatcagctcctcagggagacacatacttgagtatctccaaggtcactctg

SEQ ID NO: 177782 - DNA, 436 bp, Homo sapiens
catttcttcttttcatgggctgatgttttcctaatatgtgtaaaatatgaattgcaagaaaaatgaaattaaaaaccacaatatataatttccatttcaaaaattattggattcagtagatgtaacatttatctgtcaaattgctaccaaagtttctaaatgcttgctctcaccctctctccttactcctcatggactaggtgagtgccagtttgccatctaggaactagactttgactagcactgcctggagtgttactgcttgattctttttaaaatgatagactagtgattagccattcagttgaacttctctgctgttttccatggatttttgtagggacaccttcaatgtgaagcccattttagtccttaatggggagggatgtttgggattgttttgagggcagatgtagcagcggtgatgagagttgag

SEQ ID NO: 177783 - DNA, 583 bp, Homo sapiens
aagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaatttaaaaaaaatcactggattctactcaatagtagaatggatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaattattgtgaagaggcattaaaagaatccaaaatatatattcatggaata

SEQ ID NO: 177784 - DNA, 329 bp, Homo sapiens
cttggcctcccaaaatgctgggattacaggcgtaagccaccatgcccggccagccacaagtctcttgacgtaaaccaccacatcaagaagagggcacacatctatttgaggcaatggacaggaaagatcagttttgtggcccccaagatcctgccagaagtgtcatcccatggtgctgtgtctcaaatctgagtaggtggggccgagtgacaggggacagccagaggtgagtttcttgatgtactcaccctttaccctggaaggaagccttgggaagacattggcagtggaggaaggggggtcaaggaggtagggaggtgatcattttt

SEQ ID NO: 177785 - DNA, 518 bp, Homo sapiens
tctctggtccatcaggaactaatggtggaatcttcccatcaaagtcaatcgcaggcaaactaaaggtgaaataaaggtctcagcaaaaaggaaatttttcctcccaagatgatcttaggaggccttgtctttcattctttagtgtttctgccagaaaatcaattgttaaattattcattgagtcagatcaggtcattttgaaagtaatcttcagagtgagtgaatctttatcaaagttgacactattcctgatatctgaacagattagttttataatttaatacttaatctgtccacaaaacacaatgagaaaaaaatgctgcagtaacctgggtattgaaggactcgccttcttgattgtttttattctctttttaccttatcaggtgaataaaacttgaaagtaataaaaagagactcataaaacaatgctcattttgatttacacttctaaccccttaattatcagcagcttaactgtctctcctgatttccatctgacttcaggctgagcgaca

SEQ ID NO: 177786 - DNA, 317 bp, Homo sapiens
aagcactagttctctctaccgcctatgacagaagaatcttgactgtacttgtcagttggagtcatctattccttgtatttatctttaataatcactgaaggagttcatttaattcaggagcttacaaggataacaaaagaattggatgacaatgactagcatgaaaccaagagactgacctgcacacaaaatgctagtcaacataaactgtgaatattgattacaaactacaaatatcagtagcgttaactccggactctcctattcaaggagctgatgatacccacagccttgcataactgaaggaaatggctttg

SEQ ID NO: 177787 - DNA, 601 bp, Homo sapiens
ataatagcttcacaaatagagatttttcatctggataagaggaggagagttccagaaagaaaatcctctgggaaaaaaacagattgaatagaatagcaattgtaaattaaaccatttgaaattgatgttttgttgattaaaaaaaaaattgcttgctgagcacagtggctcatacctattatcatttggaacatgctaattgcttttggccaagttatttttttgcagtgagaatcaaatgacaatgtgtatgaattttattttattttattttatttttgagacagagtctcaccctatcactcaggctggagtgctgaggcgtgatctcagctcactgcaacctctgcctcctgggttcaagtaattcttgtgcctcagcctcccaagtagctgggattacaggcaccagccaccacacctggctaatttttatacttttggtagggatgggatttcaccatgttggccaggctggtctcaaactcctggcctcaagtgacccacctacctcggcctcccaaagtgcagggattacaggtgtgagctaccacaccgggccgaaagtatttttataaagccaggtgtggtggttcacacc

SEQ ID NO: 177788 - DNA, 405 bp, Homo sapiens
aagcagaggtgacaccaaacttcattccagaggctaagcctgacccaaatccagttcagccaaagctaggaaaccagtctccctggtaagcctctgaatgtgatgttagtattaaaaggctgctgcgtggtattatactagcagccactgtgtcttagctgttgagaaggacctcctgtgtggtggaaaccggggttttttatttccaaaattccacatgaagcccttcctctactgggggttctgaagaccaactgctcctcagtagtcaggactgtgacaggaaggattttactcaccactgacgcagcctcaagttgtctcaaagtgaggcggtgtccccttagatctgtgttgaggaaaatgaggttctcctcctcactgcgggcccggcgctggcggccg

SEQ ID NO: 177789 - DNA, 737 bp, Homo sapiens
gcttcagcatggaatggaggccttattgccttgcggatggctcttttctctttgttctggaatgagcatgactatcgacttggacactatggtgcagaggaccatcagacaccgagggatggagagacatcccacagggcccagattcagcagcagcagagctacgtagaggatttgaggcatcaaatcctagcagaagagattcgagctgcgaaggaactggaatttgaccaagcttggattagccagcagattaaagaaaaccagcagtgtctgctcagagaagagacctggctggccagcttgcaacagcagcagcaagaagaccaggtagcagagaaagaacttgaggcatctgtggcacttgatgcttggcttcagacagatcctgagattcagccatccccatttgtccaaagtcagaaaagggtggtgcacctgcagctcctgcggagacacactcttcgggcagcagagcggaatgtccggcggaaaaaggtctcattccagctagagagaatcatcaaaaagcagaggctgctggaggcccagaagagactggagaagctcacgacattgtgctggctccaggatgacagcacccaggagcccccataccaggtcctcagccctgatgccacagtcccacggcctccatgtagaagcaaattgacgagttgcagttctttgagcccccaaagatcatctgcagcagagcacatgccccagctacacag

SEQ ID NO: 177790 - DNA, 757 bp, Homo sapiens
ctgctggtcgtggctcgttggagtggctggatttggatggagatctcgctgcctcccggctgggtctctcccctttgctttggaaggaaaggagagcgcttgaagagcaatgtgacgaggaccatcagacaccgagggatggagagacatcccacagggcccagattcagcagcagcagagctacgtagaggatttgaggcatcaaatcctagcagaagagattcgagctgcgaaggaactggaatttgaccaagcttggattagccagcagattaaagaaaaccagcagtgtctgctcagagaagagacctggctggccagcttgcaacagcagcagcaagaagaccaggtagcagagaaagaacttgaggcatctgtggcacttgatgcttggcttcagacagatcctgagattcagccatccccatttgtccaaagtcagaaaagggtggtgcacctgcagctcctgcggagacacactcttcgggcagcagagcggaatgtccggcggaaaaaggtctcattccagctagagagaatcatcaaaaagcagaggctgctggaggcccagaagagactggagaagctcacgacattgtgctggctccaggatgacagcacccaggagcccccataccaggtcctcagccctgatgccacagtcccacggcctccatgtagaagcaaattgacgagttgcagttctttgagcccccaaagatcatctgcagcagagcacatgccccagctacacag

SEQ ID NO: 177791 - DNA, 154 bp, Homo sapiens
tgctataaaagagaaaacagctcgatgttctctggccatgactgaagaacttctccaagacctggctcagtataaaacacacaaggataagaatgtaatgatgtgtgctagaactttgattcagctcttccgaacactgaatcctcagatgctg

SEQ ID NO: 177792 - DNA, 393 bp, Homo sapiens
ttaaaactgactaatgtccagcattagctgaaacagctaatttcaaaaatccaatataaacaaagccaaaagaaacactctactttttcatttcagatatgaacattttaaactaccagaaaaaattagggaattagaagtcgtcaattaaaggtacattatttctcaagtgggagttttaatttacagaaaatattatctcacccttagagtatattagcttactgtgggccattagctccagcagaacatcttcttttgaagatagagcactaagtgcactgctcaggtaaaatttacattttaaagaccttgttgactttgggcagataaatacctttgttttgaaacaattaattaaaatcactaaattgcgtgtgtgtgtatacatta

SEQ ID NO: 177793 - DNA, 439 bp, Homo sapiens
ctccagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaa

SEQ ID NO: 177794 - DNA, 661 bp, Homo sapiens
acattacggctagtacgaggcctcgttggaatcggccgaggcaggtcaggggggtaattctgactcaatggacctaacaggattctcactgaaggcaggccaggaggatggtggaggatggtggaggatgaggaacaggatcagatatcaagggtgagcatgtggcagatggaggattttgctaaactgcactcatagggcttttgctagaatcagacaatgcagagaggaacgcagaagccccaaagctagggcttctttgagaagagagctcagaagaaccggagtggagtttggtcaaggagagaatctttgtcatggacgggggaagaacagcctgcagggaagctggagtggtccgtggtggcctgcgtggactgggggcctgggaaaccatgggaaggatgttgcgctctctcccatgggccgtgggaagccacggataagacacgtgaaggtgggggcagtgggaacatatgggggatggcttcaggaagtatttcaggctagaatcgccaagatttgatgacaaactggatgagagtagcaagctgcgttatcaccatggggatactaattttgtggaactagagaatctgccgtattattttctgattgtgcttgctttccactttgctgctccaggccccccactagtctg

SEQ ID NO: 177795 - DNA, 633 bp, Homo sapiens
atggctccaatgaagcactctgggaatgtttgcagcacttttcttactcctctgttgcctgtcctcatgtctctctcccctaccttgtcatgacgtcttcgagatgggagctgtgggttatttcatcttcatgtctcagccctcagaatgggttctgacacttcgaaggtcattaataaatgtttgttctaaaaatgaatgagtggcttctgtttagagtaacatggcacactgggtacccagaatatgttcccattgaaaacagcaaaaaatgtgggataaaatatattgtcagttttgttggataaaatatattgtcggtttttaaaaaagcattaacaaaagagtaagaaatcctctggctaaaatttagatgaagtcatgaacgcagaggaataactgtggtactgagactggtttttgctaaggaggtattagccaacctatgtagcgtgcttcaatttttatcattttttgaggcacggaatacagtagtcaatacctggggtcaagccaaggtggggttccagtaagaggccttcaccccatagcactgggactcctcagaataatagcaaattagaagggacttgcccacccacagagatacacaaaggactgccaggaaagtgc

SEQ ID NO: 177796 - DNA, 485 bp, Homo sapiens
atgtatatcagattttaaacttcttaagaacatagtgctaaaataaaatcaaagtacttattttttcccctcaatagtagttggagaattgtaggtataagattggggtctcacctacctcagtggaggcaagtcattagttacaaaaaagctacaagccaaagttagccttggggctgcctgtcccaccaactaccaaaaaagactttggggagatgttcaaagaaggaaagaggagaatccagcctggaaccaaaaggcattgaaacacattttcttgtacttttcaagtctgtgcatatagattctgttactgatttaggatcttaaacagtttgtttattttttaaatgcctttcagctcacctttaataacatgtttctttgacttggctgaactgtgcctcagaagaattacaagcgggaataaggctgggataaggctgggtaaaaggttcagtgaactaatccacacctggtccatg

SEQ ID NO: 177797 - DNA, 307 bp, Homo sapiens
gttttttttactcccaatccactgaggaccaatactagatagcatctaagagccattccacctttaacatcacatggacctaagttgaaatagtggtcaccttgtaattgcctggtgggttcttcctgcctgtcgcatggacaaaatcggttcactgtgactgtggtattgctgtaaagagtttaatcaggccgggcatggtagctcacacctgtaatcccaacacttttggaggccgaggcgagtggatcacctgaggtcaggagtttgagaccagcctggccaacaggatgaaatcctgtctgta

SEQ ID NO: 177798 - DNA, 177 bp, Homo sapiens
cagaaaagacacataccccttctactcagagcacattgccagaactagccacttgaccctaccttctagaaggggaactgggaaatgtggaagagctcatgcaaatgcggtgaagaataattatttccaggcggtcgtggtggctcacgcctgtaatcccagcactttagggggcca

SEQ ID NO: 177799 - DNA, 573 bp, Homo sapiens
gtcttagtatattacctaggctgctctcaaattcctgggctcaagcaatcttcccacctcggcttctgaaagtgttgggattacaggtgtgagccactgagctgggccctccaaattcttttttcttttttttgagacagagtcttgctctgtcacccaggctgaagtgcagtggtttgatctcggctcactgcaacctctgcctcccaggttcaagcgattctcctgcctcagcttcctgagtagctaggattataggcacctaccattacgcccggctaatttttgtagttttagtagagatagggcttcaccatgttgaccaggctggtctagaacccctgacctcaggtgatccgaccgtcttggcctcccaaaatgttgggattataggcgtgagccaccgtaccctgctgggccctccaaattcttaaaggaatgtacctgtccagcggactctctccacagggtggttttctaacccaggggtcagcaaatttttgtgtctgaaataacattagatttatagaagagttgtaaagatacaatgagttcccatgtgcccttcacaca

SEQ ID NO: 177800 - DNA, 256 bp, Homo sapiens
cttgtttttactacacacaaatgaagaaattatttgggttttagaaacatttctagtgaaaaagtgccattttgctttatgcaaatgtatcaaagaaaaaaaaggggaaggcatcagatagacaaataatgtagtaagactacaacctcaaaatttggatgtatcccagcaagtaacaatctgacaatactctatcctgattaaaatcacaccccccaagatgtaatagtggtgtagacatttcaagaatagtata

SEQ ID NO: 177801 - DNA, 474 bp, Homo sapiens
gccaactgcaattacttagtgtaagtagagtcgttaaacaccatcaattaatgcagctgtttcaagataatcagcagtcattagagcaagatgcacaagagaaaaaaaatcatatgctgctaacttagcaatgctagaaattatgtgaaccgaggatgagacaggcttgcttagatcttcctgcctgctgacgttagccacctcccaaaatatactttctttctcaaagaagacagtgatttttcactttgaagacagagccaaaaaaaatcaaccatccatgccatgaccttcgaccataaatgcccaagctttgatttttcaggtctgtgtttccattagggactgcaacggagacagacacactggcgacaaaagaggttccagtctgggaaatcaagagatgatcatgaccagagaagtcagagcacctggggagccatttgtaaaacagagaaagggttttcccccttt

SEQ ID NO: 177802 - DNA, 292 bp, Homo sapiens
ttgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggt

SEQ ID NO: 177803 - DNA, 438 bp, Homo sapiens
  misc_feature (177)..(177): n is a, c, g, or t
  misc_feature (269)..(269): n is a, c, g, or t
ttctgccagatgaaccttcttgctgtgattcataaacatggctgtacctctaaatagactgggacttccttttgctctatccccatttcctaaagaagaaacctgatccttggaaatgttcagtggctgccccaagatgtcggcacaacctcttgtgctcttgcctcctgccacaanaacatatgtcccagaaaagggccactccatcagcctaggtccagaaatgagaggacacatggactgaacttgaagatggcccacagcagacntgcagtcaactctcagcctttatgtaatgcgggaaagaaggaaatgtgaatattatagactactaaaattctaaagttgtaacagggcaaaatgatcgatacaattagcagtggctatcagtctagcatattgtcatgctatatgcatgctataaaactattgaacaaa

SEQ ID NO: 177804 - DNA, 815 bp, Homo sapiens
atttcttgcaggaagctggagctgccacttatgctgggaactgctcaaagagaaagcctcagcctttggctgccaggcctagggccccaggtcacagaatgtgactcgctgctggagatcctaaagcagagcccagttcaaaccagaacgcgccctcctcccacatatccagccagaccaactgcaaggaaaagaaatagtcccagaggggcagggacacatggaacgaagagggtgaggcatctcctgacctcccccgatatgtacggaacttcagccagcacctccttgtctctaccggaaggaagttgcactttgggagaacacctccggccccagccctgtggaacccctctcacttttaccctagcaccgaggccctctcattggttcccattttaagggaagccatttcctgaccactcatccattacttgtgtgtagtgtggtgtttttttatctattgtgttccaagaaatcttggcacagcccccgtgcccccagcttagggtctgcatcctgaaattctcacctgaggaacaaagggctgtggagaagttgtcgtttatggcaagcctcactggaaacttctagacttggggtcttgaaaccctttcttgttccttggtgtctgtggagacaaagagttgccttctagaaccccagcagtggcatccacagccagcctggtcttgagccactgcttaaagttactagatgggggcggggagggagggagacgcgcagagacatgggaggaaacattgtggaaatggtgccaaggccccgccatagccagtcagtacttgttatcc

SEQ ID NO: 177805 - DNA, 297 bp, Homo sapiens
cggcacgaggttttttttttaagtgataaattttcaattttattttaaaatataccagatgtgagattttattggagccataaatatgtcaagagcaatgttggtgtgtgatgggcgatgccccctccttggggcctctctccctgtttagaaattccatcagattcttaataagaggctccagttcgactgcagcaaaatagtctctatattaaagcaattgaatttccatttgccagacatcttgtgctttaagcttccaggttccaggggtgtggggttgctaagccgattcta

SEQ ID NO: 177806 - DNA, 192 bp, Homo sapiens
cgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaatccgaggtatgaattctctggtgtaa

SEQ ID NO: 177807 - DNA, 299 bp, Homo sapiens
gaaaatttcaggggctgtcgccctgggcctctgggattctcatcacacagtaagtctagttgactgaagcatgaggaagaaagatattgccaaatgtgtctcaatcactgatgtaatttgcagttcacatcttttcagtgaaataacatagagtatatgtggctagctgaaacttattttaagtcacaactggaaaagtaaatgaaagagaagagagaacctcataaattaattgagtggcactttagaagcaggtgcaaccaggctcttgaaagcatacatctcaaccctggaagtct

SEQ ID NO: 177808 - DNA, 329 bp, Homo sapiens
tgatcttggccaaaaggccaagaagcgataggtaacataaaaatacagatagtttgcccagtatcatgaagggaataggagcagacttagctcttggagaaatagaatctttccttatttactgttgcagtaatgagttatttgaatttttatttatttattttagagacagggtctcactctgtcacccaggctggaatgcagtggtagcaatcttcctgcctcagcctcctgagtagctgggactacaggggcatgtcaccatgcccagctaattcttaaagttttttttgtagagatggggtttcactatgttggccaggctggag

SEQ ID NO: 177809 - DNA, 794 bp, Homo sapiens
gaatttcatataaatatattatgtagtcttttcatttttggcttctttaccatagcatgtttttgatattcatatctgagctgtagttcctacaacttctgttgtggttcagtagttccttcccttttgttgctaaataatatttcattgtatatagagaacacaatttgtttatccatttgcaagttaatgaacatttgagatgttttgagtttttggtgaccatgaacaatgccactataaacattcacggacaaggctttttgtggacatatgttatcatttctcttagggaaacacctaggagtggaattgctgggttgcatggttatgtatgattaagtgtggatttatctttataagcaagttcaaaactgttttccagagtagatgcaccattttccatttccaccaacaatgcatgagagtttaagttgtatcagtttttgtaattttaatcgttatagtatggttatggatgattcaaaatatcttctttggtgaaatttctattcaaatattttgccaaattttgtgttggttcttattgaggtgtgagagttctttgtatattctgggtaaaagtctgccagatttttttagcagatgtattaaggcataattgctcaataattactcaataagctgcacatatttagtatccacttggatacatattaacataggtatacacttgtaaaacagcagccacaataaaaatcatgaacatatccatctctcccaaaagtttacttctgcccttttgtaatcctaattattgcatgctttctttt

SEQ ID NO: 177810 - DNA, 283 bp, Homo sapiens
ccgagtttagttgagggcctaagttttcccagcagggcaaggttgagggtgaggatgctgcaggccagttttctatggcctcagaatgaggacaagaagggggagatgggccacagggatgagggtgcctgctccctgcagcagtgtgcacaccacggctgtgcagaggcagcaggtggcaggtattgggaagaagctcttcccttgtgtgtcctaggggctgggcacagcctgatgggccccctttgctcacagttgcagaagcccatccatgtagggtcct

SEQ ID NO: 177811 - DNA, 208 bp, Homo sapiens
agtctaaacctaaccaaatcttctatctctctcaacaaactgtcttaagtccaaacattctggaacagcagtagtgaaccgtttactcttcagaggcaataacaactcacaattttctcaggacactagattagctgagtaactaaatcatcattcagtccctcattcaacaaaacaaacgctcattgctccaaagaggccagccaga

SEQ ID NO: 177812 - DNA, 342 bp, Homo sapiens
aatacagataactcaattaaaaaatgggtaaagaatttgaaaagacagcagctgggtgtggtggctcacacccgtaatcctagcactttgggaggccaaggcaggaggatcgcttgatgctaggagttggtgaccagcctgggcaacatggtgaaaccctgtctctataaaaaaaaaaaaaaaaaaaaaaaaaaacttgccaggcgtggtggtggcacatgcctgtagtctcagctattcaggaggctgaggtgggaggattgcttgagcctggggaggtggagactgcagtgagccatgatcatgccactgcactcccagtgagaccctgtctcacaaaaa

SEQ ID NO: 177813 - DNA, 107 bp, Homo sapiens
tcattgcttgctctgtactgacgaccagtgctcgggacgtccttcccatccgagacttcaagatagaaaaacatccctatttcaatccctttgtgttttgttttttg

SEQ ID NO: 177814 - DNA, 549 bp, Homo sapiens
ttttttgtagagatggggtttcgccttgttgcccaggctggtctcaaactcctgagctcaagtgatccgccctgcctctgcctcccacagtgctgggattacaggcgtgacacgtaagaaagtttctttgtgcccctttgcattcagtactatcccctcccctccagacaacaagtgatttgatttctaccactaaagaatagttttgtctattccagaacttcaaataaatggagtcaaatgagtcggattcttttctgtctcactttcctcccgccgagtgtatttttgagatttatctatgttgttggggatgagtagtttttcctttttattcctttttccttttattgctgtgatactccactttatgaatatgccacaacttgtttatccatttgctttttgatagacattgggttgttttttgttttgtactattttgaataaagctgcggtggacattcaactacagttgtttgtgtagatgtgtatgtgtgttttttttttttctcttggataatacctaggagtggaattgctgggtct

SEQ ID NO: 177815 - DNA, 296 bp, Homo sapiens
ttagttctgccctcagaagtataccttctctccctccctccttctcccccttattctcatcctccagtgatactacatggctgggggtcccctgctgctccatgcccctagccctttagccatgctctctcttctgcctgggaagccctccccacctttctctatcttgccatttcttgttcatcttgcaccattcaactcaggccccctctcccaggaaggcttcttggaaccctgggactgggcaaagaacccgcatcagcctgcctcatcattaaccctcaactgagcttgac

SEQ ID NO: 177816 - DNA, 171 bp, Homo sapiens
ggaaagaatattcatttgagtgtttcaggaagtttggattttttttttaccaacatattatttgtaaaaggagggaaatcagctgcctcaggaggttcttaacatataggaatgtaattatcagattcaaagctgaacagtagtgcgttgccctgtaacctaagtcttggc

SEQ ID NO: 177817 - DNA, 621 bp, Homo sapiens
aaagcaattctcctgcctcagcctcctgagtagcggggataacagggtgtgtcaccacacccagctaatttttgtggaaggtatgatgaaggacgcgtccttcatcatacctaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtgtagatgaatatggttttta

SEQ ID NO: 177818 - DNA, 995 bp, Homo sapiens
gagacagagtctcgctctgtcacctaggctggatcccgagttcaagcgattctcctgcctcagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgtgagttataatctaaattaggggcaagtatccctttttttatatgatgaaattgtgcataataacttggctagggcaagtctccaaagtaattcagatttaactcttcactgctagacccagttgtgttcaactttttacatattattgccaacacactttatctctctgtgtacagtgttaatctgattttataaatctatatttttttctttaagcaaatttttgttttaaaatttgaagccaatcataaagataatatagcataagacattttcttttctaaaaacaatcagcatcattttaaaaggatgaactaatacaggtgtatgtaatagcagtgtttccaaactggcaatttatgctttaaatttaaaaataaggtcatttttctccatcaggggcaaatgtttacttgtaattttcttcctacagttcgtgttaaattactttttactattattatattgtaaactccttgggatttggcaccatttaaaaattcatctttgtattcccttaatatttggaacagtattgtacatatggtaggtacttaataaaggtttgaatgagtgtgtagatgaatatggttttta

SEQ ID NO: 177819 - DNA, 555 bp, Homo sapiens
ctagatctccaccatttgctacaacccaccttcacagacttaccttccaatcactttcaatgttccttcaatgccaggaaaaatattgctcaactataggaattgtgactttccctcttctgtagcttcacttaccctggtctccactcctagaacacccatctttcccatccccactgttggaggttcacatttaatttcttctgcaatgcttttgtgattccctagtaagaacaatatgttcctacactaaactcctagagcactttctctatttccctatttaaagccttcccattttcttcttttaaatacatcatgtgcacattttacctcctcattaaaacagtaaacttcctggaatcagagactgtctctctttcataatactgttcaccatcatcagtgtcttctattttatattggtgggttactgacccccgcaataactggtaattttcttgtcctaatcctgtttgtacaaagccaaatatgcactggtacaattgtgtggtgagcactatgtggtcatgaatggaagcgcaccactgtctt

SEQ ID NO: 177820 - DNA, 404 bp, Homo sapiens
ccccctcagtggatctgctgtcacaaggagtatagccgtaaaattttagcctgtgaaaatatgtaggaaaatgtaaaaaaaaaaaaaaaaaaagacactgaggatgcaaattacctgtatacttggaagtgatttgcaaaagcgttttgctaaacaggcaacattcaagggcctgtaagaaaccagattgattgttttgcttagcactgctgctgctggagctgctggtggttctgtggccagcagtgaacctgatatgctctgcagtgtataatagccatactgtctgaaacagtcttttgggtttacccagggtaacacccctttggagtgtcccccagaaagaacctacctgctctgagtctccagctatgcacttcacccacctagtcgtctctcccctc

SEQ ID NO: 177821 - DNA, 351 bp, Homo sapiens
tgctgttccttctatcctgtgcttctcctcctgtgtccacttggtggaactttccccatggtttgcttcttccagtaatctctgtctggaccccccatcttctagagagtttattgctccttcctgatccttgtaacatttttattattgtgctcatcatactgtaatatctgtttacatacatacgaccctttactaaagtggtaggaaccacatattatttattgctaaagctcaataacttagtacatgtaatattttaggggctcagaaatgtgaaattatctccctttattgagtttttatgtgccaggcacatattataaatatatgtcaagaaaaagataacct

SEQ ID NO: 177822 - DNA, 110 bp, Homo sapiens
ggtaattttcctaaatatagtaactgcccattatagttgaatagaatctgctttattttctaagtttaagttaaagtattacctttttttgtcgttagcaaattttctgg

SEQ ID NO: 177823 - DNA, 662 bp, Homo sapiens
ctccaaacaggggttcactcagtggaccagggaagaagcatattccaggcagaggcaaagacagggtggggagaggagcgcacacgcagggaagagagtgagaggcagggcggggagggagagcagggggcaggggagctagggacagggcagtgctgaaggatcctgacatgaccctatttgtgtttcagaaaaatcttcctagagactctgtggaggacagataagagggcaaacaggaggcaggacagtcaactaacaggctgctgccatattctgggaaagaaatgattaaaatatacattagaaaaccaattcagacaaaagctttgggtgtagatgtcagggatatccataaagtagaatcacaggacttgacgatgaattagacttggggagggaaggagaaaaaaatctcaagtgacccctggacttctagattactatgcaccatactagtctacttgcccaaataggtttttaaagggagagtccattcttttaataaaggataaatcctccttctaaagcaccataatttctgtcaaacatggtgtccctggccacctcttcctaggcttagtgtcctgggctgtaatgccaccatggctgagcctaagtaaccactttcttcattctctgccaattacttctctgtgtga

SEQ ID NO: 177824 - DNA, 262 bp, Homo sapiens
tgatgtttgttctccctcaaatgccctgcccttattctctgccttactcctacatatactctaggtctcagctcatgtgtaacttctaaggaactgttccgactcacaaggaagtcttaggtcctttcctgttaatcttgtgtattccctaattaagtcacttataacattgtactatataacaattttttattttttatctgccttcttcttttttatttatttatttatttttgagatggagtttcactcttgttgccct

SEQ ID NO: 177825 - DNA, 87 bp, Homo sapiens
aaggcctgatgttaaacattcacacatatatatttaattggaattttaaaagagaaaataaaaatcatagaagtaattttaaagata

SEQ ID NO: 177826 - DNA, 166 bp, Homo sapiens
attagcatgccagcaaaaactccatcttaacagaaatgaaagattcagagcaactaaatccatccctaggtgccagagctgactgtatattatggaaggaaaatacttttcgcccgtgttttgaaaggtcttctttcaccaactctctaactgaactgagatacat

SEQ ID NO: 177827 - DNA, 710 bp, Homo sapiens
tttcattttgttgatattgtctattgaagaacaaaagttttaaatttggacatagttcaatttctctatttttgttgttgttgtttttgttgcctttactttttttttgtcatattcaataaatcatagccaaatccaatgttgtgaagttttctccctggattttcttgtaacatttttatacttttaggtcttatgtttagatcttggatagttttagttaatttttgtatatcgtataaggtaagggttcaacttcattcttttgcacatactcagttttcccatcacttcttgttgaaaagactgtcctttctctattgaatggttttgtcatctttgttgaaattatttgacttacatacaatggctgtatttcttggctcgctgttctgtttcattggactatatacatgtctgtttttatggtagtccatactgttttgattactgtagttttgtagtaagttttgaaatcaggatatgtgagcctctttgttcttttcaagattgttttggcttgaggatcctttgagattcatgtgcattttttaatttttgtaaaaaagaagtcattgggattttgatagggattgcattcaatctatagattgttttgggaagtatggctttttttttttaatgtatacactaagagagagaattcagggtgggctgcttgtaaaggatgaggcagccaatatggccat

SEQ ID NO: 177828 - DNA, 494 bp, Homo sapiens
cctctgtgtgtgtgtctctccttttctctttctgcttgagttgtaacatttctctctggggctgttgcccagattaaagccctggagaaacatgtgactgtgtatagccactgtttagtacctctgaccccgcaaggtggtacaccacatctcttttctggcaaccccccaaaatgagtatttataggatttcagtgtcaagctcttctattaaaacaacgtctctaacatttaaatgctttatttccaggatatccagcatgttctcaaagataaaaaaaaattacataacttatactgttcttttttctgtctaattttaattgcttaagtaaaaacaagaaacaatctaagtcattcaaagctttcagaccagcaggatgtcttggggaaagcctctgaatgaaaaggcccaaatgtccattagtaggggatggattaaatatacttcaggatacctatgtagttatgaaatagagtgaggaagctctcta

SEQ ID NO: 177829 - DNA, 334 bp, Homo sapiens
cctgattctttattatggtcactttcagggaaagaagtccttgaaaatgtatgactttggggtaacttaaacatttgtatcctgggcttattctcactgggttttgcaatccattttcaaatgatcacatccatttttttttctttttttctttttctttctttttttttttttgtttgtttttgttttttgaaatggtcttgcgccatcgcccaggctggagtgcaatggcacgatcttggctcactgcaacctctgcctcccaggttcaagcaattctcctgtttcagcctcccaagtagctgcaatcacaggtgcctgccaccatgcccag

SEQ ID NO: 177830 - DNA, 291 bp, Homo sapiens
atttttaaagaataattggaagcctgacactccttcatacatacaagtaaaacagagattactcttaacatgtcaggaaaaaatttaattggaaaaagcattgatgcagtaatcattaaacaatgataactgggtttgtgggtctcaaaaggaaaactggcagaaatgcaaatagaaatagataaaaatactattgtatttcatatttacagcattccactaccagaatataaggccatattctgagaactgagatttcattgtgctcttacttgtttctccagtcccttg

SEQ ID NO: 177831 - DNA, 396 bp, Homo sapiens
aatggcaatctcattcttcctgtttttaggccaaaagacatatctagaaccagacatagaatcatccttaagtcctttctttcatacttcacatctaattcatcagaaaattatgtctactctatcttcaactacttctcatcatgtccatcactatctccgtggtccaagccccatcatttctcacttggataattccaacagcctcctaacttctctgcttctgcccttgcctctacatagcttattctcaaaaaggtggccaaagtggccttttaaaacattaatcagtgtcacgcatcagctcaaggcctccaatgacttctcatcagagtaaaaaccaaggcctttggaatagccctttaaaatgtggacccatcattaactcattcacct

SEQ ID NO: 177832 - DNA, 853 bp, Homo sapiens
  misc_feature (684)..(684): n is a, c, g, or t
  misc_feature (743)..(743): n is a, c, g, or t
cttgctgtggctttacatctgtactctggaagccaaaatgcaggaaggtatcgagcgggatcggagagcccaggcccctggtaacttggaggaatttgaagtcaatgacctgaactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggttggtacttgctgcgtgtcaggtcctgcagtggtggnagcttaccttagcctcccgtcaacaactctcacactccctgtgggagcagtctgtgccnaagtggagacactgagatagctctcatagactcccataagctcctccgaagcatcatcctcctgctgatgggcagtgacattctctcaactcaagaaagcagtgtggaga

SEQ ID NO: 177833 - DNA, 795 bp, Homo sapiens
  misc_feature (21)..(21): n is a, c, g, or t
  misc_feature (26)..(26): n is a, c, g, or t
  misc_feature (626)..(626): n is a, c, g, or t
  misc_feature (685)..(685): n is a, c, g, or t
cattcgatgacccccgattantgagnaggctgggcgcccaatcgggcacagggtgactatgaagataaactccaggaagatcgtttcctatacagtaacattgccttcaacctggctgcagatgctgctcagtccaaatgcctggaccaagccctggccctgtggaaggagctgcttacaaaggggcaggccccagctgtacggtgtctccagcagacagcagcctcactgcagatcctagcagccctctaccagctggtggcaaagcccatgcaggctctggaggtcctcctgctgctacggattgtctctgagagactgaaggaccactcgaaggcagctggctcctcctgccacatcacccagctcctcctgaccctcggctgtcccagctatgcccagttacacctggaagaggcagcatcgagcctgaagcatctcgatcagactactgacacatacctgctcctttccctgacctgtgatctgcttcgaagtcaactctactggactcaccagaaggtgaccaagggtgtctctctgctgctgtctgtgcttcgggatcctgccctccagaagtcctccaaggttggtacttgctgcgtgtcaggtcctgcagtggtggnagcttaccttagcctcccgtcaacaactctcacactccctgtgggagcagtctgtgccnaagtggagacactgagatagctctcatagactcccataagctcctccgaagcatcatcctcctgctgatgggcagtgacattctctcaactcaagaaagcagtgtggaga

SEQ ID NO: 177834 - DNA, 295 bp, Homo sapiens
ccttgtgctaagtggagccttccctgcaaggataagactggactgcaattggccaaacagacagtatacacatatatgtactgtgggctcccattatcttatatattccaggtgttcaagatgtgattaacagagtgaggggcggagaagccacataatcagattggtcatgccaagcttgttaactctgatctgtgtaggttcagaaagcttgccaaagcaaaggagacccattctgtccaaacacagaaggagctgtcttgctctcttaagtcctcaagaccttcctatgagc

SEQ ID NO: 177835 - DNA, 365 bp, Homo sapiens
aaatcacccataaaaacaccccattaaagaaagtaagaggttttgagcatggaagaagaaaagattatggaaaaacttggaggtattttcaaatattttaaaaagatgacagctctactctttaacaacaagcgaacttccttgggaggtgaagcacctgtcagggctattgtagatatgactttggcattgggagtggaagttctccatggattctaccttgacatctgctgcaactccagttcagcatgctataggcgaaatttctgtgacgctactgatctcctgccatacctctcacttaagcctcaagggctacaactcttcactaagcccacacaacatagctttctgtaacaatattc

SEQ ID NO: 177836 - DNA, 504 bp, Homo sapiens
gagccggcccccttaggatactcaacagctataaacatgctcaagttcccacctccattaccttcctacccttagctcatgtcttctagctattacctctccttccttattcatccaacctcttttaaagaatagcttacactagtcatctcctttttctcatctgtcattcattcttttatcaactccactctgatttgtctccaacactgtacttacactgttcttgctaagattaccaatgccatcttacttcctaaatcctacagatgcttttcagcatacctctatgcatttaacagtactgatcacctctatccttctaaaactctactacaccagtttctgtgtatttctaccacttccgacttccttcttgggctcattttaagtgctggtactctctagagttcactcctgagcccttttctcttgtcacctctttaggtaatctcaccccctctcattcaaagtatctcctggccaggtatggtggctcagacc

SEQ ID NO: 177837 - DNA, 518 bp, Homo sapiens
tatttttccctcaacagtttgcacctcaacagctataaacatgctcaagttcccacctccattaccttcctacccttagctcatgtcttctagctattacctctccttccttattcatccaacctcttttaaagaatagcttacactagtcatctcctttttctcatctgtcattcattcttttatcaactccactctgatttgtctccaacactgtacttacactgttcttgctaagattaccaatgccatcttacttcctaaatcctacagatgcttttcagcatacctctatgcatttaacagtactgatcacctctatccttctaaaactctactacaccagtttctgtgtatttctaccacttccgacttccttcttgggctcattttaagtgctggtactctctagagttcactcctgagcccttttctcttgtcacctctttaggtaatctcaccccctctcattcaaagtatctcctggccaggtatggtggctcagacctgtaattcca

SEQ ID NO: 177838 - DNA, 315 bp, Homo sapiens
gtgagagcacgagtgtctgagtgtgagcacatgggtgagtgagcatgagtgtccgtgtgtgagcacgtgagagtgagcacgagggtccgtgtgtgagcacatgggcaagaatgagcacgagtgtccgtgtgtgagcacatgggcgagagtgagcatgagtgtccgtgtgtgagcacatgggcgagagtacgtgtgtgagcacatgggtgagagtgagcacgagtgtccgtgtgtgagcacatgggtgagagtgagcatgagtgtccatgtgagtgtgagcacatgggcgagtgagcacgtgagtgtggcacatgg

SEQ ID NO: 177839 - DNA, 124 bp, Homo sapiens
gggggtgggggcagttttgtgtttctaggagtataaggtggacaccagcccttgtagaacctcttgactgacttctctgccaaatgtgggactgagaacatccccgctgcctgcgaatgtcaca

SEQ ID NO: 177840 - DNA, 335 bp, Homo sapiens
gcgccaatccacaagcctaacatgttgtagaggcaaggcaacaaagtactatgcaaaagtctcttaccggccaaagcaaaaacttgggtaccaccaagagacaacccaagaatgcttgcaagtgtttacaaatgagagcttttgttttttcttgaaggttaagggaaccaccatttctgaaatatcagcatatatagtagattttagttatccactgaatgtaaagaaagatgaacttacaaacagtatgacaataacagcctcttctttcttctattcccaaaacctccacagcagagcatcacattaaggaaagcatttgttacctgaattat

SEQ ID NO: 177841 - DNA, 184 bp, Homo sapiens
ccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaa

SEQ ID NO: 177842 - DNA, 249 bp, Homo sapiens
tcctcactccctacctccttctctaataaccacatggagccacactggtctttctgaccccacaccacactcggcttattccttactctgaggcttagccctcttcattctctgcaggaaaggttcttcccctggctctttgtacatgaggatcattctttcgtcttttctttctttctttttttttttttgagatggagtcttgctctgtcacccaggctggagtgcagtggcacgatctcagctcac

SEQ ID NO: 177843 - DNA, 289 bp, Homo sapiens
aaacgctctcacaaagaaatagaaaaaaatagtcctttacctattaagaaactaaatccaggttaagaaaaaaaaataattatcatacaatttttatagaaaagtccagcaagcaggctgggcatggtggcttatgtctgtaataccagcacttggggaagccaaggtgggaggataatttgaggccaggggttcgagaccagccagagcaacatagcaagacctcatctctaccaataatttaaaaaattagccaggtgtagtggcacatgtctgtgagcagcgttgg

SEQ ID NO: 177844 - DNA, 616 bp, Homo sapiens
gggcacgcgggggctcttctgcgtccccagccctgggccgctgggcctggcctcgccgcggggtggaggaggcccaactacaatgatggagagaaaactgtatagctggaagaagaaaaaccctcctagttgaagaggggggtgaggaaaaaaacctggaccgtggtccacatgcttgactgaatgatgggctcctttcaaccagagtgtgtctcttgcttgttggaccttactgaggccgttggaaagacactcccaacatcctgacatttttctacaaatcccctaatgttccagccatggtgtctcctcccaaaaggagaaaggatggcaccagcagctctggccttctccatcagcttagaaacctgatcccaaagacaatgctttccctcagtcattccagaacagtcctggggctcactggctcaactttggtgctctatgtttaccccacgactgatttgccaggtctatgtcatatccccaagaccatgtggactgagaaagtggggaaggatggttccctatggtcaaagcagggtgctgttaccaggaggaggactggatgctgggctggcaaaaggaacagacatccacccatacatcctgtgga

SEQ ID NO: 177845 - DNA, 183 bp, Homo sapiens
tgtgcgcagaactcagaatccagcaaccatgaattgcagtcacttttgatgcctgcagtgcttcactaattattgaatttgtagcctgttcattggaattatagtctgatagaattttggagctagaaaagtcttttcatttgagataatttcacccatttccctaattgtgtaggtgaggaa

SEQ ID NO: 177846 - DNA, 485 bp, Homo sapiens
tggtgtttctcacatgcttctccttgcacacttgtccagcttcccacaagggacacctacatgacttccagcctggcacctctggacagaattggaaccacctccatgttgcctgctcctctctgctctaatattcccacatacagcttcttacccttagctgatcacaggaattaaggggaaccaagtttgggtggaaatcccagttacttacttcctgctgtggttgtatgtgagaggagatcagtgtggcctcttctgcttacatccactgatgtttttacacttaagccataagcacaggactggtgaagctccctccatccattggtccatctatctgtctatccatccatctatccatccatccctctatcattcatccatccatctatccattcattcaactatctatccatctacctgcctatccatccattcatttccattcatccttctatctatccatcaatttgtccatctgt

SEQ ID NO: 177847 - DNA, 334 bp, Homo sapiens
gcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacaca

SEQ ID NO: 177848 - DNA, 326 bp, Homo sapiens
tctcaaactagatcatcctaatcttacatgaattcttacagagaattttttttaaaaaggaaatgtcccctactcattttataaaattagtataaccttgataccttgatatcaaagtcagacaaagaaagtgcaagaaaggaaattcagtgatctgtaagcccacggaaaagacaccatgagcaaagctcaccctctggatttaaaaaaatttatggacaagaagttataactgaaattaaatggtggcagacatgtccaaggaatattgtggggatttgatccctttatgaatcttgtgatagataaatgtgtggagatggcaa

SEQ ID NO: 177849 - DNA, 388 bp, Homo sapiens
aattgcttgaacctgggaggcggagattgcggttagcggagatggcgccactgcattccagcatagacaatgaagcaagaaaaaaaagaaaagaccttgtctctaaaaagagagagagagaaaccctgcatggacctccattcatatggccgttctgttactagaagggtccagaccaacacaagagcactaggagccaaagatgaaattcacaaaagagcaattatgagaaatgggagaaagatggagggactgcaacatagggctaatggaagttttagaaaaacagcagaaaatcacagagaagcaatatatgatggacaatcaatgagaattttcaaaaactaggctgggcgttttggctcatgcctataaacccagcactttg

SEQ ID NO: 177850 - DNA, 367 bp, Homo sapiens
tagcttagggactttgaatagtcgttagtgtaatcttcggagatttctgttttggaaaatgtataggattttagagttgatttacagtaggatctaatttttgaagcaatgattgcctaagaaatgattatccccagctacagttttataaccagataaattaaaccacaaatatatagaaaatgtagtctgtgtccattttctgcttagtttggttactaagcaacttgtcttttgtgcacctgtttgattaaagtttctatacttagtaattttgtagctcctgaatctaatttgccaacttttaggttccttaaccgaataggcttgaaacaacatattatttttaaataaaagtgttccctga

SEQ ID NO: 177851 - DNA, 986 bp, Homo sapiens
atagccaaggcagtctttacaaaggacgttagatgacttacatcaccagagatcaagacttttaaagctacattagtgaagacatatgtaggataaacaaagggaccaggggaatatagaaagatccaaacagaccccaaataaagtcacaccagaactgacttttgttgtcaaaggtaacattgcaatacagggagcagggagggacaagattatttattttaattgtgctatttaattagatatctcttagaataatacaggtttttttttaactccaatgcattatagacataagattattaacactttaaggaaaacataggagaatattcttccaaacttaggataaatgctaaaaacattgaccatacaagcaaagattaaattagcctatattaatcataataactgtttatcgcacatgtaccccttaacctaaaagatgaagaagaaaataaaaaataaaataaaatttgaagaaaatgttaaacaaaaatgaaaccataccagtactagaagaaaaatgggtgaattcctctttaacctaggcaaaggaaaggcttctctggctcccaatctggatttaattaatcctaaagttgtatagaatcacaaaatacctcaaatagccaaaacaatcctgagcaaagagaacaaagctggaggtatcacactaccagatgccaaaatatcctgcaaagctgtagtaaccaaaacagcattatactggcatacaaatagacatatagagcaatggaacagaatagcgaacacagaaattaatccaaatatctgtaaccaactgatttttgacaaatgtgccaacaacactctttaggaaaaggatagtctctttaaaaaatggtgctgtgtaaactagatatccgtatgcaaaaggctgaaactagacccgcacctctcaccctacgtaaaaatcaactcaaaatggattaagaacctaaatgtaagacccaaaatgacaa

SEQ ID NO: 177852 - DNA, 532 bp, Homo sapiens
gaactgaaaatgatgatggtatcatttccacttctaaatttgcagcttccttctttcttatcactaagcctttataccaatcagattttaactcgcaaagaaagagggaaatatctccctgtagtaactgggtacgagtgagaaagagacgcaagaataccagaagccatgcaagcgcagaggaggaaccagagggcagagggagtgaagagatgtcacagagggcagaaacctccatgggagggcacaacagcatggatggagcattcaggaaaaaaggaatgccatctggtgatggaaaaacagaaccacctctggtagaattaacatggcggtttgttttttcacctaaaggtaaaaaaagattgaaacagaagaaacattggcgaggcagttccctgtgatggccatcagagggtactgtgagtccggcatggtctagctgctgtcaaacttcagaagatggataaatgggtggtgaaataatttgaaaacagtccttgtaactgcatgtgcaacatttaaaaacttt

SEQ ID NO: 177853 - DNA, 648 bp, Homo sapiens
taatttgactgtttttggttttggtctccaacagaaacattggctgaacccacccatgagtaataaggtagaacagtcaatgccattgttagaatcatttttaaactagttctttattcgagattaagtgctcagcatttactaataatattggcaatctgtagtcaatataaacaaatttccattttcaaaggaatattggttggagttacacaatcaggcatggattgacatcacagggttaacaaaacacacatgattcaaattctacatcaagtttaaagcttggattatccagatattttgctcatgacttaattttacttttctgtgcatccaaaacataccataacctgaaaaaataagccaaagactagaagcatggatttttaaaagtttagtataaaaatagaatactatggcaaaaattaaccagattccacatgtatcaacattgataaatctcaagaacataattccaaatgaagtggcaggccaatatgcacacttatacaatgtgaacacatttaggccagtaccaaatattgttatacatagaatgtaagtatacatgatatagaggattaaaacatccaactgcaagacaagagttatctctgaagaatgagctagggaaacagaggtggc

SEQ ID NO: 177854 - DNA, 493 bp, Homo sapiens
atagagctggtgtggttagagatgataatcaacctaatagtttacattacatcatacttacatttacaaaatagttacattttacaaacacaagaagaacattttaagacagaaatactggttaggttgtcaaaggtaaaaaagcaatgaaaaagaataacagaaaagaatttggcagttaagtcgttatctttgggcccatgatttagaaagaaaaaggctgagaggctaaagaattaataattaagtactaagggattactaattcatccattcaaacctctgagcatctactatgtgccaggtactatatgacttgcttagctatgaactactgtctcgtgatgttgagctgtgaaaggacagaaacataacagtagtggctgggcacttcagagttgagtgggagtttcttaaggatatgggagacctcaacattgttagcagggggagaagaaggagcctgaggaaatggaaggaaagaaaggtgaca

SEQ ID NO: 177855 - DNA, 623 bp, Homo sapiens
ttaatgaacttgaacttttattattagtggcaaagaagtggtcccttagattcagagtaagttggaagaagacgttagtcttcttaaaaccattataattagaatatgacatgatagatttttctaatgcaaatattatgtgaaattttgaataattaggagaaaagatctctcacacacacacttcttaactgtgtaatgttttaataaaattttattgttaaaattatttcacttctcaacttcaatatactgtggagaatattggcagtatgttatgttctaaaacatatctaaagaattgaagttcactaaatagggctaaaaattgtgtttaaaatgttatttggaaaagaaaggaatctctgtgacttagctttttttttaagcttaggttttgatcaagttaataagatttgcatgtaggtttttctatgaccaatgacttattttctctatgacactagagtgtagagtacatcaagatatgaatcagacatttatgcaaggctaggaaaagccatatttaagccacatatgtgttttggatgtgtttgagtaaatgtttgaacttcaacctccaacccacaaataatgaatagaaggctaggtagtcttctact

SEQ ID NO: 177856 - DNA, 431 bp, Homo sapiens
aatgcacttctctcgtttcattcattcatgtatttttgtgaatgtgtttattcggtatgtgtttcttttgcaccttctatatgccttgcactctggtcaggctgtggctgctgttgtgaacaagcagacagggactctgccctagtggatcttcaagtctgtccggaaagacattgatcagtaatgtgactgtgatgagctcagaggaaaagtatggggcctaggagtgcaccaacaaggggtgctaacctaattggggtaggagtcagggaaggtttatattaagtacatgacagcgacatctaagctgagacctcaaaaaattggatagagagagctaggtgagaaggggggatcggtttaaaacagaggcctgaagatcaccaacaattaataattagaggaagagccagaaaaggaggatgaggact

SEQ ID NO: 177857 - DNA, 154 bp, Homo sapiens
caaccagcatcaccttgccagtcatgtgaacaagccaccctggaaagattctctagccccagtcaaaccttcagttgagtgtagccccagccaacatctgacttcaccttatgagagatcttcagcccaaactgctcagatgggcaactcctga

SEQ ID NO: 177858 - DNA, 4392 bp, Homo sapiens
  misc_feature (1)..(2): n is a, c, g, or t
  misc_feature (5)..(5): n is a, c, g, or t
  misc_feature (8)..(9): n is a, c, g, or t
  misc_feature (11)..(13): n is a, c, g, or t
  misc_feature (16)..(16): n is a, c, g, or t
nnctntcnngnnnccnaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggtcattgccctcagaaaagcgggacacggagaccccgcccacaggcctggcccgccccttccactctacccaaagccagctcgctccataacccgcgcccccaacacacctgccccgcctgcatcgttgcaacggctccaagactccccttccatctattaccagccccgggaatatcagacccgccccttctgtccactcccggccccatatgcacccaaagccctgcctgccaggcaatcgcgaagtctttactccagtactactcttgtatgccctggagcccccaactctcccggagagcccagaaaagctagaagacttccgcgtaaccgcctccggactcccgtggctccacttctttccccaaaggcccagcaatctccctagggacccgacgcaacaggtttgaggctccacgcttcacttgcggtgccttctttggggtgccaacaaaccaaaacgcttccccccatcccactcccatctgcaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggtgagcccagccctctccattagctccgcccccaggtgggcccgatccaattagatctgaccaggccctcccccccccccccaaaccacgcctagcacggccaagccccaccctggccccgccccaataagtctgtccaggccctgcctcttggcaagccccgcccccaggtggacccacccaacgaaggtcggcctaggaccctggcagattctctcatccaggccccacccctccatcagcccctcccaacctggctgggccgggcactgagatatctcagcctgggcactccctccagctcagtcacgaccccacccaggactggccaaaccccacctccaagggatgattgataggtcctgtcattccaaccattcccgtctctggtccgacccttcttcaagcatatttaggccccgcccctcagtctggacaagctccgcctccactccaagctccgcccccggagtccctggcactcccaccaggagctggaagggacttccttagcctctgcccttcgccccaatcccccgacccccacaggagctcagagtttgattcagagcacaacctaacaagcaatgaagggcacagtctgaaaaacctggtgagattgccatctgagccctggggcaggtctgggcggtggaggagcaagggttgcggtgcagccctctcctggtttctgaaccccatcaccactgcctccccaggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaa

SEQ ID NO: 177859 - DNA, 710 bp, Homo sapiens
cagacggctgctgattctggggctggtcaggaaaccaagcagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaa

SEQ ID NO: 177860 - DNA, 3543 bp, Homo sapiens
  misc_feature (1)..(2): n is a, c, g, or t
  misc_feature (5)..(5): n is a, c, g, or t
  misc_feature (8)..(9): n is a, c, g, or t
  misc_feature (11)..(13): n is a, c, g, or t
  misc_feature (16)..(16): n is a, c, g, or t
  misc_feature (3459)..(3459): n is a, c, g, or t
nnctntcnngnnnccnaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggtcattgccctcagaaaagcgggacacggagaccccgcccacaggcctggcccgccccttccactctacccaaagccagctcgctccataacccgcgcccccaacacacctgccccgcctgcatcgttgcaacggctccaagactccccttccatctattaccagccccgggaatatcagacccgccccttctgtccactcccggccccatatgcacccaaagccctgcctgccaggcaatcgcgaagtctttactccagtactactcttgtatgccctggagcccccaactctcccggagagcccagaaaagctagaagacttccgcgtaaccgcctccggactcccgtggctccacttctttccccaaaggcccagcaatctccctagggacccgacgcaacaggtttgaggctccacgcttcacttgcggtgccttctttggggtgccaacaaaccaaaacgcttccccccatcccactcccatctgcaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggagctcagagtttgattcagagctacaacccaacacgcaattactgggcacattgatcgctacacccaggaccaccgcctcaaatgaccattgtgtgtcancacgtgcactgacgcttgatgagagacgacggccgatcccacgacctgtatccgcagctcgactttagagatcccgtaccggct

SEQ ID NO: 177861 - DNA, 298 bp, Homo sapiens
gtgcggcgtctctgtgcttctactgaggactgtgaagtggaccccagcaaatgtccagcctcggagctgccagagcaccaggccagacttcggaacagctgcgaggaggtcttcgaaaccattatccattcctacgagtgagaatcagggccccagcagcttagcccacccctgcttaccatgctagccccgacctccagtttagggtggccagataaaatacaggagacactcagttaaatttgatgcaataattgggaccatgcttatactaaaaaattactcatttgaaccaggc

SEQ ID NO: 177862 - DNA, 4286 bp, Homo sapiens
  misc_feature (1)..(2): n is a, c, g, or t
  misc_feature (5)..(5): n is a, c, g, or t
  misc_feature (8)..(9): n is a, c, g, or t
  misc_feature (11)..(13): n is a, c, g, or t
  misc_feature (16)..(16): n is a, c, g, or t
nnctntcnngnnnccnaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggtcattgccctcagaaaagcgggacacggagaccccgcccacaggcctggcccgccccttccactctacccaaagccagctcgctccataacccgcgcccccaacacacctgccccgcctgcatcgttgcaacggctccaagactccccttccatctattaccagccccgggaatatcagacccgccccttctgtccactcccggccccatatgcacccaaagccctgcctgccaggcaatcgcgaagtctttactccagtactactcttgtatgccctggagcccccaactctcccggagagcccagaaaagctagaagacttccgcgtaaccgcctccggactcccgtggctccacttctttccccaaaggcccagcaatctccctagggacccgacgcaacaggtttgaggctccacgcttcacttgcggtgccttctttggggtgccaacaaaccaaaacgcttccccccatcccactcccatctgcaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggtgagcccagccctctccattagctccgcccccaggtgggcccgatccaattagatctgaccaggccctcccccccccccccaaaccacgcctagcacggccaagccccaccctggccccgccccaataagtctgtccaggccctgcctcttggcaagccccgcccccaggtggacccacccaacgaaggtcggcctaggaccctggcagattctctcatccaggccccacccctccatcagcccctcccaacctggctgggccgggcactgagatatctcagcctgggcactccctccagctcagtcacgaccccacccaggactggccaaaccccacctccaagggatgattgataggtcctgtcattccaaccattcccgtctctggtccgacccttcttcaagcatatttaggccccgcccctcagtctggacaagctccgcctccactccaagctccgcccccggagtccctggcactcccaccaggagctggaagggacttccttagcctctgcccttcgccccaatcccccgacccccacaggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaa

SEQ ID NO: 177863 - DNA, 3737 bp, Homo sapiens
  misc_feature (1)..(2): n is a, c, g, or t
  misc_feature (5)..(5): n is a, c, g, or t
  misc_feature (8)..(9): n is a, c, g, or t
  misc_feature (11)..(13): n is a, c, g, or t
  misc_feature (16)..(16): n is a, c, g, or t
nnctntcnngnnnccnaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggtcattgccctcagaaaagcgggacacggagaccccgcccacaggcctggcccgccccttccactctacccaaagccagctcgctccataacccgcgcccccaacacacctgccccgcctgcatcgttgcaacggctccaagactccccttccatctattaccagccccgggaatatcagacccgccccttctgtccactcccggccccatatgcacccaaagccctgcctgccaggcaatcgcgaagtctttactccagtactactcttgtatgccctggagcccccaactctcccggagagcccagaaaagctagaagacttccgcgtaaccgcctccggactcccgtggctccacttctttccccaaaggcccagcaatctccctagggacccgacgcaacaggtttgaggctccacgcttcacttgcggtgccttctttggggtgccaacaaaccaaaacgcttccccccatcccactcccatctgcaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaa

SEQ ID NO: 177864 - DNA, 3881 bp, Homo sapiens
  misc_feature (1)..(2): n is a, c, g, or t
  misc_feature (5)..(5): n is a, c, g, or t
  misc_feature (8)..(9): n is a, c, g, or t
  misc_feature (11)..(13): n is a, c, g, or t
  misc_feature (16)..(16): n is a, c, g, or t
  misc_feature (3881)..(3881): n is a, c, g, or t
nnctntcnngnnnccnaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggtcattgccctcagaaaagcgggacacggagaccccgcccacaggcctggcccgccccttccactctacccaaagccagctcgctccataacccgcgcccccaacacacctgccccgcctgcatcgttgcaacggctccaagactccccttccatctattaccagccccgggaatatcagacccgccccttctgtccactcccggccccatatgcacccaaagccctgcctgccaggcaatcgcgaagtctttactccagtactactcttgtatgccctggagcccccaactctcccggagagcccagaaaagctagaagacttccgcgtaaccgcctccggactcccgtggctccacttctttccccaaaggcccagcaatctccctagggacccgacgcaacaggtttgaggctccacgcttcacttgcggtgccttctttggggtgccaacaaaccaaaacgcttccccccatcccactcccatctgcaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaaaaaaaacaacactaaaaatactaccaacccatccacaaaacaaccctcccgggggtctttttggggggcggccacaaagcgggtctttaacgcgccctgggcctgtttccccacccccttttttttgacggggggaaacccggn

SEQ ID NO: 177865 - DNA, 198 bp, Homo sapiens
ttagctgtctataattataactgagtaatttttcaaatgctattcatagcctaaacacagcaagacattcttccaatcatgtgataaaaactgagccttgcaaaatagtggtagagtgatatgttcaatggtaccgaaggacatatttaagagaagcctttcaaaagtaaaaagtaatttaaatgttagggagacagg

SEQ ID NO: 177866 - DNA, 440 bp, Homo sapiens
atagcgacctctcatctctgaatcctaaggaacttctgaagaacttcattacaatacagtaccatgacaaaaatcttaaacatagaagcgagtcaagatgtatgcacttatatgtccttaagactaagctgttttatagactgagattggttctgtattgtgaaacaacaacaacaacaacaacaaaacaaaaaaaaccccacttgaattacattctttgtaggaaaaactggcacagggatgaaattacagtgtttattattgttctgcttcttttatctattttaatccagtgtgtcatttaataatgattggagctaggtatgcagaaggttacacaaaagaatttaatagctgctagtagttcactggaggaaacaaatggatgtgaacatatgttgaagcaaatagaaaatttaattacatacttaataagctac

SEQ ID NO: 177867 - DNA, 678 bp, Homo sapiens
aggagaactgcttgaacctgagaggcggaggttgcagtgagccaacaccacaccattgcactccagcctgggtgacagagcgagattctgtctcaaaaaaaaagacacctgcaatcagatgtttattgcatcactattcacaatagcaaagacaccgaagtaaaccaggtactcatgaaacttagattgaataaagaaaatgaggtccttatacaccttgcaatactatgcagccacattaaaaaaatgaagtaatgtcctctgcagcagcatgaatgcaacaaatggccattattataagcaaattaacacagatcaggaaaacaaatactacatgttctcacttacatgtgagaggtaaacattggatgcacatggaaacaaagataggaacaataaacactgggaattccaaaaagaagaaagaaggaagggaaaacaagccctgaaaaactacgtatctacaaaattagccgggcgtggtggcacatgcctgtaatcccagctattcaagaagctgaggcaggagaatcgcttgaacccgggaggtggaggttgcggtgagccgagatcgtgccattgcactccagcctgggcaacaagagcaaaactccatctcaataaaaaaaaaaaaagaaagaaaaactacgtatcaggtataatgtacatatgtacata

SEQ ID NO: 177868 - DNA, 198 bp, Homo sapiens
ttcattccactgcttactacccttctttgcattccgtttactttcagaataaaatccaaacacttaagcacggtccacaggcttccatgatctatccggctgtgcatctcaagccactgtgtcactccttttcctctagtcttaatgaactccttccagtttccacacctcaggctctttcttcccttagagaattca

SEQ ID NO: 177869 - DNA, 172 bp, Homo sapiens
agggggattaaataaattcacattgtcgtgcagccatcaccctgatccttctctagaactttcttattccaaatggaaattccatactcctcaaacagtaactcccgttcttccttcatgttacctttttttttttttttgagatggagtctctctctgtcacccaggctgg

SEQ ID NO: 177870 - DNA, 335 bp, Homo sapiens
aatcccttcagcctcattctgcagattccttcctcctttctcttgtcttttggatctcttggatcccttcctttctgtacccctacttttccatctttcttgatttattccttattttagtgcagccatctgtcagctttctggaggtgtacgggaagtaaattactttaagaatattccatgtcttaaaaaatctaactttgccctgtaatttggataatagtttggctgggtatagaattgtaggttaaaaattattttcctgccaaattttaaatgtattgttccattgccttctagatttctgtatttgttgttgaaatgtttgagaccat

SEQ ID NO: 177871 - DNA, 319 bp, Homo sapiens
tcagtgatttatggtgctgctctgctgggtgtcccaggtgtgggcgagggcagtaaataaagcagatgaggcctgggtcccccacagggagagacagcatcagctggaggatcaggaggaggctggagcctgggactgcctcacaggtggtctcttgcctgtgtccagcttctggacctgggcctggttggggaaagtcacagaaggaacaggacacagggcaaagggtctttgactgacactggaatcctggccagctgaggcaatctgcagctgtcaggcctgtggctttctcggggccctgagttggatgacacgt

SEQ ID NO: 177872 - DNA, 158 bp, Homo sapiens
ggagcagaagagaaaaaaggtaaaaagctcattgaatataatatcaatggtaattaaaaagccaccatttccccccgcagacaagctaactttgagaacctgccagagctttcactaacagcaactgactcattttctcctgtgttggtctcagctta

SEQ ID NO: 177873 - DNA, 710 bp, Homo sapiens
ttagcacttcttgagaatgtttctagaaagatgttatgagaaacaacttatgacagcaacatgagggagggagaatataggtatgttctcgtactttcttaaccacacacctggctatagtagaaattttttgccttgcacacggcagggatctgtggctgtatagacctgccctgtgatgtatcagttgacttacccataggaaaatgaggtctaacccttgttatgaatctatattaggtagtatgttgtagtggcaatagccctacataatacttggtttctaaatgttttgtttcaaatcagagatccttagttactaggagaagatatgtatcgtgtcaagtgtctactctggagccagattgcctgattcaaatcccagttcgtcactgtgcgattggactaattaattaacccctctttccttggttttcttatgtgtaaaatgggagtaatggaacctacctatttatcacatgattgtgaagactttaaaaattgatacatgtaaagtacctagaacaggtcctgatccctagtaagtgccaagtaaatgttaacttattttcatctaaatgttacctaacagtattataagttggtgcaaaagtaattgcggcttttggctttcagtggcaaaaaccacaattgcttttgcaccaaatctataatatgctctatgcttttatcataacactataataaac

SEQ ID NO: 177874 - DNA, 641 bp, Homo sapiens
tcatgttagaaattgatttgaaaatagacttgtgtttatttagagccctggcctcataatggtttgactgaacattatgattatccatgttatcaaagaaacaagaaaaggtatcttctgctatattagagcggtgatttcagagtacagtttcacatgcaggcagcaggtcttctggagatgtaattttatgtcatagactggcagggcatattatagttgtctagctcaggtaatggtaattacaggtaagttcacagtgcgacaaaatatgagtaccactaaattaaagtgagcgtaatctgagtatttctggtttcaattactttttttttgttattttatttttatttttaagtgatgaaatgttcctatgtgaactggaaaaatacaattcatgttttgattttcatttaattagtatgtttcttcagggcttttttcagagtttatttaaatagtgggtagaagaagttaaaggtgtgatcacagttggttcaggaatggcatatctagggggcagttggtagggaatttttttttgtggttgaaagtgaaatagtatttcattactgggattagaagtaatcataatgggcagagagaactgaaaatgactaatatccttcactcagtcttct

SEQ ID NO: 177875 - DNA, 302 bp, Homo sapiens
gcaaagtgctgggattacagatgtgagccaccgcgcccggcccaagatgttcatcttttgtttttattttcctacttgccagagtccagtgccagagatattcatctttgcatgtcctgcctgtatccactttgaagggaaattgtccacctggcctgcctgccctcctggccgcagccagttgaacttgagaggaacacccagctccaccgtggacttcccattcatcggccatggcctatgacaagtgtaggctggctctaaaagatgagttgtggccgggcgcggtggctcacgcctgt

SEQ ID NO: 177876 - DNA, 165 bp, Homo sapiens
agcactttcttccccctgccctcccaaaaaaaaacatagagggaaagataattcattttgcttctagtttgtggctgttaatatggtcatacatctacagtcagcttcaaaatccctcttttattggaaacatggtttaaaaatggatgcaggaatatgaggagg

SEQ ID NO: 177877 - DNA, 345 bp, Homo sapiens
cgactgaggatcacactgctttgaagtgttcctgccaactccctgattcctctggaaaagactctatcacagagagaaagtcagcaatgcattatttgtcacatggcactaacaggaaaatgtaacatcaaacagttttctttttccactcacaggaagtttgtagtagaacccaccaaactctgtccttgtctctggggcatgagttagttattaactactgctaagggtcagtcctcaggctgagcaagtccatattccccagaccagaaaatacagcaaaagggatccacgcttcagtggctcagagcacctataaattcctcctcaccatgagagaaggta

SEQ ID NO: 177878 - DNA, 397 bp, Homo sapiens
aggagaatgggaagtgtgtttaatggggacagtttcagtttggaaagatgagaaagttctaaagatggatgatggtgacagttgcgcaacagtgtgaatgggctggacatagtggctcacacctataatcccaggactttgggaggctgaagggggaggatcacttgagcccaggagtgtgagaccagcttgggcaacatagggagatcctatccccaacaaatacaagaaaaaacaaacaaacaaaaaaatgatgcaaatgtacttaatgccactgaattacatactcaaacatggataagatggttaatttttttttttttttttttgagacggagtcttgctttgtcatccaggttggagtgcagtgatgcgatcttggctcactgcaacctct

SEQ ID NO: 177879 - DNA, 392 bp, Homo sapiens
tcgtggcagctaatactcaagggtgcttattagtgaaagcactgttcttagtgcttttatctatttaaatctcacaaccactccacaaagtatgtgatattatgattcccatttttcagaagacaacacttaaaaataagttagaaaacctgtccaaaagcatgcaattaataaaaagaagtggaagtagaatgtgaacttagtttccctctagggtcatactcttaacaactgttctatgttcttatcataaaaacatttaaaaatacataaaaatccctctattgctacctcacagagagccactgttaacattttggtatagtttctcctagtctttttttgtttgtgtaatatacatgtgcacatataaatattttaagaattggggc

SEQ ID NO: 177880 - DNA, 602 bp, Homo sapiens
gccaacatggtgaaatacatctctactaaaaatacaaaaattggctggtgcgcgcctgtagtcccagctacttggtagactgaggcaggagaatcgcctaaacccaggaggcggaggttgcagtgagctgagatcgcgccactgcactccagcctggcagcagagcgagactctgtctcagcaaccaaaaaaccacattttacgtattatctggacatagtttaaaaatgaaaacctcagcttgtggagaataaaatgaggtaatgttagaagtcattttgtaaactattgtgtgatccaaatataaaattcttaattttctgctttccccagcttatatccatcttctgcaaaacaaaaaaggatcttgtcttattttttagtaacaagttgcttatatagagtgttgatttctaagtgttttcacatttatttaaaatgaataaaatttagtgagagtttgctcttcctgggccctttgcatttaactgtttttccttaattgtggaataagaaacttcatttttgttaaaggtaattaaggcaagtagagaaagtctgggagtttaaaggagaattgaagattcttaactcatgctgtg

SEQ ID NO: 177881 - DNA, 211 bp, Homo sapiens
ctactccatcatgccacatcctacacatggacagcaagagtgaaagatcttagatgtcttccaggaacctcaaactcagcatgtccaaaggtcctcccttcggaaaacaaaaagacctggttcccattcagtgttctctttctctgaaaacgtcatccccagttgctcaagaaaaaaactcaagtcatttcatgactcccttttctcccta

SEQ ID NO: 177882 - DNA, 322 bp, Homo sapiens
gacttctccaagccctaaacatgagatcggaagggtgcttctttgtgggcagtgagaggaagtcctgcttcccaagtgagggagtgaacataaggagtgccctttggcaggcaatggtactggtaggagcgtcacataaccagtgtcagccatcacttccagagctcctgctcagttccaggtatcaggtgctgtagtgaacgaggtggacgagttccccatcctcttggcatttacaggcaagtgggagagacaggtattaaacaactcatgctaccagccaggagttagtgacccctgtggcagtggaaggacaggggct

SEQ ID NO: 177883 - DNA, 1632 bp, Homo sapiens
ttgtgagccctcgtgcctgcaagcagcccttttcccagagcgctctggtattgtcccaggaagcacctggacaatgggctctccctccactgaggcacctgtagagtactgaaatagtccacccagttggccatgaacctgagtgctgtacattggtccacccctagaatgaagcttgatgatatcaaatgtaaattatcaaggtaattttgtacctgttgaaatacagctttaagaaaaagaacaccttactagtaataatgataaacttggaacttcggctgtcaatttagtctagatttggttaaatttaggcatttggaaagtggattcctttatttctcatgatatctggttccagggtcatacctgttctggggagagttttcttacattattttgtttgtttgaccgacagctcacgtgcgtacgaagccatttcattcacaaaactaacttacaacagcccttgccaagctcttagcttgcagaatttacccacttcatatgaacttttcaaagtggaagaataattactcttttctgattgacaagcttccagtacatttttctttgcatgtttaaaccaatcatggatcattttgaaaataaatacactccaaagcacttcttaaaattttgagaatgcaaaaaaggtcttggttaatttattagagtttcatcatagcctccattaagatcagaatattagtttgtagacttgaacttcaagttctcattcacgtttgaggttgggcatcatgttgataaagtccccgaatgtagagagctcagggcagataatttaaccaggtaacccagccacgtcaccagtggggagtgcctccaggcgtttgtgccctgcccatttgcttctccctttagccttgtctggtctcctaaagtctggtgtttgactccccacctccctgattctgccttatagagtttggagggtgaggcccccatggaggtctggagaattcagactgactgccgcatatgggctctgaaacactgactcatcatttcccactacctcacatcacatacgggcttgctggtaggcaattaggccacatttagttgaccagtagtttctgttgcctgggtggcattactgttaagagatttgcttaaagtggttggctcacttctcagtgacttgaacagtttctgactttggccaggatgacagtactaggaaagtgtgctttttaaaaataattatacagctatattgtgctttccagatataggtttctcagagttcaaagcactttttatatacctttaaataggatacaataacagtcttcacttacatatatttgtaagttttggtagctttattagtaaaaatgagatttgaaatgtgaagttctttgctagaagctgtaattgacttagaactaatgaggattacatctgatcattttccttttttctgtgcattattgcatggaagttactagtgtctgtgtcagttgctatgtatctctccagatggatgaatagataaatatatatctgtatatgtattctgtatgtacatgtatgtatgtatacattcatatttagtatttgcattctatttttgaagcatttaaaatataacaacattttggggaa

SEQ ID NO: 177884 - DNA, 782 bp, Homo sapiens
gtaatatgaaacaatacaaatatgtgtaatttaaaagttattactcctcttcattgccatttcattgaagctacattataaatggtatatttttccttggtgttcctcgtgtatataccagcatatgcaaatgcatatatgcacacattgtttttgttttctacaaaagccatattgtacatattactccaacttgctttctttttctcaaagtcatgtttattaaggtctaatttacatcaaataaaatttacccttcataggtgtatagttgggtgaattttgacaaatatatatggtcataaaactgaccccacaatcaagatttccttcaccccaaaaggttctcttatcctcctttatagtcagttcattctcactccctgaaaactcttttctgatccaatagttttaccttttttagtaggtcacataaatggaatcaaaacagtatgtaaccttattcataaacacagtaaatataaatggattgaacactctgaataaatggcagagactagcagaatggatttttaaaataacatgatctaactatatgctgtctataagagatgcaatttatattcaaagccacaaataggtgaaagtaaaaggatggaacaagacatactatgcaaacagtaaccaaaagcaagctggagaaactatactactatcagacaaaatggattttaaggcaaaaattgttactagagacagagaacaacgaaaaaatgtcaatccatcagaaagatataacaattttaaacatagatgtacct

SEQ ID NO: 177885 - DNA, 340 bp, Homo sapiens
gcctctagatccaaacttctgactgaggatacaccccacaggtggcatgtgaacattactactgttctgttctgaatattgaattaggcacaggactcaaatgatcaactttctttttttttttttttgagatagagtctcgctctgtcaccccaggctgaagtacagtggcgcgatctcggctcactacaacctccgcctcctgggttcaggcgattctcatgcctcagcctcctgagtaggtggaattacagacgttcaccaccatgcaaggctaatttttgtatttgtggtagagacagggtttcaccatgttgggcaggctggtctggaactcctg

SEQ ID NO: 177886 - DNA, 510 bp, Homo sapiens
caagacatgggaaaatgcatttgtaaaaagtgagacactctgtgtatgttggataacactggctgctttggaatcaaaccccaaatgctcagtgggttaccatattagaagcgtgttttccttctgtatgatgctctgaggctctaggctgcaggtggccttcctccatacagtgagttaggaccagatgccatgcctgacacctccatctcctaaaaccgtgggatactctaatctcagctggcagatggggaaagaaaggatatgaagaaggaatactcgcttaaataccatcagccaaaagtgacctatatcacttttgttcatgttctagtgccaagaatgtcatacagcccacccaggtacatgggggctgggcagcccttctagagcacagaaggggagcataactttgctggggagttggctgaccctgccacacccggttgtttagaggcacccggttgtttagaccctgccacaccgtggaatttagagacaagggtaaga

SEQ ID NO: 177887 - DNA, 522 bp, Homo sapiens
attactttgtataagttttttggtaactgttcttaaattcaaattttaagatgaacaccattgtttaatcactgagtcagactttttttttgtactttgggaatttacaaatttactgtccattttaaacttgacctgtttatgtgtagcattataaatatatacagaaggacagtagatgcttaatttcagtgcatgttattgaaacacaaatacaaaataaaaacaaggaatatataccatttcatatccagattgacaaaaatgaaaaattctgacaatatcaaatattgggaacgacgtaggggaatgtgaacctttaactattacttgtgttagcaatgatgaaatgcaattaaaaccaaaatctgcttcccccagaaaacatctcttcaaaggtagaagaaaaaggaaacaatttcagtttttaataagtattaaaccagaatgacacgtgtatcacaagcaatctgctaaaagattgcaaagaccaaaagaatgctcacccttacatctagccaa

SEQ ID NO: 177888 - DNA, 343 bp, Homo sapiens
tctcttacagcatagaaagagagaactctccaacgctttttatgaggctagcacaaccttgataccaaaatctgattaggacagtgagagaaaggaaaattatagacctgtcttactacctaaaaaacaaattagcaaagtgaacccaccagtacacaagaaaggtaatatatcttggccaaatagggcttatctcaggaatgcagtgttagtttaggattagaaaattaatcaatgcaatttaccatattaactaagtaaaggagaaaaaaaatcacacaatcaagagttgcagaaaaatcatttaataaaattcaatgttcatttatggcaggcactctta

SEQ ID NO: 177889 - DNA, 375 bp, Homo sapiens
ccgccttgcatattaggacataatcaggaaaacactgaacaactcattactgatttagattattttctgcagtttccaatgcctgacacaggttttcctatgcattagcctctttctttctttccttttttgtttttgtttttttgagacagggtcgtgctctgtcgcccaggctggagtgcagtggtgcgatctcggcttactgcaagctctgcctcgcaggttcacgccgttctcctgcctcagcctccccagtagctgggattacaggcacgtgccaccacgcccagctgatttttttgtatttttagtagagacggggtttcacagtgttagccaggatgggctcgatctcctgacctcgtgatccacccg

SEQ ID NO: 177890 - DNA, 557 bp, Homo sapiens
agggtcttcatcctgtttatctctgcatcctccactggacccacatagttggttcagacttgcttaacacaaaccgatggatgaataagtgagtaaacacagtcggctcatggtcatgggtttctggcacctgtatcaagacagagatgacttgtaggagaagcccctctgaaaaatgcctttcttcaagaaaagctgcttcagaagctccattatgcttctgaaacagggatctccgaccccctggggccatgaactggcactggtccatggcctgttaggaaccaggctgcattgcaggaggtgagtggcaggcgggcaagcagtgaagcttcacctgaatttacagcaggtccctatcacttgcattaccgcctgagctctgcctcctatcagatcaacagggacattagattctcataggagctcaaacccaactgtgaaccatgcaagccagggatctaggttgcctgctccttataagaatctaatgtccagtgatctgtctttgtgtcccatcacccccagatgggaccatctagttgtaggaaaacaag

SEQ ID NO: 177891 - DNA, 481 bp, Homo sapiens
tgctgtgatcacgcaaaaaaaataactttttatgtttacaaatttatactgaaatacacaaagacaaagacaaggtctgactgagatttgctttaaaatactttaaaggggttaaaaaatgaagcaaatacggattctggataatatatgaatattttattctctcaatttgggtatgttacaaaattataatttttaacttgcatgatacaactaatcaaagcataagtgaggaactctagagcttctattagagaattacaaaacataaaagcatcaatgagaaatcctagagcctctattagagaattatataatataatatagcacaagtatgtaagattcacttgctagcagattccaaaacaaataaatgataaaacttaaagacaggccaagcgtgatggctcatgcctgtgatcccagcactttgggaggccgaagcaggtggatcacttgaggtcaggagttcgagaccagc

SEQ ID NO: 177892 - DNA, 273 bp, Homo sapiens
gctattgcagatgaaggcacagaaacagtttttgtggtctcttttctactactggactcaaggtgccccataactttggaaacaccaccatcgatgaggttttcacatttttttttatctatagtttttgaccctgaatacagaattggtcaaatggagtagtatctttatggccctaatacattgctttgtattacagtcatttgaatggaggtctgtattcttttcaacacttccacagaacctagtccagtgtctaacattcagtaggtg

SEQ ID NO: 177893 - DNA, 279 bp, Homo sapiens
cgaatcttggtttccatcatcatcctaagtgaagttttacaggattggattagagaggaattctaaagggctgtatgcccttgtgatggtgattagccgttagtaatgggaaattcctgggtggagatatttatttaacgtgcattcataagccggtgaacactgaactctatctctcccaagctttaacaatctttccttgacacatctacacctaaacatttgtagatttttaagaagaaagattggaaactagattgcttcacccataaaccctgt

SEQ ID NO: 177894 - DNA, 248 bp, Homo sapiens
aacccccatccatgaacccccaagattaggagtggggcagagaggagcaaaagcctgagagagagatcgggggagaacaagatagtggggaaatatatattgattaagaaattgaggctgggcatggtggctcacgcctgtaatcccagcactttgggaggccaaggtgggtggatcacctgaggtagggagttcaagaccagcctaaccagcatgaagaaaccccatctctactaaaaatacaaatt

SEQ ID NO: 177895 - DNA, 356 bp, Homo sapiens
acccagaaaaacatgggctcaaggcatagcactggcgtaaactagctgggtgacacagataaggcagccctaggggatgtcactagatgctgccaaggtccagtgctcacatcctgtgcctctctagagtctgctctgataagcaaactatttttcagtggacagagtacaagaaccaggaggaaactataacaagctgactttaatcaaagacaccatccaccagggattttaattttctgaaactgtaatatgcaagtttattatcccttcactgaacagcacatctgttcagaatatatctgatcaaagatatattcaagatcagggtattaactgtatcatgggccagcaat

SEQ ID NO: 177896 - DNA, 503 bp, Homo sapiens
tgtgccagagaagataattgccactcagtgatagagctcagaacggaattcacgttgtcagattcccaagcctgagtaccaaccaagatctggttggaaagagcaagtgctgtcgtctgagaacatccaccatattctgtactcttcagtagctgttctgtgttttgcttttttgatggtgcccctcctgagggggaggtggagagtatataattgggcatgttttttcattgtggttcctctagtccccaccagtcaactgtgactactatgaagtgcttttgagtacagggctgtaaatactaaaatctgttcctttgcaatttttggtatttgagcttttccagagaacaaatagaaggatttgatgagcttagaaatacatgtgtagaggaacagtgaaaaagacttcttcccaaatggctgctaagtaattatatatttttcatcataattaaatattctcaaaattgtatgtcagtgtgttgaaaatagtgttttca

SEQ ID NO: 177897 - DNA, 164 bp, Homo sapiens
tcagatcacaggaaggggcaagtgacaggtgcctcttcttccaaagtcacaggagggagggagtccccccgtctaagcctcttacctgaccacagtctagttcatggtgtctgaagctgacacgattgacattggaggctggataattctttgctgtaaggtct

SEQ ID NO: 177898 - DNA, 316 bp, Homo sapiens
tgtttccttccaaccatcaggaacagtaaggaattccgattcatcttggtctcttcagcttccgcttctggttatgaaattcactgtttccagccccctttctggccggttcagagaggaagacaccattttcaaattgcttctggtggagctggaaataaacttgaaagttctcttgtctttacctggctttggtttgagggtttgatgacggtcatcgaaaccctctaccggtaacagaaccgtttcatttcaaataaagaccaaggaaaggggcataattagcaatgttatctctggctgtagggtttgatga

SEQ ID NO: 177899 - DNA, 481 bp, Homo sapiens
  misc_feature (442)..(442): n is a, c, g, or t
gcttgatggcagggactgtgtctacctcattctttttatacctggaaccaagcacagtctagttcagaattggtactccaacaataactgctgaatgaattatcctttatttttctgagaaggaaaaaatttaaaaattacataactaccaagttatttctctatagataacttgtggtttttgaaggagaaccgcatttttttttttgagtcagtcttgctctgttgcccagagcaacagagcagtgcgcaatctgctggagtgcagtggcgcaatcttggctcacgtctataatcccagcactttgggaggccgaggcgggagggtcacctgaggtcaggagttcaagaccagcctgaccaatgtggcgaagccctgtctactaaaaatacaaaagttaatcatgtgtggatgtgggcacatgtaatgccaactacttgngaggctgaggcaagaaaatcgcttgaacccaagaggtgg

SEQ ID NO: 177900 - DNA, 292 bp, Homo sapiens
tctgctttgcttggggtatttcccatcctggaagttttaggtgtttcccagagttttctgagtctatgggacccaacctctcttactagagatttcttgcaactttttccctggagactctgtggggctcaacctctcctactagagatttcttgcaccattttccctggagcctcaacccccacgagtggaaatttcttgcactcccctactttcacttcacactcagttgtgtgtctcaatcacacacttttaacctccaggatgtctcaaccaccaaggaagtacttcc

SEQ ID NO: 177901 - DNA, 515 bp, Homo sapiens
agtcccagtcatcaagaaaatgaggatttctcatagtttatcaacttggccaaggtggtgtcttctattgctacccctctgttacttgggtattcactaaacacggtttgggaacagccttaagacccttcatcacctggaaagacccaagtgtgtaaggtctacctcgctatgttctagttttcttagctatttctcctttccctgcaccctatgaaggtcaaaatcatctagactcctttggctagggatgcctgggttcacacattgacaagctggaggcaaacaccatttcctcaagagctctgccacctgtccaaggagagagccatgttgggctggccacagctaaaaactgtcctggcccagtggcatcttcactgcttgggttgtgtgcagttgtatttagaggttcgactggcctcgctgctgctgcagcacctgcttcatacatggcagcattggtgggctccattcggtgtccttggagccaaggcattaaattgaagagtctc

SEQ ID NO: 177902 - DNA, 174 bp, Homo sapiens
attgggagtactgaggggaggtagagtaaagaacaaatagacaggtgctggtagtgactgctatttaccactggtatagaagagttcaatattttaacagtttaccccattggctatcagccttgctaccttattgactacccgtgccattgttactcgaactattcattcaag

SEQ ID NO: 177903 - DNA, 368 bp, Homo sapiens
agtgaaccaggagcaatgtatacacaacacaaagctcaaattcatggagcacaaagccagtttcttcttcgtcctctttttaaataaaagtaagtgcacaaaatcaccatgtataacaaccaagactttgtatatttaaaattcttccaagttatattgcatttacaatacaagcttttgttactgtgagctgttgtcatcctcagaaacagaaacgatttttaaaacacttccaactaaaaagaaaagtgactctttctgcagagaaaattcaattcgtttaaaatagagcatcacttccagggtaaatagtggattaatatattaatgctggctgggtacggtagctcatgcctgtaaccccagca

SEQ ID NO: 177904 - DNA, 265 bp, Homo sapiens
tataaacatttactgtgaacaattttgttggttcattttatgcagaagtattataagaaggttatgtggtgggagggacagaggggaaaagagctagaggatggttagccatggaagaaaggaaatgtagcaaacaagttgaagagtaaaaaacaaacaaagaaaatatcaacagcttcatggttttttcaacgggtcctgtctctctgttttgctcttacagagccttagaataagagttcagatcctattcgctatcctttcc

SEQ ID NO: 177905 - DNA, 245 bp, Homo sapiens
cattagttagtgagaggaactgaattctgtgtcttactgataatacagtagacttgtcatgtattaagaaacctttttaaatgttgaaatattgaaaccctgtcaacaaaagtgaaattgcaaatagcttaccatttatcaaagggttactgacttatttattttgttttgagaatactatttaatagtcttataaaacttgtatttgcactgatcaataatcttttggtcctgaaaagttagtg

SEQ ID NO: 177906 - DNA, 529 bp, Homo sapiens
ggtgcctgccactgtgcctggctgatttttgtatttttagtagagatggggtttcaccatcttggccaagctggtgttgaacgcctgacctcgtgatcaccctccttggcctcccaaagtgctgggattataggcataagccaccgcacccagccaccagcactattttttaaaagatctatttgactgcagtgtgtactcttggtttgttgcttctaattgctgcattgtactctgtagctggagttagggagttattgtaatagtcaattcctactggattggtctagaaaggttgtatggagaattggcattatggggtgagcctcgaaggatgaagaggactggggaaggaaatggagctgtccaagaggacgtatgaacatgccaagaacatttagggaaggacccgttgcctgctgaggccataggtcagggtgtggttgtgtgtggtcataggagaggctggagaggtctcagataacagcgttggacattccctaaagcaatggaagagagaggcagttag

SEQ ID NO: 177907 - DNA, 367 bp, Homo sapiens
tcaaaatctcaccaacttcaacatccaggtaagtatccaatttcttctaggaaagtctctaagattctacctaacccaaatcactatttctttcaatacacaagtttttcgtactcaacacagttatactgtcatttgttttatttctatttctttcttttttttttttttttttttgagatggagtctcgctctgtagcccaggctggagtgcagtggcacgatctcagctcactgcaacctctgcctccggggttcaagcaattctccgtgtctcagcctcccaagttagctgggactacaggcacccgccaccatgggccagctaattttggtatttttagtagagacagggtttcatcatatt

SEQ ID NO: 177908 - DNA, 524 bp, Homo sapiens
ctggaagattcacttttcttgtctcaggatgttttctgatgaagacgtctctgttctgtgaccccgaattatttctctcctctctgttggtgtccttttcttttgggtgaacagatcacccaggaaggagtacactgtgcctctcaatataacttggtttgatgatttggtgtttattttcctctcttcatacttctgataatcactgcaagggtagttgttcttcctttttctcctactcttcccttttccccttataggttctttgattcagacgtcagaaaataaagatggcatgactacatagtcttgtttttatccccatttcctgtgccattcctccatatggaaatgtaccctcaagtgctggctagaggtgactaaagtgaccaaaggtcacttttctacctcttcttcccaccccctcaaaactcccagattggtagctttcaacctaggaagactgctcccagtgctgtttctccctaagaaatgaaactctgaccgggactgttgcctgagga

SEQ ID NO: 177909 - DNA, 1037 bp, Homo sapiens
tgcccagctcccactgtgtctggtgcacacccaccctgacatccttttttatgcctcagctgtgatctagatagatgcttacagtaacttccctgtattagttattcacttgtactttctgttcacgtgtctgcctacaggctcccactttttgtcactttttctctttatacattatggaagctcagtaatgattaaatagatgaatgatgttttaaaaatatattttaaaacaacaccaacaaaacgcaactaaaaagaaaaaaaatttttgtgggggcgcgcgccctggcgccccaggaaaaggttttgaaaagcccattctgggtgggcggcggggggccccatgtggtagtttgagccttgggctcaaaccggctgggtgccaaagggaacccgttggccatgaaccagggtggtgggtttcctagccaagtaaaaaaaccggccgtcggggcaccgcgcgcttttttgagaccaaacccccagagtggggcttcgagggggcatgattcgggggtttcattacgaccggggtgtgccaaggggacgccaaatatcaaattagaccgcgcggcggtggggagacattaacaaaatagggtctatcagtaagggcataactgacgagactttgaaccacgaacaccagcggtttaatcggtcccaatgaatctacatttgaacgggcaaacactatgtctcagcagtttgacgtttaagtgactaaacagaggtagaaaagtagtcctgtatccactggagaatatcatcccagttataacactaccagcctgaggatctagacaagctggcacagagttcggaagtccaatcacagtgggcaacatttggccagtcacaccacaacgtgatagcccgggcccagaaacacgttgaacgaatgcattcccccccacgaacgctgcagctgccgggaacttgggcccgacagccagggcaagcaacagccgcaagcgggaagtcagaagccgaccaccaatcgcgaatagacccacgaaaaacgcaccataaca

SEQ ID NO: 177910 - DNA, 332 bp, Homo sapiens
ctctgtttgatgtaacgaagagcttgaataaaatggtgttggagtttctgccagcatacaatattctagtatataattccaagattattaaagaggctcatagtttctttctatctttctctagctcatcccactccagtagaaggtttgcatttccctaagacagctcccttcatcattatgctcctgcctatccttgctcctgcacaccaaattggctcttctaatttcttatatatacagattatatcataatctggtttatttctgagccaagaagcaagttgcaaaaacccctcatctccagttcagtcagacttgaggaattatga

SEQ ID NO: 177911 - DNA, 320 bp, Homo sapiens
aaatgactggctgtaacacatgagccctggaatttctgtggcttaacaattaaataattatttctcactcatccagttgtccagtgtaagacttagggacccctgagcaggcggccagctctcagcaaagacagcacagtaccagggaagggtcacaggaattttggcacatggccagctggttccactgcacctgcccagggacgctggtctccaggctcctggcttctcagcctcagcacagatgtctgcatccccagaattttaagggaggctgctggaagccggggcaggaggtgggatgagaatgaagcttttca

SEQ ID NO: 177912 - DNA, 379 bp, Homo sapiens
ccacctccccacagagtggttcttctttctcctgtgggctctgctccctgaggccttgctgtccatgtgtcactcatgccccaagctgtagagacagaaggtgttgctccacacttctctggctgtgtcccgtggtcttgctggtcagtttcccatgtgtctctcaagtttcccccatttcttcactgcctggatcctacatgcctcccggctgctatctctgcacccggcttcatcttccttggagcctcatgcagccggcacaaatgaggattgaaggagtttttgtccataacccggggtcctgatgacacccagccccgtgcttttccaatcacaatgctagcatcattgttatcatatttgcttgttggggctg

SEQ ID NO: 177913 - DNA, 150 bp, Homo sapiens
ccaatctcatttggtaaaagagaccaaaatgatgagttctcaactctgtacccaattcaggtgaccctctcaggcttggggacaaacctacttgccactcgccacttacccacaactgcccaccctatcattttcacttacatacacact

SEQ ID NO: 177914 - DNA, 159 bp, Homo sapiens
aaaaagctcctcccttataaatgcatgatactcaacaaaatgtttccagcacttataggacaaataataaactaagtttcaaaatacaagaatttagcttaataccttttataagaccaagaataagaataagcaaaaaatgcttttagctctataatt

SEQ ID NO: 177915 - DNA, 164 bp, Homo sapiens
cccattctatcagttctttgcagaagggaacctgactactgaagcctgcgatagaattctttatttgctttttaaattttactctaaatagaatttactgtttacaacaggcaattccctgacagctttcttctgggcagacatgaaaatacagtaagagctaa

SEQ ID NO: 177916 - DNA, 359 bp, Homo sapiens
cttcccccatccccccacctactgcaagggccacacctcagcacctgcctctaagcctggccctgctggtagcacccagcacaagcagggcactgggagagaactggggaggctggctctacctgccagatgaagacgccacacaaggccacggtcactcggctggtactcagttagcccttcctcagtgacaaatgcttgggcccaaggaggagaggttagaagggtaattggggccttgcagtgcagtgtctgccactgtgggagctttaggtactcagaggaggaaaacctcccaggagagccatggcagctataataggagccagcactcccacccactcctaggccatgctctg

SEQ ID NO: 177917 - DNA, 522 bp, Homo sapiens
gccaagagaaaaacactctgacattttgtgtatactcacagttttccttggtttgaacttcaaacactgatgtgaatcatttgcatatcatctgacaaggctacctacttgaaagagaataaacatgaatctttggtcactgttaagtgaaaacagaatgtttatgcactaacgtttgctatgagaaagagcttatgaataaaatttggtagaatgggtaagattaaagagagactcattacaccacaccatccaattcatacagcaggaatttcccttaaattctcaacaattgattacatctagtttctaatgtttcagggaatcacactgtttccatttgttatttttgtaaacagaacggtgtgcaacagtatgaactctttgtcaaagcagtgacttgaaaaatactaatgcgcatacatgtgtgcatatatctattcagaaatatagacaactgatagagaaagatggatattgatatagacatatatatgattcagctgaacaaaagtatttttg

SEQ ID NO: 177918 - DNA, 349 bp, Homo sapiens
agtgaaaaaagctggccataaaattatttggttctactctcatcttaaatagtttaaatacacagatatacaaatagcaaaaatttattatatacacacacataaatgcaaaaaggaaacaggaaaacacatgaaaacatcaacagttgtctctgagcagcaggatccgtaagttctacaaatactcgcaaagcacctactctgtgccaggtacttttctagggtctgggaatatgtcagtgaattaaacaaatgtcctgccctctagagagagaaataccacaaaaagagaagaaataaagatggaacataaactcagaaaatatcatgaaaaataaagtagggtaag

SEQ ID NO: 177919 - DNA, 409 bp, Homo sapiens
atcacaacgctaattacggtctcttatttactagcaatagaagtctaatgttgtggcgttctcaaggattcaggaatgttattcaaaagcattttgagctccatttgcctttgatgtttgcctccagtttctgaaatttgcccagatgggggaaggggatagagggggtggtcttactatttcctgaagcacaaatgccgcagcagagcccttttagggacatcttgattctattagaatttgcaggtcaaagggcaggttcaactggcctggtagtttaaagcaccagggatagagtgaatagactactgtaatgacttaaagttggatttctgctgctacctactcattatgctaataatgtgcatgttggtcatgtgggcggggggattactaatactttgaaagg

SEQ ID NO: 177920 - DNA, 634 bp, Homo sapiens
tcaggaggtgattgagtgagtggaaggaagtcaggtggtctggccaagcttccccagtggccaaagatgtaaagactaagacccattttgaggactattctgggcaaatttataaagtgtctatatgtgtatttggagcgagagagtgtgttggtattcttgtagagcagctctctccaggagaaacagaccaacattttctcatacgagaaagccacctctatgtaacttaagattttttaatagctacatgtaaaagtagaaacaggtaaaatcagctttaatctattttattaaccccaaacagtccaacatattttcattccaacatgtaatcaatattcttaagaaatcaatgagatatttttatattcttttttctcatggttagtcttcaaaatctggggtttattttgtgatccatctccatttgtattaaccacatttcaagtgctcagtagtcacatgtggccagtggctattgagttgaacggtgcagttttagagcttaaaaggcaaagacttactggcatctggtttatacttagtgagaaaaagttgagtaatgtataacttgtaagttaaaatatttgatatctctatatattctgattttagctttgggcaaaattaa

SEQ ID NO: 177921 - DNA, 199 bp, Homo sapiens
tccctactagactatgggctccttgaaggcaggtgctaattcttactcattatgtccctggaagtgaacacaaactcattattatagtgccatgaactgctgatgacacagctgctctgagtgcccaccccacctgcctagtcattaaccagtttctcatcctacaggtatatgcaaggaatattctgcgttggctcag

SEQ ID NO: 177922 - DNA, 542 bp, Homo sapiens
tccccgtggaagagcccgatggtgcagtttctcacggtcttgtattgtggtcagaggagctcacacaacacacccagtgtactggagtttatgacagacttcattgaatgaggccttgacttccagggaaaaaaaacgcctcacacaaaatccataaaatcggtcatgggaattctcagaataggcctaagtattctttcagaagtgatggatgctttgctttgttttccaagtcacgactgggtgtaccattcttgtagcaagcagaaacatctcagcatggaatgagtattttttatgcaaaagcaacctgcagacttataattaccattattatgtgggttccacagacttgtggcctctgcttgagcattaaacacgtatgaacagattgttccggcatctaaaacaaatgtgttcttgtgtgtgcatgcatgtgtgtatgaccgtgcttgtgtacacgttcaaaaggctctgcacaaagggtaccaagggacaacaaaactctcccctgtgctaactggatggagcgagacgaaggg

SEQ ID NO: 177923 - DNA, 596 bp, Homo sapiens
tccccgtggaagagcccgatggtgcagtttctcacggtcttgtattgtggtcagaggagctcacacaacacacccagtgtactggagtttatgacagacttcattgaatgaggccttgacttccagggaaaaaaaacgcctcacacaaaatccataaaatcggtcatgggaattctcagaataggcctaagtattctttcagaagtgatggaacatagctgttcacgagttccatgtggcatttggagctatgggctttcggtttttgctttgctttgttttccaagtcacgactgggtgtaccattcttgtagcaagcagaaacatctcagcatggaatgagtattttttatgcaaaagcaacctgcagacttataattaccattattatgtgggttccacagacttgtggcctctgcttgagcattaaacacgtatgaacagattgttccggcatctaaaacaaatgtgttcttgtgtgtgcatgcatgtgtgtatgaccgtgcttgtgtacacgttcaaaaggctctgcacaaagggtaccaagggacaacaaaactctcccctgtgctaactggatggagcgagacgaaggg

SEQ ID NO: 177924 - DNA, 266 bp, Homo sapiens
aagttctcacaactaacaagaatagtgtgttacatgtttgcaataatggcccccagtgagtcaggtccccgtctgcctatgcctttgtgtaaatctgtcccttccctgcaacctctactttgcaggtggctcttggaagtaacctaagatgactccacaactgagctcgtaacatgctctctctccctttctctcatactatgctcccttggggaatcttaaaaattctgttatcttggcccttttataacttcttccccattgat

SEQ ID NO: 177925 - DNA, 785 bp, Homo sapiens
ctaatgactagtgtcccacattggacaagataaaatggttgaccagttagagacataggaaaaagtggaatattgaatttgcattgaaagggctgaacttgtgaccttatgttatcttccatataattctaatttctacaatataaggttttaatttactcagttcagaaaatctaattgtttgacagtaaagtttggacctatttatataaagtttggaggaaatatgatcttatcaatatgcactatggaaaatgtcctttttagtctgtgaatttagagctatacctactgcttgaatgaagatggtctaaagatttaaaagacatttagggttaataagttttcatggcaaaacatttaacatttttaaactaaattcagatgagttactcattttttgtgtaccttaattccttccaaatactcttctgtcagaactacaaagttaaatctcaattatagtgcccttttttttatttagggaaataattatcatcattgattaatacattgtacaagggttaactgtcttttaaccatcagggtatagaaaaagtaagttggttaaaacaacttttaagtttattatggagataaacactattgtcatatgattctttagatttccttaaaaattgatctcctatgccaggcacagtagctcatgcctgtaccctagtactttaggaggctgaggtgggaggatcacttgagaccagcagttccagatcaatcttggcaatacagtgagatcgtgtctctactaaaaaaaagccaaaaag

SEQ ID NO: 177926 - DNA, 449 bp, Homo sapiens
cactactctacatatctgttggcctgtagcatacttactgcagaacttgtagcttgatagcccaatgtgttcttgggttatgattctgaaatactgctgagctttaaaaactttagcagctttgaccagaacacctacgttaaaatttctttataactcttcagaatttttttctttttctttttttttttgagacagggttttgctctatcacctaggctggagagtgaagtggcataatcatggctcactggagcctctaccttccaggctcaagcaatgctcctacctcagcctccacagtagctggggccacagatgtgcaccactgcacttggctaatccttaaatttttttgctgaggtgggaggatcacttgagaccagcagttccagatcaatcttggcaatacagtgagatcgtgtctctactaaaaaaaagccaaaaag

SEQ ID NO: 177927 - DNA, 146 bp, Homo sapiens
aagatacagcaataaggaagccagtccagagacatttccttatcacacagttaagaggtgagaaatggaacttgggtttataactagtaccactttgtatcatttagaatgcatgtagttgcaagaaacagaaaaataaacccaaa

SEQ ID NO: 177928 - DNA, 729 bp, Homo sapiens
ttcccccaaaataacttagttgctggctaactggagaaaagtcacaaattcttacagtggatttgttgatttatttttttgtctataactaagcagtgctataatgaaagcagccatcctttctcaaactggatagtagtgagattcattaaatgagatgctactagaatggcttatttcagaaagataccattgcttgaccataaatgttagatatctataaatatgaaattttggattcatactcagcatgcagttccaagcctagcaggaaatccaaaattcctaaataaaaagatttacagataagtcttttttgttttgttttgtttgtttgtttgtttgtttgtttgtttttgagatggagtcttgctctgtcgcccaggctggagtgcagtggtgcgatcttggctcactgcaagctccgtctcccgggttcacgccattctcctgccacagcctcccgagtagctgggactgcaggcacccgccaccacgcccggctaatttttttgtatttttagtagagacggggtttcaccgtgttagccaggatggtctcgatctcctgacctcgtgattcgcccgcctcggcctcccacagtgctgggattacaggcgtgagcccccacgcctggccaataaatcttgtaagaaaatgaaaacttcttatattaagtgacaaagttgaaatgcaaatggcaaactaggagaacatatttgcaaaaa

SEQ ID NO: 177929 - DNA, 578 bp, Homo sapiens
gagtctgagtacgcccatttctacaaggcccaatgtccatttcatttcgagataaactctgctttaggtaggaggattgttggcagtttacggcttccatcaaggtcaaggaactctgtgcaccttccctatgaccccaggggaagcactcgaggactgctgtggcattgtgctgcatcacttgctgcagggagattctgaagaagtgtaaggtctcagtcctgccctgtcccgaagcctccaacccacttctggcaagtgggaccttcccagggaacaatttgttaacagacccaaatatcctgtgattggatggtggctgccaaatgctttggaagctcagaggaaggagagagagcaatggcttggaagaaccaggatataaactaggttctaaagtctgcagggagatgggcttctcagctggggccagtgagcagggaccttaaggcagaaaggagccttgcatgttcctggaaattgagatgcccactggggtaggaaagcaccagaagctctgggaccaggtgtcagagttaagcctgtgaggcaggagagagcagaacaagccctgttac

SEQ ID NO: 177930 - DNA, 542 bp, Homo sapiens
ttgggtcatgccctcaaagcctcttcacctgtccaatgtccctgagggactgctttttgcaggtagggccccgaggtgggcccctggggtgggacccaagagcgaaagggaatctatcgcatcatttctgtcgccttcaccagcaccttgggtccatcactgagtctggggggttctactaggcaagtgtctctggcctcacccagacaccatggccaactctagccatcactccaggcgcaagtgactgggttaccttcaggtgtgaccacacctgtcaccttttgcaggtcggtgccaacagttctccaaacaggagctcaagccaccgtcccacttgccctgtgaagaaggaactgttatcatcacattttacagaccaggtaactgaggctcagagagggtaagtgactggcacagctggtaacaacagagtcagggtttgagcccagtctgtccagttccaaatctcccctttagtagctttctggacatcaagtggtcatcctgcaaccacaggtagccaaagagcctctctaaag

SEQ ID NO: 177931 - DNA, 216 bp, Homo sapiens
tgttcttgttctttagaatattatgattaaaatgaatcctgaatttgttctttactaagaagagggaaatgataaggaaaaagtgtatgtccaagatccagtccccaagccctccctttcaggatggtcagtggccctgcctgtcccttgtcctgtctgccccatgggcccatagggtcccatctatcaccatgcctggtcccaaacccggaaaga

SEQ ID NO: 177932 - DNA, 293 bp, Homo sapiens
tcttttgagttccagcccaccctcttcactgacgtatgaaagcggggttaaaaccacctatgacctcagaccaaatatgaaagtataggttgatagttcttagccgggttttgcggtgtgtgagtgagtatgaggacttcgtggtggtgaaatgtgcccgctgggttttcagctctctcgggtttccctgggagagcctatccgaacccagattaagaaagtcagagggaaccatgggtcttttgagaaagatccaagctgatttggaaatacccctaagatctatgttaaaa

SEQ ID NO: 177933 - DNA, 361 bp, Homo sapiens
gcagaggcatctctccttcctccagactcccagcctctgggattccctcagtctcagcactgattgcataagctgttcctgtctatgttccccattatactgagagcaccttaagggcacgacctgcatctgatctatgttcccaggatccagaggcagcatcaaaagtgaggagacctgaagcagagaggtacaggcagcagcaaacccctctgaaaaactagttggaatcacaccccagtcagaccccagatcttgactgtgccacagaaccatgacttatccccatgggtgtccctatcaggtatccctatcagtgtcctcagaccagagatctcccagaagaggcttgcaagctccg

SEQ ID NO: 177934 - DNA, 299 bp, Homo sapiens
ctaaccagaaacaaaaggaataaaaataaatattagaaatgtctgtggaatttaaaacaaaggcaaaatccctctggtcttgaagatttgacaataaaaaaattacttctattacctgaccacaaagtggaaatctacttaaaaacatacaaaagagctttcttaaaataggcactcttgacttcatgtggaaacatattaatgaatgatcaaaattagagtttttcagcaaatgctatcccaaaccctgggaacccaccctaagagagaaggagcctccctatcccagaagaaagtga

SEQ ID NO: 177935 - DNA, 144 bp, Homo sapiens
tggaggttacagtgtaccgagatcttgccactgctctccagcctaggcgacagagcaagacaccatctcaaaaaaaagaaaatcctgtaagatgaatttgttcctttatgaagaataaatttgtgtctgccatttacaccgtga

SEQ ID NO: 177936 - DNA, 329 bp, Homo sapiens
accagccccactctgttcccatgggattaatgggtcactcaggcccctcccttgccctggcactcaggtgggcaggagcctcggcctgcggcactgggagcaggaaaacgggttagaccaggcctggctccaaactgccatcctaggcttgcctgtccgtcaccaacccacagtctgttcctcccctcaggccttggggagggggcctccagtggtgagggtgccaggtctggagcagctgcacagccacactgggatctctgtctttgagcctcacccatgtttccagtcccactctgaagcagcccctccctgctgtaccgcccagt

SEQ ID NO: 177937 - DNA, 433 bp, Homo sapiens
ctctatccttaatcttgttttgattgcttccaaatggccaagaggtgaaatggacgccttctcaatactgcttcacctgacatttcctcaacaaagcaatcctttgtggtggaaaaagtcataaaaatactcttctcaaggacctgaaaaatctccaagaaaggaaaattacagccagaatactttatttactccgttccactcaggcaggaggaaaagggaactccttgcaacctcctaatgcaggtcctgtgctgacttcccttaatccttccctgccccttccttccctctgtccccgatgccccagtagacagctatgttgcttctatctatgcctgttaccttaggtcgggtctccacatcctggcttctacctttcagtacataatggtgtgctgtctgctctctgtgccgttaaatggcattaatt

SEQ ID NO: 177938 - DNA, 707 bp, Homo sapiens
atttattattttaaatgttttatagagatggggggtcttgccagtacaggctggtctcaaattcctgggctcaagcaaacatcctgcctcagcctcccaaaatgctgggattacacaacaatgccctaaaataagactttcaggtgaagcttatgcatgtctttcctgcttggtgagtagggtatgattagagttggatttttccatcccatattcactctacagaatcaatttagtgttctgcttatctatgggacattgatgtcatgtgatgggtgatgtcatgtgatgggtgatgtcatgtgatgggtgatgtcatgtgatgtgtgatgtcatgtgatgggtgatgtcatgtgatgcatgatgtcatgtgatgggtgatgtcatgtgatgggtgatgccatgtgatgggttatgtcatgtgatgggtgatgccatgtgacaggtggtcatgtgacaaggtgatcctgtgatgagtggtcatgtgatgggtgatgtcatgtgatgggtgatgggatgggcgatgtcatgtgatgggtgatcatgtgacaggtgatgtcatgtgatggacaggacatgactagggagcgtaatgcttgacgtcaagacggcggaggacctgctatcagggatatcgtccaatcgatgaaccattcgcctaatcagggcttttggaggctgaaggcatttgaggacttaatggccct

SEQ ID NO: 177939 - DNA, 694 bp, Homo sapiens
atttattattttaaatgttttatagagatggggggtcttgccagtacaggctggtctcaaattcctgggctcaagcaaacatcctgcctcagcctcccaaaatgctgggattacacaacaatgccctaaaataagactttcaggtgaagcttatgcatgtctttcctgcttggtgagtagggtatgattagagttggatttttccatcccatattcactctacagaatcaatttagtgttctgcttatctatgggacattgatgtcatgtgatgggtgatgtcatgtgatgggtgatgtcatgtgatgggtgatgtcatgtgatgtgtgatgtcatgtgatgggtgatgtcatgtgatgcatgatgtcatgtgatgggtgatgtcatgtgatgggtgatgccatgtgatgggttatgtcatgtgatgggtgatgccatgtgacaggtggtcatgtgacaaggtgatcctgtgatgagtggtcatgtgatgggtgatgtcatgtgatgggtgatgggatgggcgatgtcatgtgatgggtgatcatgtgacaggtgatgtcatgtgatgggtggtcatgtgatgggtgatatgtaatgggtgatgtcatgtggacggtggacacagtatttaggccctatttgcggcccttcatccatatggttgggccatcatattcgtggtttttttgcgtcg

SEQ ID NO: 177940 - DNA, 663 bp, Homo sapiens
atttattattttaaatgttttatagagatggggggtcttgccagtacaggctggtctcaaattcctgggctcaagcaaacatcctgcctcagcctcccaaaatgctgggattacacaacaatgccctaaaataagactttcaggtgaagcttatgcatgtctttcctgcttggtgagtagggtatgattagagttggatttttccatcccatattcactctacagaatcaatttagtgttctgcttatctatgggacattgatgtcatgtgatgggtgatgtcatgtgatgggtgatgtcatgtgatgggtgatgtcatgtgatgtgtgatgtcatgtgatgggtgatgtcatgtgatgcatgatgtcacgtaaacgggtgaggtaaaacgtcgaaagtctctataaaatcaaaaatattccccaaaatccttttgacatacgcataacctcgaacaagagcgcacttttttaaattggaccccaactgaaattttaccgtttttaggcgaaggccccaacaaacccatcaccctatgggcctcttgggccccgtccccctaccccttttttggccccctggggcaccccccttatataccccctaataaaccccccctttctttctcattgtgagtccagcctggggggcaccttttcttcc

SEQ ID NO: 177941 - DNA, 327 bp, Homo sapiens
tctctcttaggatttgatacatcagtcaaatggaatgacattttcaaagcagtgcttctaactgggcagtgcccaggcttggtcaatggccctgactgcctactatctgaagctagcctatgacgcaggcctccagacctggcagaaaagatttaacccagctggaatagatcaattcgtttaagttttttcttttcacaagctgtcagttttgccaactttttaaaaggtgacacttcaaagcaccaatatttttttttcaacaagcaagatgtgatcctgcattcttagccctgctttttaaaattaaatgactaatgaaaacac

SEQ ID NO: 177942 - DNA, 303 bp, Homo sapiens
tctgttttattgatccatttgtttatccctaaaccagtaacaaactaccttaattatagtagctttactgtggtcctgctatctggtaggtaggccaagtctcctcatcttgtcttcaaaattttgctaagtattttcctgttccttcacttctctatatgaagtctacttctagaactgaattatcaagttcctaattaaaccctattgaaatttaagtaaaatttaaaaatttggggatacaatgtctactttataatgctgtgtgtgtgtgagacagagtctcgctctactgcccaggct

SEQ ID NO: 177943 - DNA, 162 bp, Homo sapiens
ttagtacctaactttcacattctaaaattactcatatgcacaaaactgatacagctttggaaatgaagatggccgactatcttctgtgttttaagaaatgatgtgtttacccttggtaaaacgccaagtgcttttccttttatctggactgattacaactta

SEQ ID NO: 177944 - DNA, 171 bp, Homo sapiens
ggaagaggaaaaacaagaacagaggaaataaactaaccaacctaaagggctcatcctttaggtggataactagggagaattggagcacgggaaattcagtgtggaaactttttcatgtcgtatgtctagaaaaggcacagctatcagaatgaatttagaacttctaagtaa

SEQ ID NO: 177945 - DNA, 473 bp, Homo sapiens
atggtagcaagaggggaatctgtgtgtatatgtgtatgtaggaggtactgaactgtatatgggaactctctgaactggctgctcaattaagccaggcatgttggctcatgcttgtagtcccagcactttgggatgccaaagcgggcagatggcttgaacccaggagttcaagaccagcgtgggcaacatggcaaaaccccatctctacaaaaaataacaaaaattagccaagtgtggaggtggcaggtctgtggttggtcccagctaccccagctactcaagaggctaaagtgggaggatcacttgagccagggaggtcaaggctgcagtgagctgagatggtgccactataccagtcaataagaattgatcaattgactgatcattgaatgccatcagtcagtgatgtttttactgatcagctaagaaatgagtattttttttttttttttttatatggagcctcgctgtgt

SEQ ID NO: 177946 - DNA, 400 bp, Homo sapiens
cacacattggttatctgcaaaacatgtgttgacacatttcattatataaccttaaaaaaatcatattcactaatgtcaccattaatgaaaagtctaagtattgggaagctgccaaacctttgcgggcagatacaagttttccaaaatcctaacttttgttcaaaagctcaaatgtaatcatttgctacaaattattatcagctgttttccttaaagtaataggcttactccattttcaagaaaatgtttgccaataaccatagtttgtcagtcattctctcaaggaaaaatgacattcaatgaaaaaagtgactagtttttagccccaacttaaatgacagacgaatgtttttcctggagactaccaggaacagaagtgctttattcccatttcatcaca

SEQ ID NO: 177947 - DNA, 594 bp, Homo sapiens
gtgacctagaggatcccctcgaatcgacggtttctccatgttggtcaggcttgttcgaactcctagcctcaggtgatccacccaccctcggcttcccaaaatactgggactacaggtgcgcgccactacacccagctaatttttagtagagatggggtgtcaccattttggccaggctggtcttgaactcctgacctcaagtgatccgcctgcctcggcctcccaaagtgtgctgggattacaggtgtgagccactgctcctggccaggaaacaattttaatgacaagagtattgctacttacagaaaactgttctcagttgactaaccttatagaaattttatggtgaagtaagaatgaaaatgagaaataggataatcagtgaggagtagtggcttactcatgtagttctagctactcaagactaaagtagaaggattgcttgagctcaggagtttgaatcttgcctgggtgacataccaagagcccatcttgagcaggggtggggcaaaagaaaaaggaaaattatttgtttctggaatttaaccttagaactaaagtacagaggaaaaaggaagaaaactgagagacatc

SEQ ID NO: 177948 - DNA, 417 bp, Homo sapiens
  misc_feature (1)..(1): n is a, c, g, or t
nctatttaaatgctgtatgatgtggccggcgcggtgctcggcctcccaaagtgtgctgggattacaggtgtgagccactgctcctggccaggaaacaattttaatgacaagagtattgctacttacagaaaactgttctcagttgactaaccttatagaaattttatggtgaagtaagaatgaaaatgagaaataggataatcagtgaggagtagtggcttactcatgtagttctagctactcaagactaaagtagaaggattgcttgagctcaggagtttgaatcttgcctgggtgacataccaagagcccatcttgagcaggggtggggcaaaagaaaaaggaaaattatttgtttctggaatttaaccttagaactaaagtacagaggaaaaaggaagaaaactgagagacatc

SEQ ID NO: 177949 - DNA, 277 bp, Homo sapiens
  misc_feature (225)..(225): n is a, c, g, or t
  misc_feature (227)..(227): n is a, c, g, or t
  misc_feature (246)..(246): n is a, c, g, or t
  misc_feature (248)..(248): n is a, c, g, or t
  misc_feature (270)..(270): n is a, c, g, or t
agaggagaatccaaaacaggaagagactgagctggctggtggcgcaggctacattccatgccccagaaggttgaaggaatctgtgaatctgtgacagaagcgtcaacttgagtttatgagagtgtagtggggggcagatctaccacgggagagtagatttgaagaagtctttttttttttttttttttttttcccccaaaggggggaggggtttattttgggttngnaaaaaagggggcccccggntnaaaggggtttggggggcccccnccccaaa

SEQ ID NO: 177950 - DNA, 272 bp, Homo sapiens
tcagaggcagcccgttcccacgtcagaccactctcctttgggaaaggagatctccctcagggggaacagaaaagtaactcctggaaacttccactcatgagtgccaggcatccaagcacctagaagtgaactcaaatgccacttcctcaagcgtgccctccaccagccagggagctgcccacccagcagagtctcaccttaccaaccatcatttgcattgagttcatcacccctacctgtggaatgaaaggcgggtcccaggtgagaaggca

SEQ ID NO: 177951 - DNA, 382 bp, Homo sapiens
gctgggtgtgagccccaggatcccaagatacccgcaatgtaactgcagttgggttctgctatatgtgacactgccctgagtgaggcctgcacttagctgcctacctgggcagatgcttgcatgtgccgacaaggtggtaaaatatactgtctttgcagcaggtccctcatggcatggtaggaagaggatggggcagacagactcagtttcaaggcctggcttggcctttgagtgaagaagggatctcccaccatgtaacctgagagaaggggggatgggacaggtgtgggtaagtctgtagatgttgggaagcaaatgaagaagttacctctgatggcttccattttttccatcaaatatgatgtagtgtggagagtgggct

SEQ ID NO: 177952 - DNA, 318 bp, Homo sapiens
gttatgattgtgtcattgcgcaatcattgtttcactgggctactgagcaaggctctgcctcaaaagaaaagaaaaaagaaaagaaaagaaaagaatgcacacactatgctgaacactttatgtatgtaatttccaaattctcacagccacctagtgtgagcttgtccaacccacgccccacggccctggcccaggagagctttgaatgcaggccaacacaaattcgtaagctttcttaaaacattataagatacgtccgggtgcggtggctcatgcctgtaattccaacactttgggagggaggccaaggtgggagga

SEQ ID NO: 177953 - DNA, 648 bp, Homo sapiens
gtgagagcctcgtgcaggcaggccttcctcaacgtggtgtggagaagagtgacccctggtcaccagtccttgttgcgatagtgaacaggctctcaggggcctgggtagcatttctggctcctctgctcatccttgtagagatagacatcccctaagcttcactgatttaccagccagaaaggggcaggtcatgttcagaacaacactttctataattaccaggatctgattcgctgtattcctttgattttaaggaaatcagctgtaagatgtgtcactgaaaacaactcttttggaataggaaatactaccacatgaagtaaatacacctgttgtgaatatacatataagagtcacctcataaggccgggcgtggtatctcacacctttaatcccagcactttgagagggcaaggcaggtggatcacctgaggtcaagagtttgagaccagcctggccaacatggtgacaccccatctgtactaaaaatacaaaaattagcccggcgtggtggcacacgcctgtagtcccagccactcgggaggccgaggcaggagaatttcttgaacctggaaggcaaaggttgcaatgagctgagatcgcgtcactgcactccagcctgggtgacagagtgagactctgtctcca

SEQ ID NO: 177954 - DNA, 610 bp, Homo sapiens
gcaagcaagcaggatacaagatcaatacagaaaaaccaacagtattttatacaatattgaaaaatctaaaaatggaattaagaaacaacatttacaatagcatcagaaagaatacttaagaataaacttaacaaaaaatgcaaaacgtgtactctgaaaactacaattgttgaacaaaattaaagaaaatctaaataaaatggaaaaacattccatattcgtaagtctgtagacttaacagttaagatggtgttgggcgtgggggcatgcacctatagtcccagctactcaggaagctgaggagagaatcgcttgagcccaggagttcatggctgcagtgagctatgatcacaccactatactcagcctggcaacagagcaaggcctcatctcaaaaaaaaagtatatattgtcaagatggcaacatgccccaaacccaaattgatctatagatgcaatgtaatccctatcaaaatcccagttggcttctttgcagctatcaacaagatgatcctacaattcatatagaactttgggggactcagaacagccaaaacaatctgcaaaagaatgaagttgaacgatttacacttcctgatttcaaatcttc

SEQ ID NO: 177955 - DNA, 222 bp, Homo sapiens
ttttgaaacagatataaagaatttgcaaattatattaataaagttgctaaaaaagcaactttttctgggagatttcaaataatgttacaaaactgagacttacaatagtaacaattttataatttatgtgaattggtgttaatgttttgaattacatactgcagtccatagacagtggtgaatgccagctgttgatctgacacgctagctatttctgctata

SEQ ID NO: 177956 - DNA, 485 bp, Homo sapiens
atctcagaaatcaagaatggtagctacagcccagccaggcttcccagagacaagagctggagggcatcccaggagccagggcagctcaaggcacttcagtggcggccatccccctgtcttcactcctcctgttccttcctcttcatgtgactcagccacaccccttctctcttctcctgccagttcttcccatgtttcttagttcacatgcctaaaagcagagcctgatggttcatcttttttctcaggtcatcacaggtcacatgccagcctatgggttggttccaaggatccactctaagaccaggcataggggaggcaaggttcacatggtccaaaacatgggcatcttaccccagggctgtggtcaggacagtcttgctaagatgaaataataggtgggacgcagcttgggaagtgtggcctgccccatatggctactgctcaccaggcatcgtgctggatggaggggccacagatggggt

SEQ ID NO: 177957 - DNA, 328 bp, Homo sapiens
aagggtgcagtgagccaagatcatgccactgtgctccagggtgggtgacaaagcaagactccatctcaaaaaggaaaagaaaagaaaagaaaattcattcttctccaggcattaacttctcttcttgctctacattcctccctagaccgttatcattttaagccattatgagacccgctcggggcatgcaggtttctcacaatagaggaaagcctctgtctttccttctgtttccagacctaggtggccatgtaagcaatatttcctcttgaacatctcaaagttacccaagtactaaatccaaaaccaaacccatgatccctttcat

SEQ ID NO: 177958 - DNA, 294 bp, Homo sapiens
ttttaaatcgcaagcttggagtgctatttcttactcatatttaacgttacagagttttctcttctttggtttaatatttgtagctcgtttctcttaatgctagaaatcttggttcttaacaacagtatatttatttgttaaaacagtttcatagtatcaaaattatcactactaggggagcagagggctcacacctgtaattccagtgcatcgggaagctgaggcaggaggatcgctccacgtcaggagtttgagagaagcctgggcaacgcagtgagaccttatctctacaaa

SEQ ID NO: 177959 - DNA, 530 bp, Homo sapiens
agaggaaaatcagggataccgttgctggaagaaagaggaatagaagcagcaaggaagaaaggcagaggcctgaggtccacgtagaagcagcaaggaagaaagaggcagaggcccgaggtccacgtagaagcagcaaggaagaaagaggcagaggcctgaggtccacgtagaagcagcaaggaagaaaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaag

SEQ ID NO: 177960 - DNA, 247 bp, Homo sapiens
cttgttatttaaatgaataaatactttaaaagttcttcagttataatttccaatgtagtggatattggtaagcataatgcatgtaagaaagagctctttggagtgctcaatacattttaagagttttacaactcgtaaaggggtcctgagaccaaaatgtttgaaaacttgagaaatcctgcttgagaacagctgccccaagatgaagtagacttttcagtggtggtatgagctgtccatgcagcac

SEQ ID NO: 177961 - DNA, 416 bp, Homo sapiens
caaatattgttcctattccatgctcgtctctctttctgagcaataactataattcaaactattttatcatgttccaaatatctcttactttatgttactgttttcttccctgcttcggtatgtaaaatttttattgacttatctttggggtcactaattctttattctgttgtacctaatttttaatattaaaaatttttaattttaattttaatattaaattagtattaaaattttaatattattttaatgttatttttattaaataatattaatattttaatgttatttttattaaataatattaatattttaatgttatttttattaaataatattaatattttaatgttatttttattaaataatattattttaatgctatttttattaaatattaatattttaatgttatt

SEQ ID NO: 177962 - DNA, 441 bp, Homo sapiens
gaaaacaggagtgctctggatgcaactatgaaagaacaagaggattccttctagtgacacaattgttctgtatcttggctgtattgatgccaatatcctggctgtgatattgtaccacagttttccagatgttatttggggaaaatgggtaaagtgaacacagtacccctctgtatcatttctcataactgcatataaatctacagctttctcaagataaaaagtttaagaattttggttttgcatacaaattctaaagcagctggaagaaaatatacccacgattaataattatttaagtattccctcttgacggcatttggcagtagtcttcattttcaaaaacctattgacatagctaatacattttcaaatagattctttatttttaaaacaatacaaaacttttttttttttttgagaaaaaagtctcattctgta

SEQ ID NO: 177963 - DNA, 182 bp, Homo sapiens
cctttttatcactaaataatattccattatatggctataccacagtatccattcacctgttaaaggtgaatggctaaacaaactgtggtacagccatgtaatggatgctgtttttgatgtatgtgctgccagtttttggtgatttgaataaagccgttataaacatgtgcatgcaggttttt

SEQ ID NO: 177964 - DNA, 799 bp, Homo sapiens
ggacagcgagggcctgggaaacgcgtggaacacacgtcccggctcgttttcctctcccactctgataacctgtgtttcgatacgaaacgggccctgcctcattatttgtcatctccctggaggtgacggagggctgtttcaacctcaggggaaaagttgctgtacagaacacaggccagagtgtgccccaaagaaatcaggcggtggagtgatttaaaagtgatcattttctgtagtcctagctactcgggaggctgaggcaggaaaatcgcttgaacccgggagaagaaggatgcagtgagcagagatcgtgccattgcacttcagcctggcgacagagcaagactccgtctcaaaaagaaaaaaagtgatcattttcatgaatgctgcctctaaggtccctcctgctgacaatggccagggcagtgcggaggctcctctttggaaattgtcttcagagctgatgcagactcttttgaaagcagccacagacattggggatggagtctggtggttaaggacttggactaggaagatcaactgggcacggtgattcttgcacagatttttataaggatcctccaagtgtaacaaccatttggaaaactccgggccttgaggacagccagagaagataagttcaacttgcactttgccagagcaggggatctccctcagctccctgcttcaaactaacttacagaactgcctggctgcactgagcacctttcttccttcctattcccactaaggaggtgtccctgcttccttcatagtgggtccttcccctgcaccggga

SEQ ID NO: 177965 - DNA, 266 bp, Homo sapiens
cagttgagatgaagtctccctctgtagcccacactagaatgcagtgagctaagattgcaccattgcactccaccctgggcgacaaaacgagagtccatctcaaaaaacccccaaaaacttagaagctatttccagaagaaagggacaggcagaagtaacactgccacccttgcagccttttaccttgacattctgactcgcagccttatgaatggttctgagaacctaacaatctccctcacctttccaatggtgactcactaggt

SEQ ID NO: 177966 - DNA, 575 bp, Homo sapiens
gattctatcttagatgtaactttccccaggaatccttctgtgttccccttccctcctaccctggctgagtttgaagtcatctgtgcttccacaggttcctatgaatatttccatcgttgcttttaccacattattttgtattttgtgtttgtatcttctctactaatctgtgagttccttgagggtgtcttcatctttttatccttatggtagacaccagacttacgttgagtagatggatgagtggatgagtgaataaatcgggatggaatgtagtgagaaaaaagaccataaaattagatggagccaaattatgggaggccatagaggtcatactgagagtttgggttttgttttgtagagtagcagtgaccaaccagtggctcatgcctgtcatctcagcacttggggaggccaggacaggaggattgcttgagaccaagagtttgataccaggctgaccaacatagtgagaccccatctctacaaaaaattttttaaaaaaattagctgggtgtggtggcacacacctgtcgtcccaattacttggcaggctgaggcaccaatcaccacag

SEQ ID NO: 177967 - DNA, 559 bp, Homo sapiens
ggcaggcagatcacttgaggctgggcgttcaagaccagcctggccaacatgatgacaccccgtctctactaaaaatacaaaaattaactgggcgtggcagagggcgcctgtaatcccagctactagggaggccgaggcaggagaatcgcttgaacttgggagacagaggctgcagctagtggagatcgcgccactgcactcaagcctgggcggcaaggtgagactcgcctcaaacaaacaaacaaaaacaacaacaaaaacttagctggataacttagttatccttgtgtttatctgctgaatctgaccactctattcaaggtcatctgatttctaacgtctggctgtcccagatggggacctggagaactagacagggaaagtgaatgaactggttcctgcagagccacctcccagatgaaatcagagtaaccccatggaggtcctgagtcacggtggcaccttgccctgcttgcctaacaaagacctcctgggaggaggacccagaagagggcagggctgaagaagagtcacagctgaagaatgtgactgtttgcca

SEQ ID NO: 177968 - DNA, 403 bp, Homo sapiens
cctctgagttccttagggctactgataaagtttggatgtttgtccctacccaacactcatgttgaattgtaattcagcatgctggaggtggggcctggtgggaggagtttggataataggggcggagcctttgtggtttggtgctgtctatgccatagtgagttcctatgagatctggtcatttaaaattgtgtggcatccctcacctacccccacttgcttctgctttgccttctgccatgattgaaagctccttgaggcttcaccggaagccaagtagatgccagcactgtgcttccagtatagcctgaaaaactgtgagctcttttctttataaattacccagtctcaggtatttctttatagcaatgcaatcatggcctaatatagctaccattacaaa

SEQ ID NO: 177969 - DNA, 517 bp, Homo sapiens
catcatgggggagtaacatcacagggccttgtgacatgacatcatgagaccaggcatcaacagacaggtttatcattaaagtaacaaaagcaaaaaaacatcaacatctccctgaaaaccaggctacatatcccaggtggctcgttttcattcccctccaggcaccctatctcctttaggatgttatgggtatgatttttatcaaagaacagtacgcaactaactactacctaggaaggcatcaagatgtcaaaacattttaacaaatacatgccaacaggataaaaatcctattctgcctacgtcatgattttaacaaaccatgtggatatattttataaattcaagcaccaatataatggcttaacttcctaagtgactaaacatttcaagtattttaaggagaggaagcataggtctagcaaagcacatttggggtgatgatgtgctacagtcagcatattctctaggaagcccacagcaacatgctttttcttttttttttttgagacagggt

SEQ ID NO: 177970 - DNA, 502 bp, Homo sapiens
agcaaactaaaagaaacatctttagcgctggacttctcagaacctggaatgtggctctatggctcataaaacagcaaggttaagacagagcatgtcatttttttcccagaaatgttgaaacactttccttcccttggcttcagtgtcacctttctcctggttctccatcaacctcttaggctgctccttcttgatgtccttcttgacaatctgctgctgctcagccattctcttttcattccccatggatttctcaagtgtgtttctattcctgcatattaaactttccttgtttttcctgacacttctccttgtctgaccctcccctgttctaaggcaggtgttccatctgtgtgtgcttttgtcatcctgggatgctcccagcatgttccctaccacactccatcaggttttctccccagactctgcgagggcagcggccttgtctccaccattccttcaatgctacgcacataacacagaagctgactccataacattt

SEQ ID NO: 177971 - DNA, 476 bp, Homo sapiens
tcgtgacacttcagactgtctaggtctgcacaggctgcactctaacaaggagtggcatgcatattcatgacccagggctgtgggaccagacacgcttcctagggctatattttacagtgtttttatttcctactcaaatttcttgaaagaaacaactatgaaaaattgattttgtgattatgattaagtctagaacccaagacagcagtgctaaaatgttctcactggaaataggaacagattagaggaggtttgtgtagtatttgatttacagatagacaacacaaaccccaaaatgttggtgctcacttagagggggcagtggagcaaacttcacatctgcctaagaagaatgcataagggttctaccttcgtgaagtcctccttaaaccggaaggaaagatgaatttcacttaaaatatgtaagagtattaaatgtatatttaaatgaaaagtgtggaggtttactattattg

SEQ ID NO: 177972 - DNA, 246 bp, Homo sapiens
gggctggggtagaatgatatgctttgtctgtgtccccacccatatctcatcttaaattgcaactcccacaattcccatgtgtcctaggaggaacccggggggaagtgattaaattatgggggcagttctgaatctcaagacatttgatgtttttaaaaatgggagtttccctacacaagctctttctttgcctgctgccatccatgtaagacatgacttgctccttcttgccttccaccatgattg

SEQ ID NO: 177973 - DNA, 1170 bp, Homo sapiens
taattaaatggtaaatacaatgtgacatttttttcttaccttttcatctaacttgtgtccccttctttccatttccccaaatgcaaccctgaatttcaggactttgtaaactctactctagttttgctttctgtttgtttgtttgtttgtttagagacaaggtctccctctgtcgcccaggctggagtgcagtgacataatcatagttcactgtaaccttgaactcctgggttaaagtgatcctcctgcctcagccttataatttagttttaattaacctccttgaaaaagttgcagcctggtgctttatttaaatatcttgctttctcataatctgtgttattttagtagtcctgtatttatccttgctttcctgacaactggatataaaactacacaaaacattgatttgggcacaaagaaaatcagtaagtaccaaaatagatacaacataaaggtggtggggttttttatgaactaatttgattgaagtgagtttatcttataaaataagccgggagactgaaatggagtctccttcagtggtacaccaaagggagtgtagggtgtagtaggagctctctgcctccgagaggaggaatatattagactgataacgtttaagtctgatgtatggtgacaagaaaaaggccaattttttgttttgttatttttaagttacctacagataatgcatttcattattgcctacttccaactctccctatgtagtatgtttctgatcttctgtgcttgtgcagtgtagatgagctcaccgctttaatttttaagatagaaatgtggaaaactcttgaatcatagactaggggaaggaaccagaggtcctctaaaatatcagaggagtgagaaggaaaggaagagctcctttctagggccatagaataagagtagaagtttttgctcattttttttgtttgtttttactttacaaaaaaataaaaaattttttgctctttgaataacttaacatgaggaatttggaaacaacctctcttgaaaatatattggtattcattcccaaataattcttctaagtaccacttgaccagaggatagggaaaggaggaaaaggtgagtgtatttatatccttgctagtttttgttatatattcagttgcagatctatattatatatcattttattatcag

SEQ ID NO: 177974 - DNA, 517 bp, Homo sapiens
cttgaacttctgacctcaaattatccgcctgcctcggcctcccaaagtacagggattacaggtgtgagccaccgcgcctggccctaatttttgtatttttagtagagatggggtttcattcaccatgttggccaggatggtctcgatctcttgacctcatgatccgcctgccttggcctcccaaagtgctggatttacaggcgtgagccactgtgcccagcctaaaaaagtattcctattatcgatttatttgaatcaaaattaaaactgtgtgtttggtttttatatctctttgatttttatctctcttaactgtcctttataacagttgctgcttctgttttttttccgatattaactataaggcactgtagaatttcccatattctggagttggctgattatgtctttgtggcatcatttaatgtgtacctctgtccctgtatttcctgtaaactgggatttagattcagagactggattagattcaggctctttctgttggtaagaatgctgc

SEQ ID NO: 177975 - DNA, 1148 bp, Homo sapiens
tgctgggattacaggcatgagccaccgtgcccagcctgcatttctatatgccaacaacaagtataatgtttaaagatccatttatagtagcaccaacaaatacgcagtattaaaaagaaaaaagctaaaagacatatgttcatagatttgatcagtcaacataataaagatgtcaattttccacaaattgatatataagtttaacagaattcctgtcaaagtgccagcaagatttttttgtagatgtaaaattgtgaagtcccaaagcctccctcacttctaacatcaactgtaagtttgggcatctctaagaccaccttcaggtttggtaatttgccagcactcatagagctcactgaaaactgttacattcagttacagcttactacagtgaaaagataccaattaacattagctaaggaagtgtcacatatggcaatgtttaggaaagttccaagcatgactttccaattgtcctctctcagttgaatcatggacacctctgtcttcttccagcaacaatgtttgagaatatatttagaattctaaatctgggaagttcattggaggcttggtatccagagtttttattgggattcagttactttgacatgttaaccacccacatggcaaactttagcctccagaccctccaaaggtcaagctgatgcaatacagtccaaaggtcgaaataaaggaagccattcatatcaggcagaacattccaagggctaagagattactccccaggtgctgagggcaaaggccagacctctctttgggcaaggttaatcctttacggcacagtggatatagacaaaattattctaaatttctatgtaaaggcaaaggatctagaatacttaaaacaatttttaaaaaggagaataaaatatgaaaaatcagtctacctaacttcaagacttattactggcaaagatacagagaaactggattgctcatagattgctggaaggaatataaagtggcacaatggacctggaaatagtgggccagtttcttgaaaaactaaacatgaactaaacatgcaactaacgtacaacctagcaattgcattattgcatttatcccagagaaacgaagcaatggagtttatcccagagaaaccgtcgattcgagctcacaca

SEQ ID NO: 177976 - DNA, 657 bp, Homo sapiens
atcaaaattttgaggcccaactagagtagtgatgaggtgagatttatagcaacaaatgcctatatttgaaaagagggatcccaaatcagtaatctaagctcttaccttaagaaactcaaaaaagaagagcaaacttaaccccaatcaagcagaagaaaggaaaatgtaaagtgataccaattctacacagtctctttcagaaaaaattaggagagaacactttccaacttatttttttaggtcagcattaccccggtgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaattcattagtataatcagtatattaacaattgaacatctattcatcatttaaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaag

SEQ ID NO: 177977 - DNA, 323 bp, Homo sapiens
tttttagtaaagacaggatttcaccatgttggccaggctgtttttgaactcctggcctcaagtgatccacccaccttggcctcccgaagtgctgggaatacaggcatgaacaactgcacctggccgattgggtgccccttctatgtgctcccattgccccaggcatagtgtcaccataactcttaccattctgagttgaaaatgattttttttttttgcttttttttctctcattaaatgcaaagcttattgaaaagaggacagtggttgttcactgttgtactcctaacctttgactcagtgtccttaggttggctctagag

SEQ ID NO: 177978 - DNA, 443 bp, Homo sapiens
gttttccccctctattcagtttctgcctccagcatatcctgcagaactaagttttcccaaactcgcctttatgcaatatttctctgatcaaatgtcttcaagtgattccagtaattaaaagataaaagctaatgccaggcattgcaggttttcctatctctctaacttttattctctcattctatctattaccttataccagtgttccttttcagtcaagctggttttcttctacaaatataagccatctctgccttacattttctaccatgccactgaccctcctagaatggtcactcttatcttcagttttctaagttctactcctctctagaaaaccctgtttgagttctaccaagtttccctaatcttgttaaataatattacacctgttcatactgctcattacagtatatacttgattcagaatttcctgtaatgtt

SEQ ID NO: 177979 - DNA, 747 bp, Homo sapiens
ttgtatatttgaaaatataaaatgtgattgtaacatgaaggaaaaataaaaggtgataagtaaaacaataattaacaaaatgtggaggaatgaggagactgggaggtcaggctttctgtctgctagtccacagtccttgtcaacataaatctatttagttgtgggggagggtggggagtgggagaaggtggcaggccaggattcagagttctctctgaggtttctagtttggatgactgagtttatggtgagatggggattccaaaaggggctgcagattctagactgaagataatgaggttgaactttggaaggtttgagaatccaggatgtttagacaggtgtggaactggaggacatgcattgggtgtctggagacaaagagaaagatgaagggtaggaatatgcaattaggaattacacacaaatctgtgataaaatgagctggcctctctgcaaggtgggttggatttgaaggtatgaaaaaagtttaaatgattcattctgaaaacagtagcttaattaagtaaattagcttttcccagaatatgtgcctcaaaaacctagttctgaagagtgatagtaagtgctcctcaaaataaataaatatgcaaagaaacaaacgatatgtcagcaataggttcgaaaagcaagttaaacaaagtttaaaaggtttcatagcctttcatataccaatgtgcctctttttccaaacatattaggccactgaacttttttcttaaggag

SEQ ID NO: 177980 - DNA, 290 bp, Homo sapiens
cacataacctaatcgctgcctattaggagctcaaagtgcagcaggcaaacaacatatgtaaataattacaaatctctacaaaagagctataataaagataggctcaaggaaggcttcatagaataaagtgggaccttgaaggagtaagaggtttggcaaaggaaaaaaaaaaagggtgaggtaggagtggagagaggacaatttgggttatgaaaacacattacaaggggacacagcataaaaaaaaaaaagatgcctaggactgggtaagtgcttttacatgactagat

SEQ ID NO: 177981 - DNA, 404 bp, Homo sapiens
gctatcttcagaaattaaggaatgagaggcaaggaagaaaggacattcatcttggaaagacccaaagcaccttgaaatttggaaggaatgttttgctagctgctaaaaccacctttgtcaccagaatgaatgaagtgcttcagatttaaataattgatcattcttagaagagctgctgtaacacataggggaagtgaaaactaacagatgaaagttttgtcatgcactgtaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaa

SEQ ID NO: 177982 - DNA, 451 bp, Homo sapiens
aaaaacaccaagctgaattctaaagtgtggaatccaggttgcaatcagcttataaaggagcttgacaccacactaaacaatttgttagtggaagtcattaccagggcttggatcctttcctcaaggtagggaagccctgagtttcataaactctaatgaagtaatttctaagtgagaaattcagttaggggaccataccaaatctcagccttagagacctgcctatcagcaaagtggccaccaaacagaggccactgctgcccagatgcagcaaaactggtatcacagggcatgtgtgctacaggctcggctggcactgagcactgtgcaagctgtgcctcccacacagtcacaaggaagttagatttgtattttcatatagaatcatttttgatgggtacactgccatcagagattgtaggaatccaggggtgcttaaaacatacaagcg

SEQ ID NO: 177983 - DNA, 393 bp, Homo sapiens
aaataatggactttctccatctacctaaaggaacaaatattatgataccctctttccctctcattctctactgtggtgattacaaataaccagtttttcaaagcttgctaaagaaacattaaaaacattaaagacacattaaagtgcattacagtgcttaggaatatcagaatacgtatttgggcttggtagaactgtgacagatacaaaagttcagttcagatatatgccccaaattaggaagccccttgttatctgcagaaaatggcagtttgaaaataagccctgtatagaacagcaatttctactgaggtatagaaagaaaacattagcatccctgctctatcaataactgtaccttgtccttttaaatttctatatttctgtgtatgt

SEQ ID NO: 177984 - DNA, 418 bp, Homo sapiens
atagattgtccctcaaattgagttttctgatgtttcctggttagattcagtttgtgcatttttggcaagaatactgaataaatgtgttctcattgcatcacatcagaggcctataaattcagtttgtcccattattggtaacagctcccctcatcaattggttaccctgaagtatagttcatataggaatagctgcataaatgctgccttttcccctttatcacttttagaataatgagtcctgtgtaattttaaactgaagtaagtcagtatagagtgattctatacctgttgctttgaggtctagaataagagtgttttgctactaggagaaaggtgttttgttttgttttgttttgttttgttgagacggagtctcgctctgtcacccaggctggagtgcagtggcgcagtctca

SEQ ID NO: 177985 - DNA, 313 bp, Homo sapiens
gatgggactacaggtgcccacgaccacgcctggctaattttgtatttttagtagagacttttcaccatgttggccagactggtctcaaacccctgacctcaggtgatccacccacctctgtctcccaaagtgctgggattacaatcatgcgccaccatgcccagctaaattttgtgtttttagtagagatggggttttgccatgttggccaggccggtctcaaactcctggcctcaagtaatccgtctgtgccttttacccccaacacaatcttggtgacaaggactttgtgttttgttctctattaaatccc

SEQ ID NO: 177986 - DNA, 795 bp, Homo sapiens
cccacagtgacctcttcctattgatgaatagtggctgccttgactcccttgtacccactgccttacctcctatgtgggcttttctgaattgctagcctcttgatctctaccaacgttctgtcttccaggactgagtaatattcttcatctgagatccaggctaccagcctgtttgccaatggcgttcctatccctctgaatgcatcttcttgtgcccctttctagaataattgtccttagtcttaactcacttgacctgctcctgcgagtgaccctgtggtctcagacctgtttttcttggctcatcttgtgctgctgcattcctcagagaagcagaatttattttcctccaagcaggagttgttatgttttccttagttgttttatccttccactttttggttttgttttgtttttttgttttgttttttttgtttttgagacatggtttcatttccattgcccagactggagtgcaatggtgtgatcttggctcactgcaacctctgcctcccaggctcaagggattctcccacttcatcatctcaagtagctgggcctacaggtgggtgccaccaagtgtggctaatttttgcatttttttttttttggtagaggcagggtttcgccatgttgcccaggctggtcttgaacttctggtctcaagcaatccacccaccttgggctcccaaagggctgagattataggcatgaaccactgcgtctggccatcaggcctattttgactttcatttatcactctgcttctctaaaagctggcagcagtgatgttct

SEQ ID NO: 177987 - DNA, 534 bp, Homo sapiens
cagtgcatcctctcatcttttgttatagaaatctgattaggacagtctatgattcacaacccttctgtagttgccactgtcttcaggataaattctagattccttgagaaaagcaaacatataaggcattcacttcacattccagtcctttccttacttttccaatctcacttcctgccatcttccctcccttctgaccaactcctaaccctctaactatattaggcttcttcatgctcctggaacacaccaaacttcttcaaccttcacccctgtgagagttaactttatgtgtcaacttgactgagataagggatgcccagatagttggtggaacattatttctaggtgtacctgtgtgggtatttccagaagagattagcatttaaatcagcatgctaagtaaagaggagctgccctcacccatgtaggtggaattgtcctgtctgttgagaacatgaacgaaacaaaaaagtggagaaggacaacttgtttcgttctctccttgagctggggcatccatctccttttgcc

SEQ ID NO: 177988 - DNA, 228 bp, Homo sapiens
tcccaaagtgctgggattacaggtgtgagccaccgcgcctggccaatcctgtgtttcttaattaacagcatcatcttctaggtgagagaattaggggctcggagaaaggaagtgcccaaggtcaggcccctggaaactgagaggagcaggatttgaagccatgctggtcccttgagggtggcagaaaatccagacatgtgtcaggagctgaaggtggccttcgtcaag

SEQ ID NO: 177989 - DNA, 224 bp, Homo sapiens
gccacctgacagaaagctgtcagtgcatgcagaagagctccctgtggaaggggcacttggtttggtggaatcctctccagagacatgatttttgtcaaggcttcctttatggtatttactactttcatttaatgtcattccctttccccaaacacacacacacacacacacacacacacacacacacactaaagccttaatagttttgtcctctttgagttttc

SEQ ID NO: 177990 - DNA, 463 bp, Homo sapiens
atctctgagatgccttccctggtttcctagggagaaccaaagtgtgttccatgatctgtgtgtctcctccaccatgcggtgaggccctcgaggggccaacaacatacttatcaccacctccagggcccagcccagcacccagcgctgagcggtcgcttgggatactctggactgtagaactgaggggaaccggcttcagccctggctttaggctccctggaaggggagtttgcatcctgggaagggatgtctggccagtgggcttgttctccagcagctagagctggtgggagcaactgctgaaggttaaggcttctgtggggctggtgacccctgtgatgctggtggctgctgtggagctggctcagcacttagctcagagcccttcactgttttttttttttttgagatggagtctcgttctgtcacccaggctggactgcagtggcgtgatctcagctca

SEQ ID NO: 177991 - DNA, 626 bp, Homo sapiens
accacacttctttctagaatctctaaaactcctgccttttcttagaacatgtatatattagactgtatgtaccataacaccattaaaaaacttacttaaaacaataactaatgcatatcaagtattttatacattccaaacactgttcaaaatattgcatgaaattctcacaacaatttcatgaaatatatgtgggtactaatttttctactcatctttcaattccaatctctctgggcaatgagcccaattgatttgttaagagcttcaaagcaaagaaagacaaggtcataagccacaagcattcaaaaatatggggaaaacaaaacaaaccaaagaagaaaaaagaaatagagaatcctctgtcccacagtcagctctggaaggagtcataattgtatacagttaaattatacttaaaggttatgtcaccaaaaattgtagaaagataacaatagaagtgaactcctctcttagcagtgagttcagatttcagttattcaaaagtttcaggcatatgggccagtgagtttcttacacagtaataagtggtaaatatgataagcctttttactattagcacaattgttgacaaatatttttgaaatagtgaattgacataaggg

SEQ ID NO: 177992 - DNA, 331 bp, Homo sapiens
cctgatagtcttgaaagcgatcctcctacctctgcctcccaaagtgctgggatgcgtgagccaccatgcctggccaagagaaggaatacacttcagagaactacttagctgttcaaattcatgtagctggttggctgcagagcaaggattccagagaactacttagcttgttcaaattcatgtagctggttggctgcagagcaaggattcgacccaagctccactacctttcattagggacgtttggtaaactgtcaagtgctgtacagatgtccatttgtttctcttttctcctaacttcagagaccagaacagaccctttaacaaattg

SEQ ID NO: 177993 - DNA, 273 bp, Homo sapiens
cctgatagtcttgaaagcgatcctcctacctctgcctcccaaagtgctgggatgcgtgagccaccatgcctggccaagagaaggaatacacttcagagaactacttagcttgttcaaattcatgtagctggttggctgcagagcaaggattcgacccaagctccactacctttcattagggacgtttggtaaactgtcaagtgctgtacagatgtccatttgtttctcttttctcctaacttcagagaccagaacagaccctttaacaaattg

SEQ ID NO: 177994 - DNA, 779 bp, Homo sapiens
acctttcagatggtgctgagccttgactgcagtgtattttgtggttctgtggcagtgacgacaggcaggcgagacacctgagaaaccccatattctgttccaggttagtctcctgccagctgtgttttgggccagcgtcggaaagccttagctgcaggctctgcccctgcaagagggaggaagcgacctgacccgagtgccttggtaggaccttgcatgtttcccacaagttctccggtcatctcgtgaggtatttctctcccttcggactgctggaggcttggcattctctgagtccctgtgtgcagtggcctggaggttgccctgtacggcctaccaaccagccagcttcctgggtctgcccaagtgtaggtgaccgggtagccctttaatcagcagaaccttattgagcacctgctgtgtgcctggaactgagtacatggtgctaagcagagtgttgggttggtgcaaaagtcagtgcggtttttgctattaaaagtaacggcaaaagtaactgcactgacttctgcaccgacgttatagattggattccggcccttgaggagaacagcttttttttgggattctcctttggttgtgttttcccacatcctcaatgaggctttctccccacccagaggcctttcatcacccctgagggcagggctcttagattagtgggtcaggaaggtgtgggtcttttggtctgtactgttgacagtgggcaggttgaggtccaccttctgtccttccccaagctcctacaatggatggagtag

SEQ ID NO: 177995 - DNA, 552 bp, Homo sapiens
cctttatgaaggccccagtttttacagtaagtccctcactgcccgcacacaacgatgccaagttccaacctgatttgcgtcaccacagttgtgggtttgcgccaaggttagttatcaagcgtagtgagaggataaattcacaaaatgagggacaaaaataagacgagagctgggtacaacggaagtgaaacctgggtggaggtcatctccaaatcacagtggaaggacgatgtcagggatttgtcccaacactcttttgatgaaagaatttgattagtggactattgcactcttaaaggcaaagaaaacaaagcacggcagtgccccgctcggtcgggattcaaaagcagtgaaagctgccttgctctgtttaaagcgacaggactgctctgctattcaggaaagactaaggaggcagcggtatctgcgaagtcctgcgagctcccggcgacaggagtagcgcgagcagctgacgggggaaatccactggcagcgagtcggatgagtcagcgctgagtcacgctcggcgctacgtgccggcctgggcggccg

SEQ ID NO: 177996 - DNA, 487 bp, Homo sapiens
gcccaacaaagtggatgaacccattgcatgaatttagataagtgagtgaaatggtcaggtaggactcttgggcagcactgtggagaatggatttcagaacaagacgagagacaatgagatcaattcaacagtagtgccgtaattgagatgagaaatgatttgagcctaaatctaggttactattttccccctaaactttcctttggcctccttctaacttgaagagggtaaagaaataaggatataggggaaaagaaaaatttagcacaattctgtggctagtaacactattcactcagatgagggaggcagaggggaaacatttaaaaaaaaaatctattaaagttgatgtttctgttggtgttcaggtagaactatgtaggagtcagatggttatgtgggtttggatcaagagaaggatctaggatgcaggtgaagactgaggggtcattagtctttgaggcctttggaaatgctgcgttcaccc

SEQ ID NO: 177997 - DNA, 188 bp, Homo sapiens
cataatactgcaggagagatctttcacaaaaatctcatcacattcctcactttctcaaaactctttggcttggtttttggcttcctataaccacatacaagacagaaaccttaacacagcatgtaatgctcctttcacaaccccagccccgcgctacagtcacatctctaggtagtaccctccactat

SEQ ID NO: 177998 - DNA, 409 bp, Homo sapiens
gtaaaagatctagttacactacatgtgtgccttcttaataactgtatactattggatttttaaatcgaaaattcatctttaatcctacatcttggttctggacagaaaggtggagatttaaaataacatgtaatcagaaaaatagctaatcaatcctacaaaatgggggagaaaacctcgccaaatttcagttttcacacatttaactaatagtaacaaacaacattagtcgtgacgaatttattacccagatagactttcccaatatatttactttggtacttgagaaaaagtattaagtgcagcattttggggtgagggggtggacacacatcttcaatacgcagtttcaccaaaatgagggagtttcctactcccggcgccttctatatttttacttcttaggcca

SEQ ID NO: 177999 - DNA, 257 bp, Homo sapiens
cgcacttcctacaaggacagtttcacaaaatttatttgagatattactcttcattcatttagccttattgaagtgtgttgaagggactgaccccgtctgcagctcgggctgccttgacgtcagtatatccagttaccctgttgggagtgactagtttataaatgggcatggccagagccaacgggagatgagaagacattcactgggacttctaggaaagacattaggataattggccttccatttggaggaagatg

SEQ ID NO: 178000 - DNA, 176 bp, Homo sapiens
tgacctcaggtgatccgcctgccttggcctctcaaagtgctgggattactggtgtgagccaccatgcccagcttgaaactaacttttgaattaaagtatctaagagctgggaggatgttttttgttgtcatgatttgacaaaccacttgctatactgtaggaagtatgcttattgg

SEQ ID NO: 178001 - DNA, 458 bp, Homo sapiens
gcagggtgcgctgataagatatgtgagtgggagaaaagaggagactggctcatatttccctgcctgagacaatctccagtggctttacgttgcaagaaaaatgaaatccacactcttcactttggcctgcaagatcctatatgctctggctctggcccatgtctctgaacgtgtctcctcccagtttccttcttcacggccatctggccacactgccctttccatgtctctaacacggtaagcattctcctgcctctgagcctttgtcctgttcccctgcctgaacaccgtccatgtggttggctcttcatcactcaggcctcagctcagacacttgctcagatcatcaaataggctggcatccaccccctgtgctgtctgcctggctttcacattctgtagcgtgctcatgatcaccttctaaaaggatctgtggcacattctgtctcctcttacta

SEQ ID NO: 178002 - DNA, 377 bp, Homo sapiens
gcagggtgcgctgataagatatgtgagtgggagaaaagaggagactggctcatatttccctgcctgagacaatctccagtggctttacgttgcaagaaaaatgaaatccacactcttcactttggcctgcaagatcctatatgctctggctctggcccatgtctctgaacgtgtctcctcccagtttccttcttcacggccatctggccacactgcaacctctgcctcccgggttcaagcgattctccttagtagctgggattacaggcgcgcgccatgcctggctaatttttgtatttttagtagagacggggattcaccatgttggtcagtcaggctggtcttgaactcctgacgtcgtgatctgcccgcctcgg

SEQ ID NO: 178003 - DNA, 390 bp, Homo sapiens
aggaaggaaggggtacggaggactggcatctgtttggccccaagaaatcctagattgtcgctaaatggggaagaggctactgctcagagttgctgaggagcggagagcttcgtgattcagaacccacactctggagtcggggacacggctttgactgtggacttgtggacctgtcttagttgctgaaagttaactgagataatgcagtgtcaggtatgtcagggagccgggcctcttcttgggcttcttcagcagggtctgcctgaaccagtctgtgggggagaaacactgctcaggtctgtgtttggagtatgggactccataaggagatgaaaacagcttccccagcctttgataaggacagatagttgtggtggggattgattcatt

SEQ ID NO: 178004 - DNA, 559 bp, Homo sapiens
atgaccctgaaatgtgaccaggctgctcccagcgtggagttttgtgctcagtgtctggcaaagaagcgaaaggctcctttaccctcacacccatcctctagtctggacaactgcaaaactgccataaatcgtatcagtgaatggtacccctaacgggagctgaatggcaggctgtacagacggcacgggggtgctgtggcagtgaaaccaaagcaagaagtactgttgataaagttgagcaaagaagaggaaataccctgtgctgcttcccctcctgtcccttcccgtcccagcctcctctttagaggaacttgagagtccgctactgtcaaggagaggaaagaactgccaccccaaaacgagtttggtaatcctgtggttcttattctcctgcactaggtttccccagcctcagccaggcaacatctcctgtacgctagctagggttacacaaatgcaactactcaaaagcaatttctcaacactcctcggctacctccctggtataagccaccttcatctgtcacctgaataactactatagcctcccaatgtctac

SEQ ID NO: 178005 - DNA, 192 bp, Homo sapiens
tgcgcctgtagtcccagctactcaggaggctgaggcaaggaaaatcgcttgaacccaggagacagaggttgcagtgagccaagatcacaccactgtactccagcctgggtgacagaacgagacttggtctttaaaaaaaaaaaaaatcgttgggaatggaagagaattagcgatagaagagaaatggaaaat

SEQ ID NO: 178006 - DNA, 394 bp, Homo sapiens
ccccaaccttttagtgaggagactattcatttgcaagaagcagagaatagaagaatattgggggatctactattaactaaacttgtgttgaatagaagttactaaaacctggtcagattcacatctgtgattccaggttaagggcctcaggcaaggaagcgaagccccacgtggatcctgaaatactggccttagactcgattccacagcaaaggttgcagccacccagcatctgagctgctgggcaccagggcaagtgatggccagtgacaggaaggagctatgcacgcatatatcctctgttgtgtgcactctttaaaagaagagataaggagaaaaaaatatttaaatgatatcatttaagtttcacaataaaccattgactgaaataaga

SEQ ID NO: 178007 - DNA, 230 bp, Homo sapiens
tcacacattagattttctctagacttctaactgaacaaaatggcaattagcacaaggattttggaatacacttaacagaacatgtgtaaccttggaaaggggaatgtctaatggagggtttgcaattgagtagctgctttaagaaaagaaaaatgggtaatgcgtagttgatgggtttgggtgcattgaggggatttaaaaaggccgaatgatgttaggatgcattttgg

SEQ ID NO: 178008 - DNA, 469 bp, Homo sapiens
agaaaaagaggtttaattggacttacagttccacatggctggggagacctcagaatcatggtgggaggcaaaaggcacttcttacatggtggcggcaagagaaaatgaggaagaggcaaaaggcagaaacccctgataaaaccatcagatctcatgagagttatttactaccacaagagtagcacgggaaagactatgcccccatgattcaattgcctccctgtgggtccctcccacaacacgtgggaattctgggagatacaattcaagttgagatttgaacggagacacagccaaaccatatcagagacctacttgagatttgagggtgtgtggtgcgtcactttccctcggtgaggcgctttacctgtgtttccacactcactgtggcactcctctctggttctccatgtgtcttcctagatgtcaccctccacaggctccagtattcccgtctgtctgcgccaca

SEQ ID NO: 178009 - DNA, 651 bp, Homo sapiens
cacagccagaaggccaaggtatcacactttgagacaatgccctgggcgatttcacaatacagccacctcctcccctcccaaagtcaagcacagcacccacatccccgtgaggcggtggtcctcaaggaggagggtgtctgacctggacagtaaatgcaggaaaactggacccagaccttggcattctcagctctttctgcactgagatttgattctctccatctctccaaggaagaccgggatggcaaaaggagcaaggccaattagccccacctgctatgggtgactgtttctgactcatcccatctgcattcagacttaatgacctagcacataactgcaagtacctgaagggcgaagacgaagtctggttcaaaatcatcttcctagcacctaccacagtacctggcacacaccttgactggactgaattcaaactcctgggcacataagctgaagtctgcacagacagggaggggacattctccaggccctactcttcctgtcagggcaccccctccacaggcacactcagagccaactcgcccctgaacaatgaagccattctccctcctgttccaagagcactgcctcacagacagctccgcagtggggattggaatggcgcccatcctataaactgagacccgc

SEQ ID NO: 178010 - DNA, 502 bp, Homo sapiens
tgaggtgggcacggcgctctgggcttgtcagcaaccgctctgctcccgtccaatagccagggatggcaaacacaggcagaggcaccacggtcttcctccttgcgcccctggcagacatcactaatcaatcacagcaacctttttgcacagagcctggctgccaccttcatggtctccacctacatctccaggctgaagccacacagttcccggagcttgggcccaggaggcagtcgaaggcactggggtgttggccccaagtcccaagaccacaaagaatctggttggtttgccgtcggtcctgagggcagccgctgccacttctggggaaagtgtggtgggggggccaggggtgatgctctgtgcccagcacctgtgcagcagcagcaccttgcaggcacatctcccagtcctgatagagtctgcacgcccacctccccggctcggccactgggcaagcaggaggtgaggagtggacggcccgcccagggaggggcggccg

SEQ ID NO: 178011 - DNA, 149 bp, Homo sapiens
cattatttttttaaaattacagacgtcaaaagagtcacacaatacaaagtttatagagtgaaacatgaaagaatgaccttcatccctgccttaggaggatctctggagcagctttgctcatagtgtctctgactgcagtgacttacgga

SEQ ID NO: 178012 - DNA, 295 bp, Homo sapiens
cttagattaaatgccaccttcttagaaaggtcatctcccccatcagtctaaaagagcccttgggtgttatcacatctcttactttttttcttcacagtatttaccactttatcagatattttcatatatatgtgtaggatgtagaatgtcagctgtatgaaaagagtgaccatatctgtcatgtaactgttatattcccagcatcagaaacagtacctgccgtatggtagatgctcagtcaatatttgtggaatgaatggatgatacataaaatagagtgtaacagtagtgattt

SEQ ID NO: 178013 - DNA, 133 bp, Homo sapiens
ctcaacctctcaaaatttctgggattacaggcgtgagccaccgtgcccggtcccttgcaaatattactaatatagcatcaaggtaattagcaacaaaagaagtcactcaaccagaatgttatccagtatgtta

SEQ ID NO: 178014 - DNA, 653 bp, Homo sapiens
acccataccagggaagagctacagagacatgatacagggtagttccttctgatccagggattgcaaacaacttgtttgtgtaaatcaagttttatcggagcacagccatgcccacctggtgacggattgtctagggctgctttccagctacaaggccagagttgagcagttgtgacagtctggcttacctaaaatattgactccccggccctttatagaaaaagtttgtttactcctgttaatccaaagctatgaccaaaagtgcaaaagcataaagttcttcagcctctacgaagaggacacctactttaaatacacttaccttactttccttcacttatcaaagcgcagttgtctggtgtgggatttcctgactcaacacggacagtgctatactgcatcaaaaacccaatttaggctgcgcttggtggttcacacctgcaatcccagcactttgggaggctgaggcaggaggcttgtttgaaccaaggaggccagcctgggtaacagtgagacctccaattcaatttacagaattaaaccctggccgggggtggtggctcacgcctgtaatcctagcactttgggaggctgagacgggtgggttgcccgagctcaagagttcaagtgcgtggggtaggaggcgtggggta

SEQ ID NO: 178015 - DNA, 423 bp, Homo sapiens
tcccttcacttcctaatccttacaccttaaactgctccttccaccttagatcttcttttcagactttagctcctctttgtcattcttaaatttaaaggctctaatccccaatccatactctgatctctaaatcaacctgtctttctagtctgagtctctcccatttctaccaatcctgttcctgaccaagctcagttcttaacatccagaaaggctcttagaaacactggattcttcccataactgccctccacctgggtgactgagcgagactttatttcaaaattaaaaaaaaaaaaaacaagaaaagaaagaatcatgggattctttatgtatggctaggacagaaataataagagtacaaaggtaaggacattaaggaagggcctaaagactaaaggaagaacatgagcaaatgtccaa

SEQ ID NO: 178016 - DNA, 212 bp, Homo sapiens
tgcaaagtctacacaggccttgacaagtgctagaccataggttagacaaagaagcatgcctgtgcctctgacccagaatgagggtaagttgaatatttctttgacagattgatgaaggcttcatagagctggtatcatctgagtcaagtctggagggaagagaaagatatcgggcagatgtcacagtatatgcaaaggaagggaaggtagaa

SEQ ID NO: 178017 - DNA, 784 bp, Homo sapiens
aaccatctgtcttagtcagtctgagctgctacaacaggacatccacagactgggtggcttataatcaacagaaatgtatttcttgccgttctgaaggttggaaagtccaaaattaaggcactaacagatctggtgtctggtgagggtctgcttcctggctcacagagaactagctatcaacaatccatgttcacattctgtccagccacctgtgcctatctatctaatctgatgtagtctagtctatcatcagcctaaatagtcatcatcctaaacattcctttatttatgttacatacatctactcactatcctcacaactcatttataatacaaaggaatgtctaagttctggtacccaccatacccacctcccctttctaaggaaaatggacacaaacatttctttctgcttaaagtttcaggatcatatcatgtgtattaagtgaaatcagttctatttctctgggcagcaaccctgactggacaaggggcaggttcttggggttcctcaactaaaggcaactgtgtttgtatgtgtataatcttaacatatatacacacacatatatatatagtagcttatgtattacacacatatatgatatattctatagatatagatctgtcagacatatgcgtacatatataacttcaatagcttgccataaaactctgcccaaatgaggttctcagtgagaccaaacattcacactctccaaggaagaaaatgaaggaagagaatgtttatgactggctaagtctgtcaccatccagtacagag

SEQ ID NO: 178018 - DNA, 419 bp, Homo sapiens
agcccagaagaatcacgtttctgatacatgggatacattgtgggttctcccatgactactaggacacacaatgagaaaggcctaggaaggactgaaacctctggagccagctaaccatttacacaaagcccaggagatgagagctggggcagggagtagagcgcaggagggatggggtctctctgatcacattgccaccggggaggatgttttctctgtgcaggtctatttaaagtatctacttcccatacgtttctcatgtgtttcccttactgaagtacagtgtttttgaatatgaattcaaatgttttcttgggcccacaatgaaaggacaagagtttctttagaaaacagccacttaaaactgggatgtacttgaaagtcaggcagtgacaagaagccccatgctctaacttaca

SEQ ID NO: 178019 - DNA, 117 bp, Homo sapiens
aagtgctacaccagaagttcaaatgggagaggatgaatttggccagttttagctgtttttgtagggggtgttgtaggaaaaggagaagcttcacagaacagctggtaagtgaacagc

SEQ ID NO: 178020 - DNA, 527 bp, Homo sapiens
cagtcactctatagcatcaaatcgttgacatggcattcgaggccctttgggatctagatcctgaatcctcatctttatttttttgttttttatttttctcttttagagacagagtcttgctctgtcgtacaggctggagtacagtggcgccatcatagatcaatacagcctccaactcctgggctcaagcagtcctcccacctcgacctcccaaagtcctgggattactgctcctggccttgaatcctcatctttagccctcccccagcaaatacacaatttcccttattgttccctacatacctctgtgccttcgtatctacctctcttccatctgcctggaatattctcccccatccacccctagtaaattcctattcaatcctcaagagctaatgatagcacgctgaaaccttcctgaacctttccctccgccccttagcagacttaagtcacttctctctcgtgcagtggagttgtggaaagggaatggcattaggaaacattcactctgtgtgggggtgtgg

SEQ ID NO: 178021 - DNA, 220 bp, Homo sapiens
agcccatttcttgacaatccagataaggagaaaaataagactcacttccctgccctggaaaagcataagaggccagagaaaacaaagtcaacacgtgttcgggacctaaaaaatgagactaatctttccaaaggagggggggtcatgttggaaagcagtaaaatactgagtttgtaaatgaaaatattactagtgtgaaggatcaacgctcaacctaatg

SEQ ID NO: 178022 - DNA, 322 bp, Homo sapiens
aattttaggaacactgaaaaggcatttcaaacaataaattcattaatttcctaatctttccttctatagatactggttctggttttgtatgtataaataataaataaaatttggtgaatacagagttaaagagtttagaagtatgtggaattcattaaaaagtctctttagggctgggcatggtggctcacacctgtaaccccagcactttgggaggctgaggcgggtggatcatctgaggtcaggagttcgagaccagcctgatcaatatggtgaaaccctgtctctactaaaaatacaaaaaattagccaggcgtggtgg

SEQ ID NO: 178023 - DNA, 310 bp, Homo sapiens
tgcctcactccaccttctcagtgtctctgtttcatctccgtgccagtgttctctgggcttcccttttggggtggaagccccatctctcaccaaaggcaatgagccctatgggaggaagccctgtgtcttcccaccctctgcttcccactcaacttgtggctctctcagccaggcagcctctgagttctctgattatccatcatatcgacaaccgcagcacccctgtttttgtttttgtttttgtttttgtttttttttctttttgaaacagtctcactctgtctcccagactgaagtgcaggaaacaaga

SEQ ID NO: 178024 - DNA, 417 bp, Homo sapiens
ttttgtaatccacgcaagttgtattcgttgagaaccactttgtgcccagaaataaaagttcctacgtacacagatgaacagtgtataagccggatgctattgtagccatgtttgtggtaggaaaataagtagaaaccaataaccactgatatgaaaattacatgaataaattatagtataactaccccatctctcaccaaaggcaatgagccctatgggaggaagccctgtgtcttcccaccctctgcttcccactcaacttgtggctctctcagccaggcagcctctgagttctctgattatccatcatatcgacaaccgcagcacccctgtttttgtttttgtttttgtttttgtttttttttctttttgaaacagtctcactctgtctcccagactgaagtgcaggaaacaaga

SEQ ID NO: 178025 - DNA, 310 bp, Homo sapiens
tcgtctacaggagttaaggtcttttcccctcaaatactagagatagtgagtcagtcattttaaatcttcctataaaataaacagcaggttggcaggtgtggtggctcacgcctgtaatcccaacactttggaggcggagggatggtcacaaggtcaggatcacaaggtcaggagatccagaccatcctggctaacacggtgaaaccccgtctccactaaaaatacaaaaaattagctggacgtggtggtgggcacctgtagtcccagctacttgggaggttgaggcagaagaatggcgtgaacccgggag

SEQ ID NO: 178026 - DNA, 772 bp, Homo sapiens
gctcctcgtaggaattcattcatctgaatacctactacttggcacgtcgaggcattcgatttttttaagtacatgtggactctgggggtaagaagcattccaataaataactcatactctcaaagagcttgcatcatagcgagtagaatctatcacatgaaaacaatagtgttagaaatcaggatttgggctttacaacacattcatgctttcccctttcccaaaatatgcccagtttcctattgtggtcagcaggcagcctataaaaagcagggttactcaccttcagctttctaaatgaacacacagtatcaaatatagtaacagaggaagctttatttttatggagccaaactgattgagatcaagagtaagtgctttaaatatacagacgaactcacagatttaagatgcagattctgaaaagctaaagatccaagatcaatcattcgaacgcccaaatatatcatcagagagactgttgcagcatgcacgcagtgccagaacacaagacaggcgccatgcccagagcctccgaaacgtagagccagggccagggtggtcacggtgccaaagagaaatttcagaagcaacacttttgaaatgcaaaacagaatcagaagcaagcaccagaattctgcaaaaatgcaaaacaagtactaggttgagccctactaaaaatgccaagtaagcagcaggccaatcagagccaagacccactcttaatgcagcagctctaccgcgcatgggccttctgggaacacctgcacga

SEQ ID NO: 178027 - DNA, 129 bp, Homo sapiens
acccaagagccatgtcttccggaaagttcaggctctcagctggttgataagcaactgacactctgaccagcctttcttccaaatccttaggctgctggtttgccaatatgctccagcatttctggtctg

SEQ ID NO: 178028 - DNA, 156 bp, Homo sapiens
atgtgatcatacaatttgcagagatcacattatagatatttatatgaatttaatcctttccctaaaagatcctaagaaaaatattacatattctggggcattcaattttacatagggttatatcaggctttgctctccaagatttgtatgaacttc

SEQ ID NO: 178029 - DNA, 244 bp, Homo sapiens
ggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttagga

SEQ ID NO: 178030 - DNA, 314 bp, Homo sapiens
tagacttgagcttataccctcgataaggggccaaatggaagatcccagcctgcccctcaacaagctgtctcttgcatgcctccctcagcgcacccttcctctctttatgcctgagaccctttgctctctaggcctttgacccttttactccagagactggagcctccatctcctccattcctggggttagtaaccgcagttctccatcattgacctcaacagtttaaaaatgtcacctcacctgtaggtgcctccataatccgctagccatttgttcttttattaagaaacacaggacacagcgctgtccctgt

SEQ ID NO: 178031 - DNA, 460 bp, Homo sapiens
tccttgtggtactgtcgactggaccgactttaggaaactaagtgggactatgttagaaatgggctatagtgaggagaagcaaacacacagaatgtaggaattcacattcacatatatgaaagtaggctttgggccaacagaacattgggtgtgtacttttgagcagagtctccctcccttttataccaatgagttgcacacagattcacacagatacagacacaaagagacacacacttttagtatcatagtgataacttccaaagtacatgtacaaaatatttgactcaaaataaacttgacattttcagcctgagtctcctctcctctgttcttgactcacttgaacacacacacacacacacacacacacacacacacacacatacataccctagtcctaaagctggtatcttatttaatggggaaacactaaaggtactttcagtaagatcagtaa

SEQ ID NO: 178032 - DNA, 315 bp, Homo sapiens
aatggttacagggtatccaaagtactaggaaatagactaatgtatttatgagagaaaggacacagcaggcccctttgctaattagagatttgggagcatgggagtaatatgggagccatgtggaggggtgcgggcagtgatcacgaccccccactcctggaggaaggtgggtagctgccaaccctgacttttgaccagggcttctcaaatgccaggttagctggcaattgccattcttccgcaggctcttcctgaagctgggtgggcccctgcctcactcccctctgcaatccagtcctacctttattgtcctca

SEQ ID NO: 178033 - DNA, 547 bp, Homo sapiens
ccaggtgttctggaaaaattaacatcctaaaggatagtgagaagaaagtaatgtggagaggatgacagggcagagcatgggcaaaaattatcccctttgccctggtagtagaatgggtaagtgtttaatgattgagaactacattctactaaaatatggattccagtgcgatgggaaatatgtatgtcctagatgttggaagtctcttcagggggagaagttgtgtgtcactgcagtagaagtatatccctcatttcgagggttcaagactagcctttggtcctacgagagtaaaatttcagcagctttttcctatggtgaggaagcgtggaaacaggccatttttcaagaaaaaaaaaaagaatggggggttctatccccggtggtctcttaattttttaagggacaggactgcgtgaagctgtggagaccatgagttgggagacatgaggagagttaagtatttaattacagaaaacagcctcctagcctgggcaacctagtgggatcctgtctctacaaataatacaaaaattagctgggttta

SEQ ID NO: 178034 - DNA, 261 bp, Homo sapiens
acaacacttaattccagccataggtggcaaaagatgttatggcagggaatagagaggtttaaatactgatgaaataaagggtcaccatctccttaggcacagggaacagcttactttttgccagatttcttaattccacttgtggccaaggccccttccccgtggccttccattttagctcctcgagtttcttctgctcctctttttgtttctgcttgaaagccttatcttcctcgtccatctccttggcctgcattcttg

SEQ ID NO: 178035 - DNA, 136 bp, Homo sapiens
tttcttacttccacctggtgtgaaagttgttatcgcaaaggcttccattttagctcctcgagtttcttctgctcctctttttgtttctgcttgaaagccttatcttcctcgtccatctccttggcctgcattcttg

SEQ ID NO: 178036 - DNA, 393 bp, Homo sapiens
tacttgatgaacattaaagtagccacatgatgtgccttctataaggatatcatatgctgtacatacagtaccacttgacatataggacactctaaaataaaactgtgggcttgcaaggtatggaactgtacatcttctgtgaagtcatgtactggttacaaaaaagttgcaaaaataccagtttctgtaaatgctgcttcttaaaaatatcaataccaaaactgttcactcaaaaatatctctccatttaaccttgaagtgagaagcagaactggcagcattattcaaggaaaaagggaagatccagatatgattttaccagagtcaagaacttggaagacatgaaagaataaaataagtctgctcaagtacataataagcttggtcttgtgg

SEQ ID NO: 178037 - DNA, 697 bp, Homo sapiens
actctttttttttaagtccttgtcctttattggttaaggctgagggaagcagacagaccagttggacatagtagatgggtgtgtgaggtcaaagtgctacctgaaagccagccaacccacactcccctgagatgaatgctaatgcccttcaaactgtgggcattggtttcacacacagcctcttccagggataaaagagggggttcttgtaaagcctcttcttttttcttttttttttgagacggagtctcgttctgtcacccaggctgaagtgcagtggccagatcttggctcgctgcaacctctgcctcccagattctcctgcctcagcctcctgagtggctgggactgcaggtgcccaccaccatgcccggctaattttgggctttttggtggacatggggtttcgccagtgttggccaggctgatctcgaactcctggcctcaagtgatttgcccgcctgggcctcccaaagtgataggcttgagccaccgccacccggcagcttcttgttttcttacctctaccatggagacaagttctggttttcttaggacaactagctctggtcataaagatctctggagtgatcaagtatggtggagtggcagagtgagtgttccaaaaggataagtagaacaggagtcttgcccaggccctattacaacctcagtaccttgaatggcctccccagcc

SEQ ID NO: 178038 - DNA, 294 bp, Homo sapiens
atcacaagattaggagttcgagactagcctggccaacatggtgaaaccccatctctgctaaaaatacaaaaattagccaggtgtggtggtgggtgcctgtaatccagctactcgggaggcttagtgagctgagatcgcaccactgcactccagccttggtgacagggcgagactctgtctcagaaaaataaataaataaagtttatgttttttcaaagagcgtgacctttggagtcaagcagaatgcattgggccatgcccccatcagccatactagccctgtgatcttgagca

SEQ ID NO: 178039 - DNA, 666 bp, Homo sapiens
aaaatggtgctgtccagtggcaccaccatgtatctgggaattgccgacaggatgcagaaggagatcaccgccctggcacccagcaccatgaagatcaagatcatcgcacccccagagcgcaagtactcggtgtggatcggtggctccatcctggcctcactgtccaccttccagcagatgtggattagcaagcaggagtacgatgagtcgggcccctccatcgtccaccgcaaatgcttctaaatggactgtgaacagatgtgtagcatttgctgcatgggttaattcagaagtataaatttgcccttggcaaatgcatacacctcatgctaccctcacaaaactggaatagccttcacaaagaaattgtccttgaaggttgtgtctgatataagcactggattgtagaacttgttgctgattttgaccttgtattgaagttaactgttccccttggtatttgtttaataccctgtacatatctttgagttcaaccctttagtaacgtgtggcttggtcacttcgtggctaaggtaagaacgtgcttgtggaagacaagtctgtggcttggtgagtctgtgtggccagcagcctctgatctgtgcagggtattaatgtgtcaggggaacagtaacttctatacaggtcaaatcagccacagtctac

SEQ ID NO: 178040 - DNA, 800 bp, Homo sapiens
aaaatggtgctgtccagtggcaccaccatgtatctgggaattgccgacaggatgcagaaggagatcaccgccctggcacccagcaccatgaagatcaagatcatcgcacccccagagcgcaagtactcggtgtggatcggtggctccatcctggcctcactgtccaccttccagcagatgtggattagcaagcaggagtacgatgagtcgggcccctccatcgtccaccgcaaatgcttctaaatggactgtgaacagatgtgtagcatttgctgcatgggttaattcagaagtataaatttgcccttggcaaatgcatacacctcatgctaccctcacaaaactggaatagccttcacaaagaaattgtccttgaaggttgtgtctgatataagcactggattgtagaacttgttgctgattttgaccttgtattgaagttaactgttccccttggtatttgtttaataccctgtacatatctttgagttcaaccctttagtaacgtgtggcttggtcacttcgtggctaaggtaagaacgtgcttgtggaagacaagtctgtggcttggtgagtctgtgtggccagcagcctctgatccgccagcaggttttactagtacgattgagtgttactgggatttctctagtggctagcaagaaccatttagttttgtaggacgggtctgtcaggactggcaagtccaagccgtaggacatagtttcatgtataagttgatgtgtgtggacagaaacacgcgtgggaatgtacttgcatgtgagttggaagcggtttgcagt

SEQ ID NO: 178041 - DNA, 994 bp, Homo sapiens
aaaatggtgctgtccagtggcaccaccatgtatctgggaattgccgacaggatgcagaaggagatcaccgccctggcacccagcaccatgaagatcaagatcatcgcacccccagagcgcaagtactcggtgtggatcggtggctccatcctggcctcactgtccaccttccagcagatgtggattagcaagcaggagtacgatgagtcgggcccctccatcgtccaccgcaaatgcttctaaatggactgtgaacagatgtgtagcatttgctgcatgggttaattcagaagtataaatttgcccttggcaaatgcatacacctcatgctaccctcacaaaactggaatagccttcacaaagaaattgtccttgaaggttgtgtctgatataagcactggattgtagaacttgttgctgattttgaccttgtattgaagttaactgttccccttggtatttgtttaataccctgtacatatctttgagttcaaccctttagtaacgtgtggcttggtcacttcgtggctaaggtaagaacgtgcttgtggaagacaagtctgtggcttggtgagtctgtgtggccagcagcctctgatctgtgcagggtattaatgtgtcagggccgagtgttctggaatttctctagaggctcgcatgggctcctgaaccaattgtttctgtcctgctggtctgtctgtcagggttggaaaagtccaagccataggacccagttttctttcttagctgatgttttcctgctagaacaccatggactgttacttgccttgagttggaagtagtttgcatttatacctgtaaatatatttatccttttaatttatgtaaggttttttttttgtatgcaattctggattctttaaagagatgacaatgaattttggttttctactgttatgtgagaacatcagtccccagcaacacgtcattgtgtaagtagaaataaaagcgctgctgttaaaaaaaaaagaga

SEQ ID NO: 178042 - DNA, 637 bp, Homo sapiens
aaaatggtgctgtccagtggcaccaccatgtatctgggaattgccgacaggatgcagaaggagatcaccgccctggcacccagcaccatgaagatcaagatcatcgcacccccagagcgcaagtactcggtgtggatcggtggctccatcctggcctcactgtccaccttccagcagatgtggattagcaagcaggagtacgatgagtcgggcccctccatcgtccaccgcaaatgcttctaaatggactgtgaacagatgtgtagcatttgctgcatgggttaattcagaagtataaatttgcccttggcaaatgcatacacctcatgctaccctcacaaaactggaatagccttcacaaagaaattgtccttgaaggttgtgtctgatataagcactggattgtagaacttgttgctgattttgaccttgtattgaagttaactgttccccttggtatttgtttaataccctgtacatatctttgagttcaaccctttagtaacgtgtggcttggtcacttcgtggctaaggtaagaacgtgcttgtggaagacaagtctgtggcttggtgagtctgtgtggccagcagcctctgatcacaggaaggttgctagatacaggaaggttgctccggg

SEQ ID NO: 178043 - DNA, 427 bp, Homo sapiens
agtgtcttcccacggtcctcaagaaagtccaactcctttataggtctccaagttttccaccaccaacctctccagacttgtttcctcaagagatattgtactctaggactggccataccaaactttccattccaggaactcaacctgggtttttttacctcctcacctctggaaagactattcttaaaattccctatttctggatgctcttcctttcattctctccccacttattgggtcacttctgggcatcctttaggtttcagctttgatgttacttcttcctgtgcagcctgccctcactcaccaagactgaggttggcactctcttccctgtggattccacagcccctgtgctcaccctgaatgtgctacttgtcactcatataaaaatcatctccctccatgtaacttcatggtaacctcg

SEQ ID NO: 178044 - DNA, 460 bp, Homo sapiens
tacatttcttcaattagttgtatatactcttgtcaaccacgtagcaaagttgaaaacaatggcaaggagtcagccaaaaaattctacattatcatcaggaaagcattttgaaacataggttatatccattgtcatcaatgtcaactcactctaagtgcatattctaactcaagatttgaagttgatgatagtattcaggaaacacgtacgatttgattactcatgctcaaagccatgtgttattgaaccagccactttacaaaatttaattaaacttaatgatgaaaattaaaagtctctctgaaagatcttatcaaagagcaaaagacaaaagccacttactattgggggaaatgtgttccttataatatgcaagcttattttcccatcattttgatcaaaacagaagaaaaaatatatgaaaacgtataataacaagcttaataaataaaacatgcaa

SEQ ID NO: 178045 - DNA, 446 bp, Homo sapiens
tttctatacattttacttgcctcctggggatgatgggagcatatgccaggctgagatgggtggcaacctacattttaattctttaaattgctaactccacccttgagcctacaacaagtaggtctgcactgcagaaagaaatcacgtcgccatggggtcgctgcgagtagttccttactgggtgggatgtggaaggggagcgctgagggacagcattgggtggaagcaagatagcaacagctgcagggagcagcagcgggactggggcgaaggctgtgctctggtgagctccgtgtaacacaggagggctgacgctggcccagataggctggcgcttgccagaaaagggcattagcaggaagacccaggagcagattttcaacacgggttgcacagtgtaattaactggagatagtttaaatatccagattttcagaccacaccca

SEQ ID NO: 178046 - DNA, 418 bp, Homo sapiens
acctaacatgactctgaccatgattctaactttgactattgacttacagaaaatacaccatgaagatactgtcaacaaaatccaaaaccagaaattctatgacaaccaagtttttctcctcttgcatcttcatgtgaaaaaagagagatgagggagaacctatagattaaagaaatgtaatacttttacaaattgcaagatgtgaactttatttagatttcaattcaaacaaaatgtagagagttaggtctacctggccaggtagacctaacccagagacaggaaagaatttgccttctccctgggaactggttcaagagacactgcttgggttcctttttcaacttggaaaaagaaagaaacactcaacaataaagactgagacccgttcgcccccatgtgacttttatctgtagca

SEQ ID NO: 178047 - DNA, 242 bp, Homo sapiens
ggcaggcagtccacaggtaagggtagaaaatagactgtcatggtgggaagtgccaagagtgctgaagaggaatcaggataagggcttagagagcaatgggggttgcagacagggacagcttttctgaggatgcatctttcagtaaagacctaaatcctgtcaagaccaagaggccatggaggctgagtgatccagcgtagggaagagcaggagtgtgctctgctggagctaggggtgggagt

SEQ ID NO: 178048 - DNA, 338 bp, Homo sapiens
aacctgcttggcacacatcttccccacctaagtcaagggctacattctcctacttggtgcagcccggaaatcactaagtctttctttcatctctcttttatattaccaattcatcagtgaccccaatggctctacttttcagacatacagagccggtggtgaggcatggtggctcattgctgtaatcccagaagtttgggaggccatgacaagaagatggcttcagctcaggaatttcagaccagcctggacaacacagcaaaacctcctctctattaaaaaaaaaaaagatagccaggcatggcggtgcatgcctatggtcccaactatttgggagg

SEQ ID NO: 178049 - DNA, 504 bp, Homo sapiens
tttttattttaaaagattcttcgaacactaaacattttgctgacattgccttgttcatactgcaatgcttatcattagaactgcaaatgacagacagctacctggttttaaaagcccccaatatgacacagggtagactgagaaacttttcccctcatttctaatccttcctttaggtcacaatgctatgggacttgaattcttcttgaaaaagctttgctttcggctgggattcttataaaaatgatgaactgcagagaaatacgaagggaaagagatcctaaggtcttatgttggagttcagaaacaatcttataaacacaattgtatttaaatttctaatagcacaaagtatggatgtaccaaattaattttaaaagctacagctggttgtcacaggccacctatgtcacctaaaagctgtgataaggcaaaactgaaataatttcaaaaggaaaacaacaaatctcatttggtcttaaaagtttatttcatgaacatata

SEQ ID NO: 178050 - DNA, 268 bp, Homo sapiens
cttggtaagcaggaggagcagaaagaagccagtgcagccaaagcatgctgggtacaggcatgtatggtatgagatgaaacaaaatgcaggatcaaatatttattctgaagtgatgtgggatcagaatagccctatagtcacatgagtttgggatcatcagtttcttccaggatctggtttgcttcctagtcttctcaggttactacctgaccccctgagtcctcccttgcctccaggtgcaaggttttcaacgtcctctggcttcatg

SEQ ID NO: 178051 - DNA, 352 bp, Homo sapiens
gttgatagcatcaatgtagtcactcaagccagaaattctaaatgccatcaattacccttctcctcctgcccctcaccgattaccaggtgtttttgatcatcttctaaatatgactcaaatccatcccttcctttcatcttctataccagggcctaaatttagtcttgcataaactctcatccggattattcgggaactggtctctacatttctagccactttgtaaaatccttacactacactgtaagatatttcctcctaaaaagtgtttctctagtccgggcacagtgtactcacaccctaaaatcccagcactttgggaggcagaggtggatggattgcttgagcctcc

SEQ ID NO: 178052 - DNA, 402 bp, Homo sapiens
gaggatccccaccgtcatataagcggtagccagatgcagtggcttatacctgtatttccatcactttggaaggccgaggcgggtggagcacccaaggtcaggagcttgagaccagcctggcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgggtgacagagtgagactgtctcaaaaacaaaacaaaacaaatgaatgtaaaacatttagtgaagtgactggtagctagtgagggttcattaagcgcttatatgacgtttattgtgggcc

SEQ ID NO: 178053 - DNA, 338 bp, Homo sapiens
cactcatccactattcattcatctcatcatttcatctcaccatttcatttcatcatctcatctcatcatttcatttcatcattcatctcatcatctcatcattcatctcatcatttcatatcatcattttatctcatctatcatttcatctcatttcatctcatctcattccatcattacatctcatttcatcgcgattagggttagtactaaccctaatcgcagagatgggggactacaggcccacgctgccacacccagcgtgtgtgtgtgtgtgtgttttagtagagacgggggactacaggcacacgccgccacacccagcttgtgtgtgtgtg

SEQ ID NO: 178054 - DNA, 331 bp, Homo sapiens
cccctggtggaagttttccctttgggagaccaggacctctaaccctgaagagcttagagctgtaatgatgtggcggtaaatgcggccacttcagttttcacccttggttcccaaacccatgtattttttcctgtcggggtttgttttctatcgctgctggaaccaattaaagactgggatacgttctaagaaatgcttcattaggtgatttcttcatgtgagcgtcatagagtgcacttacacagcctagatggcactaggtactactaaatgcctgggctatatggtatagccttttgctcctaggctacaaacctgtacagcatgttac

SEQ ID NO: 178055 - DNA, 161 bp, Homo sapiens
aggtaaaagtgctagggtgtccacactcctggcaagagccctagaaaacagggtaaacagtccaaagaggggggtctagtcagactgggctctggtagggacttgcaaagctaggtgtggcgcctccgctttgtaaccaagaacccccagttccttgtaat

SEQ ID NO: 178056 - DNA, 815 bp, Homo sapiens
acagaggccccacagttctatgagtttatcaagcagcagaatatttgctccatcagccagaatctgttatcaggcttcttagagcagctatcattatttcatttttcttactcagaccaatctgagaatgaacaccctagtacattataacaacataagcattagctaaatacatcactggatctttgaaaccttaggcatatttatatacaaaaacaacaaataagaataataataataatggacttaagccttttgttagcatttgtaatatgtccactgaatgcagacatgaacagagcctctttcctttccatctagcttttgaggctttggggaagaagggctgagacgccaagtggcagttgagaaacccccaggagagaccactatgttagacagtcaccccaagagtattgcaaatggggacatcctctgggaggtgagggattcgtgggaatagtgaacggtacccaggagtcacatcccgtatctcttcaactccatcttgtcgtgcataccattccctcctggagttgcccaacactgagaatcccataccgaaaattttatggctgcctaatatctttaaggcacgacaattttgataattccctactttacaagtcccatcttctcaaggccaagccagaaaacttaaaaccctagactcccttgcaactaggtacaagcagataaaatgggtcccatgaatctgatgaagcctcaccagcacttggattctaaaaagcagcagtttaatttaggggactcaatcttttgccatccacgatgacaagctatgtagttgttta

SEQ ID NO: 178057 - DNA, 456 bp, Homo sapiens
agctagaggatccccttttaaaaaataaaagaaatgttatcacttcatgagctttgtatgtaacaatgaatgagatgtgaatgttgaatagttggcagggttcactcaataccaaagagattctcacgagccttatgtgcttatgattcagatttgtcctaaggcaaaaccacaaatttgattataccactcccccactccccatagaactattattaatatttcatggaccttagaacgtggtttgaggagcactggtatgggatatgagcctccaaatgaagccagatcctagaaagaaggcatagtaaccagagccctggactgtgtgtttgttagtcctggggctcagtttcaagttgagcaagtgtgttgtgtgcacgtatacatgtgtgtttatgtattttgtttttataatgtttctatgcaacatgctttaaaaaggaatgacatcct

SEQ ID NO: 178058 - DNA, 726 bp, Homo sapiens
agcgagagagggagcgtggagagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccacca

SEQ ID NO: 178059 - DNA, 425 bp, Homo sapiens
aacggaattttacagttgtttcaagttactattaaattcttactgtgttccttctatgtaaaatgaagacattgttctagttattaaagcaacatgaaagtggacattctaaaatccaagtgtcaaagaagggaggacttacataatgcgatgcaaagggaaaggctaggacaggtgggggcctgcttggctgttgccctaagtgctccattctctcccttcttgtgtccacttatatataagacacccaggcatccatgagtaggcctggtacacaatcctgtcgaagaggctgacttgcctgccacatggcctctgtcctggggacagtgctaagcagcccactctttatttccggctgtgctttattattaaggcagcatttcgttacagtggaaacagcaaagggcaagtggactctgatt

SEQ ID NO: 178060 - DNA, 470 bp, Homo sapiens
ttcattttttttcagacttttgactaattagacaacatgagagaaatgtaaggtaaaagataaatcatcctggtcatttttccacttcctcaacctcatcattttcccctataaataaggtgattctgattggcacaacaatgctcaagatgtaaagctgcagaacagaaaattacacacagtaggatgaagaaattaatttcacggcagtaatggttttctagcttcactaataaaatccctttagcccaagatctctttacgaagaaccatgtatgtagcaaatgctttatgagaaaaacatgtcagaaacatcaccggatatgctcagcccatcttctaaatatatgcatgtatgcattcgccaaatatcatcatgtgcaatctataaatgactggttatctatattttacaaatcttctaactcctaatccactgaactgcttatgctgggtggtgttgggattta

SEQ ID NO: 178061 - DNA, 515 bp, Homo sapiens
tcaggctggaggcttttgcatttggtttggcgaggagagacagcaggatttctgggtgccggacatgcttctcggtcagagctggtgcgtttctttgcagggcaaggtggaggcggggatgccagggaggcatctgctgcatttcttgaggtttcacagggtgcagagcccctgtcctcactgttctgtggggtgctaagggagcaagccatgtggtccctgaactttgagtagatacaggtaatatttgaaaatatttgggaatgtttacacaatcacaaaaacaatgaacacttgtgtagccactactcaggccaagaaatggaacttaactttgaaattccctttgcccctcccaatcccagcttccagctcccgatcctctccccttcctgcaaaaatgtgtttatcagataaacctgaagcatttgagggagtccctgtcctgaatttcgcagttgtcattctctgctgttttttagttttatcacatggggttgtgtttctaagcaaca

SEQ ID NO: 178062 - DNA, 361 bp, Homo sapiens
tatagactgaatggaatttgccaaaatttatatttgcactgtctgctgaataggcagattgctgagtaaagtccagtttgtatttgaacacaataccaattatcttttgtgttttctgtagttttattaagctcttaatagaaatcaagaaaatgatttgaaacctcctttttcaaatcaaagtacctaacagctagggacaatattttttgttgctatgatttgacacatcacttaatgtacggtagaaagtatgatcagtggtaagatctgacagaatcagctctacacgccagggggctaacacagcagtttccccctcttttgcccacaggactttttagttgcaacttctataatc

SEQ ID NO: 178063 - DNA, 242 bp, Homo sapiens
ctttgaaattagatagacttctgtttgaatcttaactctaccacttactcatttcagcaccctaggtctagcacttaacctctctgagtctcaatttcctatctattaaacatgaggagaataatagctactttgtagggttgcagtgagggttaaagaaaatcataaataaattgccttgtatatagtagatactaaatcatcgtcattctagttgttattaacaggtaaggtatgccttc

SEQ ID NO: 178064 - DNA, 776 bp, Homo sapiens
gaagagctaagtgggcagacactatcccagcctgttagggctgctatagccaaactgaaagcgggcgtgttatgaacaacagcaatgaattcctcacagttctgctggctgggagtcctgcgtcagcgcactggcagactcggtgtctcgggagggcctgcttcccatttgtagacggccgtcagctctcgaggggcctctgttatgagagcactgattccattcacactggctctgcccctgtgacctcatcacctcccacaggccctgccttcagttaccgtcacctgagggctgaggattttgacaggaatttgggaggacataaacattcaggccttagcaaatgtgttttattttccaactatcatcaattttaaaaaatcagaatcgtgcttggtgtaatcacattatatagaattacatgttcaaagttatatatgttttttggaaatcacattctaattggttggttggttggtgtatttatttatttatttttgaggcagagtctcgctctgtggcccaggctggagtgcagtgacatgaacatagctcactctaggcccaacctcctgggctcaagcgatcctcccacctcagtctcctgagttgttgggatgttgggactgcaggtgtgccccaccacgcccagctaatttttaattttttttgtagagaccgggtgttgccatgttgcccagactggtctccaaactcctgggctcaagcggtccttccaccttagcctcccaaagggctggtattacgggtgt

SEQ ID NO: 178065 - DNA, 195 bp, Homo sapiens
cagatgcgagtaaagctgctttcactgcttctccgagttcatgctttctggccaaccgtaataaagggagcatggtttccagcgacgctgtgaagaatgaaagccacgtggagacaacctatctccctctgccatccagtcaacctggaggcctaggccctgctctgcaccagttccctgctgggaacacagaca

SEQ ID NO: 178066 - DNA, 551 bp, Homo sapiens
ggccaaggcgggcagatcacttgaggtcaggagttcgggactagcctgggcaacatggtgaaaccctgtctgtactaaaaataccaaaattagctggacgtggtggtacatgcctgtaatcccagccatttgggaggctgaggcggagggatggcttgagcccaggacgtggagtttgcagtaaaccaggatcaccccactgctctccatcctgggcaacagagcaagatcctgtctcaaaaacacacacacacacacacacacattatttgtagtggctcccttaggcactgccagcactgaacaataactcccacaaaattatccacagtggtttccctgaacagtgtctacactgacatcagcacacaacagcctgggtcacagagcgagactccgtctcaaaaaacacaaaaaacaccaacacacagacaaacaaaaaaacacactagtactgagaagttaggtgtctttgtgtcaatcacagactctttgtcaagtgtgcatttaaatcacttatcgttatgagttaactaagccaaatgtgtatc

SEQ ID NO: 178067 - DNA, 306 bp, Homo sapiens
ttatgagggtttacatgttttttttattgtttttaaagttgtttcatgtgggatggtaattcagtctctgtttctctatcttggctggaagtacaagtggctctaggtagttcttttaaataggtcctgaactggacagatttttaagtgaaggaaaaggccttttaaaatttcttgttcatgtccctgggggtaccaaaacattgatgaattgtatccctttctttaggaaagcagaggatcctatcctataatgaagaggtaggtcataatccttcctggaagaaacttaaccaaatgactggg

SEQ ID NO: 178068 - DNA, 263 bp, Homo sapiens
aggtcattcctacactaagatcctaaaagtctgttaacaagaagcaggacttttgacttctcctccaatactcatctcacaccttcctatctgcaatgattgaaaccctatgcatttatctgggcccagcagaaatcctgtccccttgaaaatctttctactcccactgaattcctcaacagaatataactcttctctattaactcttaaagcacttttggcctttatcatagcagtttattgatcatgctctgccctaaatt

SEQ ID NO: 178069 - DNA, 286 bp, Homo sapiens
ggagcagatgcccgcccacggtagatttggtactgaaaggttaagaggtttcccaagtgatgggcactgaggggcaaggtcctgctaagaataagcggggaagagatttaaggaaagtagagatttgaaatcgttcttgagacaaatgggacagcaagttgaccagagaaatacagtaggactctccttggcagtgtggaaggtgcaggtgagtctggtgggttgatgttgatacctatctgctctgtcatgggattttctccagcagtttggggaccaaggtgca

SEQ ID NO: 178070 - DNA, 405 bp, Homo sapiens
gtccagcagatggcagatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagct

SEQ ID NO: 178071 - DNA, 625 bp, Homo sapiens
gggaactgagccaacttggtacttggcagcagcccttctcaaggctgatgggaggttctgtaatcctctttgcaagctttgtcaccaggtcacacttttggcagccaatcaatagatttatctcattaaactggcagaagagtgtttcaatgcatgctccaacagctacctggaaatagcaattgtgagagatgctaaggtaaggatattccagttcctataaccgtctgattttttgtccttgtgaattttcaatctgctgttttactgggatagctaagttccaggtttattttctcaggtaggctcacccacgacctctgtcctgtggtttgcattcctgaacatctgttagtctttcaaatgcaaggcacaaaactaacctcaagagtgtggctagatctgggagtgaacacagggcctgtccctcacagacgagaggtcaggagcacctttgtttcccaaggcaggttcttgattgatttaccttcatgcgttgatgtctttgctatgtgtgtaaaatgcatgtgttgctgaatcacatgtgaagctctacatgctggggtttatactgtgtttggcatgttgtgggagctcaataaatactaaatcagttgcacagtct

SEQ ID NO: 178072 - DNA, 440 bp, Homo sapiens
tcaacagcacatgtgaaaccacttcctcttcttagcacttggcacatggtatctttggtaatttattaccacatatgtttactgttgcagtctggggggtcactaagaccactcttgggtttaattttttgctaggactcaaataactcaaaaaaatccttacactcatgagtgtttatcaaagtgaaaggatacagattaaaatcaacaaagaaagaagatgcacgaggtagagtccaacagagaccaggcatgagcttccaggtgtgctctcccaggacagtcacacagacaatgcttactcctctcagctgagtcttggtatctgaggattttaccgcggctcagtcgcgaacatggttggctagctgtgtggctggccttaggctccagcccctccagaagtcaaacccatgctatgtagcccaaggccaccacca

SEQ ID NO: 178073 - DNA, 264 bp, Homo sapiens
gtacatgtaacattttgttaagtatatatgagaagtcatcaagtcagggtatttagtgtgttcatctcctgagtacaatacattttgtttactatagtcaccctactctgctatcaaacattgaatgtattccttctaattgtatgtttgtatcctttaacccacttctcttcatccttacctcttaaaaactaaagatttttaccatttttgttttttgagacagagtcttgctctgttgcccaggcttgagtgcagtggcac

SEQ ID NO: 178074 - DNA, 1465 bp, Homo sapiens
agctgcgctggccgctcgcggagggagaggctgcagagcgagggcaggaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctactgctccaatggcaatctctcctccatcaccagccacttgcaggaccccaaccacctgactctggactgggtggccaatgtggagggcctgccagaggaggagtacaccaagcagaacctcaagaggctctgggtggtgcccgccaacaagcagatcaacagcttccaggtcttcgtggaagaggtactgaaaatcgctctgagcgatggcttctgcatcgattcttctcacccacatgctctggattttatgaacaataagattattcgattaatacggtacaggtaaaaggaccccaacaacactggagatggggagtcccaggaagctcatgtcagccaggtcttggagggcatctcgccagtggtgcgaggcaggggactatactaatctgtattaattgtgtagcaggacttgattccccccatgatgaagtccaccttttggaatccagtgtcctctgaacagaaccaccttttttcttgccattttgagctgcagacaggcggtttattatgacaagtgaagagtcagctgatgtgtactaaaggaggccataggaggattttccagccaggacaaaagagcagcagttttctcctgggctccatctctctgtaccgctagccagtgccgcatttatccatctgtaagaaggccctggtggagaggatgggatgagaacaagaggctacctccagttaaccaggacataaagtccccagcggttcctgtcacacctgctcctccctccccagggtgcatccgtgatcgtggatgtttgcccaggggtgaccatgtttggctggcttggaatgctgtgcattctcagagctctgttagtgtcccctcttgggggtcagagatgaggtgtggcagggtctagaggaa

SEQ ID NO: 178075 - DNA, 1463 bp, Homo sapiens
tgacagcaaagcgacagcaccaggagccaagagcatcttcatggcaaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctactgctccaatggcaatctctcctccatcaccagccacttgcaggaccccaaccacctgactctggactgggtggccaatgtggagggcctgccagaggaggagtacaccaagcagaacctcaagaggctctgggtggtgcccgccaacaagcagatcaacagcttccaggtcttcgtggaagaggtactgaaaatcgctctgagcgatggcttctgcatcgattcttctcacccacatgctctggattttatgaacaataagattattcgattaatacggtacaggtaaaaggaccccaacaacactggagatggggagtcccaggaagctcatgtcagccaggtcttggagggcatctcgccagtggtgcgaggcaggggactatactaatctgtattaattgtgtagcaggacttgattccccccatgatgaagtccaccttttggaatccagtgtcctctgaacagaaccaccttttttcttgccattttgagctgcagacaggcggtttattatgacaagtgaagagtcagctgatgtgtactaaaggaggccataggaggattttccagccaggacaaaagagcagcagttttctcctgggctccatctctctgtaccgctagccagtgccgcatttatccatctgtaagaaggccctggtggagaggatgggatgagaacaagaggctacctccagttaaccaggacataaagtccccagcggttcctgtcacacctgctcctccctccccagggtgcatccgtgatcgtggatgtttgcccaggggtgaccatgtttggctggcttggaatgctgtgcattctcagagctctgttagtgtcccctcttgggggtcagagatgaggtgtggcagggtctagaggaa

SEQ ID NO: 178076 - DNA, 356 bp, Homo sapiens
cactgaatggccaaagccctgggtgggacagtatgtgctgtctagccaggtcatcctccctctcctcctctgctattctattggccccagcctgcctatcctcaagtttcttatgttggaaaaacaagtccctcttccttgaagccattgtagttgggaacacttgcagcggaatgttttcctaactgcttagacccatttataggcttaagatagggcaacatattaaatggcactattgttgaaggatccaaaatagaattccataaccaattcctttgttatatgctgactttcaattttgagtgataccacattcatgtaccttcctttatatgtgaagatacctggtcaca

SEQ ID NO: 178077 - DNA, 694 bp, Homo sapiens
ggggctttgggtttgtctcacatgccactgcggagaaggtggatgcagccatgaatgcaaggccacaaaaggtggatggaagagttgtggaaccaaagagagctgtctcaagagaagattctcaaagaccaggtgcccacttaactgtgaaaaagatatttgttggtggcattaaagaagacactgaagaacatcacctaagagattattttgaacagtatggaaaaaatgaagtgattgaaatcatgactgaggcagtggcaagaaaagaggctttgcctttgtaacctttgacaatcataactccatggataaaactgtcattcagaaatagcatactgtgaatggccacaactgtgaagttaggaaagccctgtcagaccaagagatggctagggcttcatccagccaaagaggtcaaagtagttctggaaactttggtggtggtcatggaggtggtttcagtgggaatgacaactttggtcacggaggaaacttcagtggtcatgatggctttggtggcagctgtggtggtgatggatatggtggcagtggggatggctataatgggtttggtaatgatggtggttatggaggaggtggccctggttactccggaggaagcagaggctatggaagtgttggacagggttatggaagccagggcagtggctatggtgggagtggcagctat

SEQ ID NO: 178078 - DNA, 326 bp, Homo sapiens
actaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgt

SEQ ID NO: 178079 - DNA, 428 bp, Homo sapiens
ggctgctcactgcaggcaggactggaaatggcaggaaataacagataagaagtaaaggatagcacttggtagacagcccagtggctccagggacacatgtgcttctcagaggccaaggaaggactggttcagtccttgctgctagcagcacctgccagcatgtggattgcagtcccatgtgcctggatgcagaccctgcaactttttagttttgatattcattgttacctctgggcaggaatgagcatggtgaactgaataatagagatgagactggattacgctggttttgatctgtttcaggacaggaattgtttgactttgtggttgctaaaagaaaggcaattctccaaactaagaccatactttattcctgagtttagaattaactgattaaaatcctgagacttatgtttattgtagcacta

SEQ ID NO: 178080 - DNA, 533 bp, Homo sapiens
tatttagtacctttaaactagggcattattagcatatcagtatgagttaatatctcgaaggattaggaaataaatatattccttaagtgtttcaaaaacacaatgaacgacagttaagtagttagaaatagactgacacatggactttttgagctccaagtattaccatgtagatacaagcttggtaaaatcctagcctatgaagtatccatttctttttaaccaatcttttctctttcttcagattcagtttccacatctttctactgaggaaaatctgtgaatacctcttaacactacttttcatttccttttttctcctcaaatatccaatgagtaaagtagctgaaaaactccaatgattctcaatttattgctaacacaaagcaattacttttgcattcactgactgttttcatgtgggcacttgcgtgtgtccgtgtgtttaggagaaacagagagcggttcttttaggttttactttttttctgaaacttcaacctagccaggccttgacaaacgcagacaatatg

SEQ ID NO: 178081 - DNA, 460 bp, Homo sapiens
ttgagatatgatttacatatacaaaattcagctctttaagtgtacaataattttagtaaattgagttgtacaattttagaatatttttgtcacctcagtaaatctattatgctaatttataattaatccccttccccactcccaggcactactaatctttctgtctctgtagatttgtattttctggatgctttatagaaatggaatcatatagtatacagacctctgtgcctagcatattcttttttatttttattttttgagacagtgtctcactctgtcactcagagtggagtgcagtggcacagtcactccagcctcaatcttcctgggctcaggtaatcctcccacctgagtagctgggactgtaggcatgcaccaccatgcccagctaaagcatattctttaaaacaatattcagttactttgtcaacactaaataatttaccctctcccatct

SEQ ID NO: 178082 - DNA, 310 bp, Homo sapiens
gccttcaatattctatgacattttactcctgctttagctttcacttcctgcttgctttgggactcaggatcagctagaggtaagagattagggccttctctggtcttttatgagcatgcatacagccctgtacatgcatgtggactgctagattccctggagtatattaaagctgttcaaaactcccagtggggtttcattctactgcttttccttctcagttttttagttagctttttgtttgccccagctgatatcctcactctggcagctatgatgttaaacaattactactgattgttttcagcaa

SEQ ID NO: 178083 - DNA, 336 bp, Homo sapiens
actaggttacccaaacgcagagaggacaggacatgagtggggtggaaggacaatgataaaggtagtagagccagtaggttgtacgtccttgtggtgtttggaattcttgcaatgggggcattaggcatgactgggaaggcaggagtcagagtgggatgcctggaactgagatcatagagagcagttacaatgtcaaggtctaggctggatgtggtagttcacgcctgtaatcccagcactttgcggagctgaggcaggaggattgcttgaagcaaggagtttgagaccagctccagcaataaagtaagaccccatctctaaaaattaaaaaaatag

SEQ ID NO: 178084 - DNA, 161 bp, Homo sapiens
gtttatctagaggatcccggccgaaattgtttgtaatatagtgggtggagacataatagataggataaataagtgaactatagtacattaaaaggtgctgagtgctatggaaagtaaaatagggccctgtgatggggagcataatggtggtagtgatggtg

SEQ ID NO: 178085 - DNA, 409 bp, Homo sapiens
aagagatagaacatttctaacatccacgaaattccctgatgcccactgtagtcatcccagatcccaggcaatctcttatctgttttctgccactgtagagtaattttgtctttgctagagtttcatataaaagtgcaattatgtgcaactggcttgttttgctcagcatgaagtttttgacactcatctatgttgctgcttgtatcaacagtttgtcctcttttgttactgcatagtgtagagtacttaccccattattttgataatattatccaacattgtggattcatgtcagacaaacacagtgttaatgctttgtataattttttttctctgggtccccacaatgatcttatgagaccataaatggaaaaaactgaggctcaggaatgataatataattgtccca

SEQ ID NO: 178086 - DNA, 281 bp, Homo sapiens
gtctgtgaatttccgtgttttcatgcccacctgcccgtgtctgtgaatttctgttttcatatccacctgtgtgtctgtgaattttcgtgttttcatgcccacctgcgtgtctgtgaatttccgtgttttcacgcccacctgtgcgtgtccgcgaatttccgtgttttcacacccacctgtgcgtctgtgaatttccgtgttttcacacccacctgtgtctgtgaatttccgtgttttcacgcccacctgcgagtgtctgtgaatttccgtgttttcacgcc

SEQ ID NO: 178087 - DNA, 107 bp, Homo sapiens
taactgcacagtggtgtagagattgccctaaaaacagaaatgatagcaaggtggcaaaagcgtcaaaagagtccaccattgtagtcaagctcttcttacgtaaagag

SEQ ID NO: 178088 - DNA, 210 bp, Homo sapiens
tgaagggacattctgactttatatgcttgacatttcgaaaataaaaagtttaaatagaagtgaagacaggttagatttccaattctggataatgaaaacctctgcaggtgaagaaatccagggcatcctgggcagggcccttgctgctagggaagaggccatttcgttggtatttccttcctttcttctctccttccttcctccttccct

SEQ ID NO: 178089 - DNA, 333 bp, Homo sapiens
ctgaaggccctggcctcacctgagtggagtacatcaaggtagcaaaactgcactcacaccccatgaatacatacaacattttgttaaagtactctaatgtaatctaattaaaaagacaaccaccaagctttcaggcatatgggtaggggatgtaacactgagaggagacacaggtgtgcttccaaggccccacagcctgcaggccgtcctcatctccatgtcacttccgccccagaggcccttccacagggccctgctgtctgcaaagtcaccacctggtagatggctggctctccaccttccccacagacaaggactcaaaagccatcacca

SEQ ID NO: 178090 - DNA, 338 bp, Homo sapiens
aacaccctttgccctttttaggggtgattctgagacttggcagagatctttctctggctttactaattgcctgtgtttttctggtctttgcctatcagcattggtttggggggatctgctttggggttggtgagctgccggtagcaggggaccgcatttggagcgcccgtggctgtccagcccccacgtggtagcgcatggaccctgcatgctcaggttttgtggagtgcccatgtcacacatgaccccgagagagggggctgtggcatgattttgcaaacaacgatgtcctgaaagagacttggaacacagaaggcttgtcttgatccagagctggg

SEQ ID NO: 178091 - DNA, 274 bp, Homo sapiens
gatggtatataagcgtatgtcaaagagctgctatcatttagggctacagtaggaatataaaatgctctgtggtgccccttcattatacatctctgttagctaacaactcacttagggctgctcacccaccctaaggctgttcagggaggaacgaggactaatgtggtagtcagtgccccggcatcctccccgctactctttttagtactgaactcccctagctctagtcaggcatgtgattcgccctgaagcgggtcagcaggtatagactata

SEQ ID NO: 178092 - DNA, 312 bp, Homo sapiens
cactagaactttactggagcccatcagccagaataaattgcttccgcatgtgtgttccccaagcacagcgaacattcctatcctataaccctaatcaaattgcactttggtttcctcctcgaatagtgtctatgtatatgtgactccttcctcctgtgcctttcatctctgcttctcctggtctagcgcagcaacggggagaaaatgagcactcagtgagtgattattgccttcgccttgatgaaattaaaaactcatttaagagctgatttctccaatttttgtatctactggatttctctctattatagc

SEQ ID NO: 178093 - DNA, 439 bp, Homo sapiens
ttcactcctgaggccagcgagaccacaaacccaccggaaggaatgaacaactccagacgcaccatctttaagagctgtaacactaaccacgaaggtctgcagtttcactcctgaagtcagcaagaccacgagcccaccagaaggaacaaactccggacacaccatctttaagagctgtaacactcaccgcgagggtccgcggcttcgttcttgaagtcagcaagaccaagaacccaccaattctggacacagtggcgtaccgggaggcagaggttgcagttagccgagatcatgccactgctctgtagcctggtgacagagtaagactctgtctcaaaaaaaaaatgctaagtgaaagaagctggagacatactgtatgattctaatggcattggtggcttgtctggagtggctgctgccatgacgctggttgcagctg

SEQ ID NO: 178094 - DNA, 349 bp, Homo sapiens
ttttatttttagtagagtcagagtttcgtatgttggtcaggctagtctcaaactcctgacctcaggtgatttgcccgcctcagcctcccaaagtgttaggattacaggcatgagctaccacgcccggcccataaaatttatttttatcccagttgtgtgtacttatttacttatgtatttatttatatttatttatttgagatggagtctgactctcttccccagactggaatgcagtggcacaatcttggctcactgtagcctctgacaccagggttcaagccatcatcccacctcagcctcccaagtagctgggattttaagcatgtaccaccatgcccagctaatt

SEQ ID NO: 178095 - DNA, 181 bp, Homo sapiens
gtgtgagtgagtgaatgagtgaatggctgagtgagtggatgagtgagtgaatggatgagtggatgagtgagtgaatgagttaatggatgagtgagtgaataagtgagtgaatgcatgagtgagtcagtggataagtgagtagatgtgtgagtgagtggaagagtgagtgagtgaatggaag

SEQ ID NO: 178096 - DNA, 214 bp, Homo sapiens
cggatggacggctaaataactgctttgctccatgtctttccaggaaaactatttcctgtgcttgataagccacatgagaatccgcagaaacagctcctgaagatgctccaggtgtctccacatctgcgttcctagacacgcctcaaatccctcaacaaacgtgatgatgacgacgcatgggttctgcaggtgctgagtcagcacttttcacgca

SEQ ID NO: 178097 - DNA, 189 bp, Homo sapiens
gtttcataatattggccaggctggtctcgaactcctggcctcaagtgatctgcccactttggcctcccaaagtgctggaattacaggcgtgaaccacctcggcacctagctcctagacatggtttaaaaccatagtgctcatttatcaaatagcaagctcccccttgggtcctagcgtagtcctatata

SEQ ID NO: 178098 - DNA, 302 bp, Homo sapiens
cgagtgtcagagacggaagcgcactacaggcatccacacacagagtgtgcgttcagtcgctttcctgggtggaagcacaagaaaatgtgaacagctgtttcctctggggagagcagtggggcaggatgagaggagtagctctcacttccttttatgctgaaatatttaagaataagttgtgggtatcctcacattactcccctaaatgcttcagtacacatctcttcctggagagtcacacagccactgtcacacacacagtcacacacctcacaaaatgggaaattagcagcagcatctca

SEQ ID NO: 178099 - DNA, 143 bp, Homo sapiens
acagaggcacttagttaagaccttgtcaacaagccacccaaagggttaactatccagatggaatttaaacctactcgtccttttaatatttcatttctagctccccacagctgaggcataagcttggcttgttttaattaaat

SEQ ID NO: 178100 - DNA, 127 bp, Homo sapiens
gattttcagactggcaaatgaccactggcttccacttaaaggcagcaacctgcattagcccctaacaagagtcagcctatccttttaagcattgaaaccaggcattgatatctgctctctagctatc

SEQ ID NO: 178101 - DNA, 264 bp, Homo sapiens
gggagaggagaaaggagtgtggaagagatgggggtgggctgctggcggggacagaatgtggagacttagtcaccagtcatcctgggaaggtctcctgagcacctacgatggggtgggcactctctaggcctggcaacccgcgagggcacagaacagaggccgctgcttccagggagctggcattttatttatttatttttgagatagagtctcattctgtcacccaagcgacagagtgtagtggtgtgatctcggctcactgca

SEQ ID NO: 178102 - DNA, 681 bp, Homo sapiens
cttttctatgctggtggggctttcccatgggagcacatggctggaccatcacttggagtgggataggattgggattcacattcttcctgcatttttttttttgttttgctgatttgcaaccatcaagatgagccctgtttaatctcctggcaaggaatacttgggaagaatgtgctcacagctctcagtgcttttgagatccatgtattgttgttgttacaaccactcttctgtcccctttgagaaatctacacagaaatccacatggcagatgtttgaatctcaccccttccctctcttcctaagttgaggaagagctgagctatggtctgccaacagtggaggaggctcttctggagctcactaacatgactgcaagaccctcattgaggccgagcagtattcagcgtctctgtggcctcctcactggcctccctacctctttgtagtctgccctccatgtatcagccagggacatctttccaagtgtaaattttatcttgtcatgcctgcctctaggttcccagactgtgcttccaaagccttgcaccgtctggcccctgcccacctcctgaaccactcccttccaccttttacacatgcaggccaaccatgctggttttctttcaatttctccaactcctcatgctccatcttgtccctgggcctctgcacatacta

SEQ ID NO: 178103 - DNA, 417 bp, Homo sapiens
agaagaatcctcaaaagtccttattctcagcactgttttcccattatgatcacagacttttcaaatgatgttcttgtccaaagtcccagggggaaaaaagggaaatgagatcactctatgagtttatttttccttgacacatatgggaagggagcattgctgagtttgtaagcaacttggtgggtctcattccgggtatttctctaatgctacagaatacccccactgacttcctaatgaaatgaagttgtaatgaaagccatatggagaaaggcgtcatgtttactgcctgcaccagtgtggggcagggctagtgtcacacatacataggcaatgtgccaccatcctaaatagctccacagtcaccagcaatcatttcctctggccagggtattgccatggtgggaatcatctgag

SEQ ID NO: 178104 - DNA, 263 bp, Homo sapiens
ttttccctctacttctatcctgaatcccatgaagacaggtatttttgcctattacgataacaattccatctatatggattgggttcttgacctctcagctcacacagctaacttaaaggtgtcaattactgctggcagggactagaactctttaatattgattgacctgtgaagtgctaaggcaggccagctcaaaatccaaaccaagatgctcgtttatttgcaaggtaggatcatgtgcttcagaaaaccaactacaataa

SEQ ID NO: 178105 - DNA, 829 bp, Homo sapiens
gcatgccaaattaacatgtcataaactgaacacctgatagtctgtaccaaaaccctttcttataactctttccatatctcaaggatggataactcaattcttccactgatcagaccagaaatcttggtatcattcttaattcctctctttctatttgaaattccttcaaaacataatcagaatgtgaccacttctcacaatactgtctgctacctctcttgaatcaaatcatcatcctgttatctatattactgaaatatcctcctaacagtttcttggcttctgctctttgtctattctcaatgcagcagccagaataaacttgttaaaatatgtcaaagcatgtcacttctctgctaaaaatcatctgatagtttctgctttcactcaaagagacaaagtgagttctgcctgatgctcttctccccatgactttctccccttcctcttctgtgaatgtgccagcgatgctcccgtctcgtgacctttacacttgctgtttactgtgctagaaatactcttcctcagaaaggcaagaggcaagaggctggctctttcactttcttatttcgttacaaaataaagtcactttcttagtcaagccttcactgataatcctaagatttcaaactccctcccccaccggcactttatatctttcttccctgattttcttctgcttggcacttactatttaacatactgctttcctcattttattcatgttatttatcagttgtctcctctcctaaattacacacacagcgagagcagggatttttatcacttttgttcactgatgtattcccaactcctagaagtatctgga

SEQ ID NO: 178106 - DNA, 236 bp, Homo sapiens
tgtgcgaggtgaggaatgaaagagcatatagtctcggtgagaggcaatagacaaaggttattagagtgagtttggtggcgagacggaaatgttccaggccctgccccttttatatcctcatctcagacttggcttccactttcccagggcttccttcctcacactgaatggaattttgcctgtgggaccagctctctgtgtgacagtgtagggatttgatttgatttttttaaatg

SEQ ID NO: 178107 - DNA, 572 bp, Homo sapiens
aatctgaggctgtagtgattctggtgtacttttcgatgggtcagttataaactttgctgtgggtccctgaaacaaaaactaaatgaggcttccctctaatcttgttttacatccttgagagcatgactttgtgaccatgtggggatactctctcttggtctccaccatccagagaacaggaattttcaagttcatgtcaggcacccaatccgaaagggctgggagtctgagatgagtcagcacattcttcatcccaaatgtgtcaagcccttgggtgagttttgtctgaaaaggtcccatctctatagggcatttgtcatcttttgctatcttaagcccatttctgagagtgaattcttggggatcatggagatgcctcttctaccctagataccttttgcttctaatgtaaaaagaaaggaaaaaaaaaactggaaaattatcatctaaactttaataggcttcttagattgtgtcactattggaactgactacctcattgaaagaaaaaggttaaattaaaagaaagatgcataataatgacatggttagtcttagaaaattctcttgag

SEQ ID NO: 178108 - DNA, 557 bp, Homo sapiens
gggaggaataagcaagtgggtgttaatattaatcattgatattgctatcactgcctcttatttattgagtacttatctttgacattgtgttgaataccttctgcaaatgatctcagtacatgtgacaagtctttgaggtagtagcattagccccattttacagataagggaatggagtttgagaaatcttatggtcatgcagttggcaactgctggagagagggtttaaatctaggtcagtgtggctttgtgcacactgctttttctgcaagttgttggtaggagagaggtcaccttaatttaccagaattttgttttctgtaaagagaatgactttacccaagagttgaacattctctttccagaaatttaatgagcagttctgctccacgatggtgcttggaagtttagctaaaactgctggttataaactgagagcaacctgtgtgtggattgaaagggaagggtgtgcagtcattggtaagcattttcctatggtgtgactctgacgggcaagggtgccatcgctaagatggaaagatactcctgcaaattga

SEQ ID NO: 178109 - DNA, 123 bp, Homo sapiens
gtgctgtgtgtcacagcgcaggacaacaccagatgtttctgttgggttgaatttctattgggttaaatggaattaaattaattgagtcaaactgtgctttgtgcctctgtagaaaaatttaaa

SEQ ID NO: 178110 - DNA, 276 bp, Homo sapiens
gctttttttttttaagatatattaatctgctgaaatccaaccttatgttaaaagagagacacagctaaaagaaaaacacgtcccactgattcaggagaaatgcaaaaccactgataatctcagctctgacaaaagggaggctgtggagctagaatcttccttaaagagcattggcctttagaatgtcagcaggaacttgcaacctgccagaaaaccctgagagctgaagagggtcaacttagttccttaggaggacctgtaggaagagaagtccag

SEQ ID NO: 178111 - DNA, 397 bp, Homo sapiens
aggtcacagtgttcaggaaacgactgaatttcattcaaacttcagtgaaaagccactgaggattctaagccaaggggtgacatggcccactttatatgttaagaaagtctgttacaagtggcccatagaggggtgatcattgaaggagaagactgtctaagggtggcatttgtctaggtgagaggtggtggcctggactagaatagtggcttgcagagaagaagagaatcagatgcatttggatatatttgggaggcaaaaaggacaggacttgcttatggttcagatgaagcaagaataaaaaatgctgcctgggtttctggctcctgtggactgtgaggacattcgctgcaaaggcaccatgctgggggatgaattaagaggtcaggtgcagatt

SEQ ID NO: 178112 - DNA, 395 bp, Homo sapiens
tggcttcaccaagggtgggtttcccagcctgttttcaagttttggatatgtgcatgtacacagtgagtcagccaacttgggttctggcttactgaggttggggccatggagctgttactctggctgggaagcatgggcatgtagttgcctagccagcctgaggacatgtctgccaagagtagcctatggggctgtttcttaggctcatgatgtgggtgcaaggctgtttggctggccttggggatggggggcatgtcttctgagggtagccctatggggatgtttctctcacacaggacacagccacatggctctgagcagtctaatatttctcaagtgtattagaattcttcgttcaacaaaatatctgatgatttaagttagaaacagctaat

SEQ ID NO: 178113 - DNA, 331 bp, Homo sapiens
aacgctgagcaatcaacacacagattagataggtagctttagatcattacaatttaaaaaaacattttaaaacatgatttccccagtgttagggaggcatcttagggatgaaagcctccagtctgatggattcccagttctgcggagtgaaggcagggcatatgaggaaggtctcagtccaggctgattccttaagcccatgaaaagcagatgcatgcagacatacagaccccctccttatcccattcaccgcattcttccattttaaaaaagtcacctgggtatcggctggtgcaagtggaatcagcttttggaatcagatcattccaga

SEQ ID NO: 178114 - DNA, 287 bp, Homo sapiens
ccttgtcggtctctctgaccgtattccctggacaggtaatttatcccttctgtagtttgattggctgtgaaatggcatttataatgtttacttgaggcttaaatgagataaagtggataaaaagtgcatagcccaggcctggcggagagcaagtacttggctgtctagcattcgtacgtgcaggacaccctgcactgtgtttgatgtatttcatctccacaagggctctgtgaggctggcactattatcatccccattttacagagggagaaagctgaggcacagag

SEQ ID NO: 178115 - DNA, 340 bp, Homo sapiens
gaggaatctattttctgttatttaaggatcacgatgagccattttcttgtaactaactagaagattatagactctagcatgtgtgtaagtgtatggatagactctaacatatgtatatgtatatatgtggggtggtatgtctatatatatatgctgtgtgtgtatatgtatgtgtgtatatataatacatatctatgcaaatggtcctactgaaaatttgccaatggtacaaccaaattcagaaaaacaatatgaatagtaattaacagcttgttaaatttgaaatgcttttaaatttatctcacctgttcaagtaataaagtgacatggttctactctg

SEQ ID NO: 178116 - DNA, 842 bp, Homo sapiens
aacttactttataattgttaaatgtcaagatttccttgacatttctgagatcttttaaacaaatgcagcatatccgtagttataatttttattatcaaagacaaatgccattaaatgtctgctttataagaacaatattgaatgctataatattaaatctaatgattctttttccattacaagtttaagaaattagtgtttgctttattttgtgtttattttctgtttagtcagttattctcagtcaacagtgtagatactatagaaacgtttatacattttaaaaagtcttcagaattagagacattagtgtgtagttgttataaatccacagtatttagctgtgtctatcttggttattgaagcatacatcatgcaagaagtcaaaaagaacacccttcaaatactttctgccaggcccagagttcagtgcattaatacttgcattagtataacaagcttaagaggtaggtactaatacctctttcgacaaatgagaaaagcaagttcagtaatgaaagtttactcagctgttttaactcctgggaatataaatgtagaggtaagatgcaatcttgcagcctaactccagagcccactgtggtatactctttcctaagtccagagtttatatgccataaacaaatattttaatacaagcttgtattaagggaacaaaatgagattaggaaaattgttaatgccagatatatttgtagatatttttaaatataaatggataaatattaatgcacacgtatatacatacatatataaatttatatatgtgagaaaaatcactcctgtataacctggcattttatataaagcaaaatacttat

SEQ ID NO: 178117 - DNA, 222 bp, Homo sapiens
ctgtggcctgctcagtcatcttcactgcctctgttccccagcttgtcactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttggagacagcatatca

SEQ ID NO: 178118 - DNA, 490 bp, Homo sapiens
aggtctaggtcatttgtattcataaataataagtaagtataagcaaagtttattttttaaggtcacaactgatactgctttttccttttgaggtaaatttagagatatttccttaatcacctgttgaatatgactaatgaaaaataaataaggatcccaatagaaatctaggctgtttttaacattttaatagcggttgtgactaattcagtgattatgtagttgtaataattattacaataaaaataatagatgttaatactaataagaactcatcaaacaactggatttaaacataaaagcctaagtgaagaaaataatttatttcctaacaaaaagacacataattagagataaaatatttgtgagtgagccagataagaaatgaaagatagcttagaatgagaaaaacaaattaatactttctaaaaattaatacacctatagagtgctatatacaaacatttttaagagcattttcacacatgct

SEQ ID NO: 178119 - DNA, 317 bp, Homo sapiens
atggctatgttctaataaagctatttatataaatgtgcagcaggctaagtgaactctagtttgccagcccttgttgaaaggtgtcagctcccaatttggcttttttgtttgtttgtttgagacggagtctcactctgttgcccaggctggagtgcagtgatgcaatctcggctcactgcaacctctgcttcccaagttgaagtgattctcctgcctcagcctcttgagtagctgggactgcagacatgtgccaccacacccagctaatttttgtgtttatagtagagatggggtttcatcatgttggccaggatggg

SEQ ID NO: 178120 - DNA, 312 bp, Homo sapiens
cttgacctcaagccatcctctggtctttggcctcccaagtgctgggattacaggcatgagctaccatccctggcctgaaggtggtatctgttaagagcattccctgagcatatttcaagatgactactcttaccctcttcctgccataagcaggaagcatttttctatgatcttcactgtgagaactgatgaagtttctggaggtagagctcacacatttctgggggccccctatgactggatccctggatttttacctctttttttttaaaaaacagctaattaaaaaaaatatttagtagacaagaggtc

SEQ ID NO: 178121 - DNA, 507 bp, Homo sapiens
agcctaggcgacagagcgagagaaccgttttaaaaacaaaacaaaacaaaaaaagaatagaactatatgagaacattataggttgagtataccttgtgcaaaatgcttgggaccagaagtgtttcagatttcaaattttttcacattttggaatatttgcattacacttactggctgggtatccccagtctgaaaatccaaaatctgaaatgctccaacaagcattggattttcagatttgggatgctcaacctgtaatagacaaattcctagaaacttacaaactaaactaactcaagaaaatcgaaaatctcaacagacctatcataagtaaagagattggatctgtaatcaaaaacctcccaagaaagaaaacttcagaaccaaatggcttccctaggaaattctaccaaacattttttttttcccggagacagagtctcgctctatcccccaggctggagtgcagtggcatgatcccggctcactgcaacctccacctcacgg

SEQ ID NO: 178122 - DNA, 475 bp, Homo sapiens
aaggaattggagagaaacaaaagcagtaagcaggcaatggttgcccagactagatggtggctacagtgatcattatggtagaactgtgtccccaccaaaacgatatgctgaagtcctaacccccctgtacttctgaatgtaacctcatttgaaaacaggattgttgcaaatgtaattgcttaagctaagtaagggagggctcctcatccaatgtgattagcatccttgtaagaaggcagtcatgtgaagacagacagggtgtgcagactcgcactatgtgcagatggaggcagagacaggtgtgatgcagcggcaagccaaagaatgccaaggattgcgggcaaccaccagcatgtaggaagaggcgagggagggttcttctgcaggtttcagaaggggcatggcccagatgatttgatttcagacttagagtttccagaactgtgagataatacatttctgtagttttaagcca

SEQ ID NO: 178123 - DNA, 444 bp, Homo sapiens
cagtgtggtttatgtttagaaaggcaggtggggctgtggctcacacctgtaatccaggcactttgggaggccacggcaggtggatgatgaggtcaggagttcgagaccagcctggccaacatggcaaaaccccttctctactaaaagtacaaaaattagccgggcgtggagtgcatgccactgccttccagcctggccgacgagtgagactccatctcaaaaaaaataaataaataaaaaataaaaacggtgtcctctgggccaggcacagtggctcatacctgtaaaatacctgtaatcccaatgctttgggaggtcaaggtgggaggattccttgagcccaggaggtcgagaccaatctgggcaacatggtgagaccctatctctatattttatttattttatttttatttttagtttgattttttttgagaccgagtctca

SEQ ID NO: 178124 - DNA, 315 bp, Homo sapiens
tcatcgtagctgcgtattcctgttttcagtgtagtaacgttgagcatttatgttcctagcactcttccaggtaccctgtgcgttatgaggcaggcacatctctcctgaaagaatttatattcttgtcagggaaataaggcttcagataagaaaaaattcgggggaaagtgccgaattccttctaccctaacctgcctccatttcctccctcctccgagttgagatgattgggtcagagccagctcttcctgggcttgggaagaggagatggggcttgagtgctgctgcccccctcataacctcagagtctatatt

SEQ ID NO: 178125 - DNA, 171 bp, Homo sapiens
taatgctttttgaaaaatcagggcttagctgcttctgaaaagatgaatgtactcttaggggtccacatttgacttttttccaaattcaaataaaaattagtggggcaggatgttaagcaggataactctacttaaagcagaaaatctttaaaattttggtgtagataaatt

SEQ ID NO: 178126 - DNA, 623 bp, Homo sapiens
tcaaaagctgaggctaaaatcagaggtaaataataggttttagccagatatctgtatttgcgtgtctaatttaggccatttacaaagtccattcagagaggcgctgaacccagaaaagcatcatgtgtaaattaacttttatgaagattattaatcctgtttttttaactataagtaaaatccagttaatactgtactgcctatattgttttatttactaaaaaatttttaagtcctacttgaaaaactagaaagtgaaatgcttttgaatatgcagatgtatcttatgaaactcgattcgacttcgagctcggtacccaattttaaactgtaaaaactaaattacaataatgccccatggtaactagaaaagttttttttaagctaatatattcttttgtaaaagaagggatttctatgtttttaagcatatgtttgtaagatacacgttggaatataaattaatttggcattagcttaacttgctgtacaaaaattcaggcttaaatttatacttactgtagatgtggtctttatctcagcagtgctgtatgaaagcagagactgaattggtttctcttaataaatgctgcttaagcaacagctggcagtagtcctcttta

SEQ ID NO: 178127 - DNA, 375 bp, Homo sapiens
tctttccctaagaacttcaattttgccctgtcaaccctacactttgaataaatatatattgggtgattctgaacctctataatacagtttatctttgttgtatttccaaggagttagaggttgagccagggaaagacagaagagatatgagggttacagggaaaggaaaaaaggaaagaaaagatgagtaggcttgaggcagagaggaaaaggacatccatatagacccgaaacacggaagaggctgaaagtctagatgtggtgaactttggggcaagtccatcttggtcctatccctccctcatccacagagggcacaacctacccaaacagacccacacctcactaggacagcagtattaccatcacaaccac

SEQ ID NO: 178128 - DNA, 539 bp, Homo sapiens
aaagaattatggatgattccccctactttctctatttcctgatttttttacaacaatcccatgttatttgcataacaaaaaaccaattaggaaccatttcaactgcacccccacgcaaggacctacccagggcctgtgcgactgtcattcctgctgtccagaaggctccttcccctaggaatccataagccaagctccctcagcttctttagggctttggttgtccagcacttcatctcaataaggatcaagggttcttctctgagtaggaatctcacttaacggcattccttaagtgactaacttttaatggacaatgattttaatgttactaaaacttggtcagctgggtatggcagctcacacctgtaatcccagcactttgagaggccaagacaatcgtctgaggccaggagttcgagatcagcctgggcaacatggagaaatctcatgtctaaaaaataataaataaattagctgggtgtggtggtgcacacctgtagtcccagctgcttaggaggctgagacaggaggactgc

SEQ ID NO: 178129 - DNA, 150 bp, Homo sapiens
gccaggtggggggcacagaaacctcccgctcgtgcccagctgagcctgccttcctgtgccaggagtgagagcgctctctggaccgcagcaccagcctttgcttcttgatgctcaccacttattcaggtcaaagcctggcaactccctcac

SEQ ID NO: 178130 - DNA, 296 bp, Homo sapiens
ataagcattgctcattagtaatgacttaataaatgttgcctctccatttagccttacaaaaccttttctgcattaagattgaccttgccttagttcctacaaagaagctgctggttggagaggtgttaattgtcttctaaacaacttcatctgattaacctcttggcttgctccggtgccagcctcccagggaaagaaatcttatatcattattactgttaaaagaaatataagctctgaatatgcaatacatgcccagggtagcaagatgaataaaaggttatatagtgaaaagt

SEQ ID NO: 178131 - DNA, 555 bp, Homo sapiens
aagttgatccacaggtttaatacaattcctatcaaaaccccagtaaggtttcagtaaggtttttttgtagatacatacaagaatattctaaaatttggctgggcacagtggctcatgcctgtaatcccagcactttgggaggcagaggtgggtggatcacctgaggtcagaagttcaagacaagcctggtcaacatggtgaaacccccgtctctactaaatatacaaaaattagcgagcgtggtggcaggtgcctgtaatcccagctactcgggaggctgaggcaggagaaaagcttgaacctgggaggcagaggttgcaatgagccgagatcgcgccactgcgctccagtatgggcaacaagagcgaaactgtcaaaaaataaaaaacaaaaaaaaaaacttttttttttttccgtttaaaaggtgggttgtccatccatgcaataaatattgtggagtggctactgtgtgctaagcactgttgtaggcacggggattttgtaagtgaccaaaattagaaatctcagtccttgaggtaatatacattcttaagg

SEQ ID NO: 178132 - DNA, 339 bp, Homo sapiens
tgacaccccccccccaagatcacaacccccaatccttagttcatgatgccattcagagtgtgtgtttttttgctaaatagcataaaattacatcctttcaacttaaacaaactgctctgcaacgccgagggccgctgaacgggtgttttaaatgtcagcatacggtagccacttgtgttgtctggcactttttgattaagagcagctgcctgtaaaggcctctgcgattggttaagtggccctgggcagcctgcctcggccggcctggctttggtcagggtcaccgagaccgagccgggtgggagccgcctgcgcctggcagccgggccacagcggccg

SEQ ID NO: 178133 - DNA, 129 bp, Homo sapiens
agagaggaaagatatgactggtgtggggacagcacaggcaacactaaggaggaagtggactttggcagcctgagctcacacaaggtctgagtggctgaaattggaacaaagagccaggccacatgggga

SEQ ID NO: 178134 - DNA, 651 bp, Homo sapiens
tctagaggatcccaagtgtccgtgtagtctcaaaaggaaaaaaaaaatcaatgaatgtatttctagcctatagatagttactgggctagtgctgccacttggcctggtgcttcagcttgttcatatcgtgacacacctgcaaattaatgcatttgtctgacacactggggtaagcggatgaagctgtttggggctagaagttactagctggatatgagaagacaggtgcccaggaagtctcaggccccactttgctatcttaccctagggctgaggggatcagcatcttgaagctaacaagtagctcattctcggcacactggttcagaattttagtctagcccatcagtactctgtgtatcagccccataaagcaagcaggtaaccaacaccaaattcaaacaaatctgctggactgttttcccagagtcaatcagttactggctatcatcatcaaactaccagatttaaagtgtgtgtgtgtgtgtgtgtgtgtgtgtgtgtttgtgtgtggagggggaggcggagggggtgttctgggtgaattctaccctctctttcagctcccactctcacttagcaaggacttctttttagtatcaaattaagagaaagtgctatgaagcataaaagatgtaatagacacagatt

SEQ ID NO: 178135 - DNA, 914 bp, Homo sapiens
tggtctctaagctgcttgattcgccaagtgcagtaggagggagggggatgaaggaacattctaagaagttctaagacacctcagaaaagggcagactagttttattccttcacagagaagaggtgaagcctggttttactttaaagtaaacatgcccagtagctgagggctacttggagtggcggaggaaggaatgtgaatcacagcacacgaaatggagcactcagagcatctgctttgtgctgccccatgaggcctgctcaccaaagtgaggagctcacagaggtgcagcccctcatccaagccaacggcctggaggtaggaaagtgaggcaggggaagtctgattcccgagttggactcttagacataaacagataccgcttctcttgggagttttgctgcaacagcagcacagaggagagagagcagctcccagtagattttaaccagggcaactgtatcccccaaaaaacatccaccaagacagttttgcttgctacaactggggatggggagaaggagttgctaatggcatctagtgggtgggaagccagggaggctgctaaacatccaacaatgcacaggacagcccccaaaacagaatgttcccgtgcaaaatgtccacagtgccaaggcagagaaagcctgaattacctaagaaaacagggcagctatgactcactgggccctgctgtatcaggtactgtctcagcgctttatgtgcaccatctgatgtcatcctcccaacaattctacaaacagttactactctctctcttctacagaaaaggaaattgaggcaagagaaggcaagccatggacacaggccagtcagtggtggagttaaaattgaaaccaggctgggcgcggtgcctcacgcctataatcccagcactctgggaggccgaggcg

SEQ ID NO: 178136 - DNA, 296 bp, Homo sapiens
ggcctgagccaccatgcccgaccctttttttttcttacagggacatcagtaacagtagattagcttcttccccaaaatgacctcatttttatttgattatctgcaaagaccctgttgccaaatagtgttacatttacagatcctggggatttggacttcaacatatcttttgggggaacacaattcaatacttaatagacttggaagcgggtatgttggttcagccctggggaagagggcttaagtggagtcagaggcatcaaagagcagagaagctgcctttatggacgtatgag

SEQ ID NO: 178137 - DNA, 204 bp, Homo sapiens
aatttctcctcagctctgaatatgtgatagaatttggaacagtcatctggcaatgcctaactgcctggcactaagactttaaactagattctgtgaactgtaaatcatagaactatgtgatcttggctcttttaatgtttaagtgcagcaaatattttatgcttatcaatacaaaggaagcatatattctctttttcctatagt

SEQ ID NO: 178138 - DNA, 357 bp, Homo sapiens
tattggtccacactgtgaaagaagcagtttgtttgttttgtgggtgcgcttttccctctgtaaacatgttttgaggccaagtgattggtaaatgttttataaactggaagtataaacacagacattctcttccaaaaatggatctctaggacttccctagggaactcgctcttgtttgttctaaattctgaacctggttttaatgaaaatgttacacgtctaatatttgaggtggtaatcctgacatcaaagagaagaaatgttgaaaaggttttgagacaccctaccaaaagccatttctgcttctgtgaaggacacttaaattacatgccttaataaaggaagaaaagagacgag

SEQ ID NO: 178139 - DNA, 459 bp, Homo sapiens
aagaaggaaattacttttaggtcttgaccaaagggtgttccaagtgaagaggtcccaaatcttagtaagcgggcaaaggtggttttatttttttcagcattgcttcattaatctgaatgtaaaactatagaaaaaatagtctctaatttagctagaaaataacactcatttgcttgctaaggtctagcaacaaaagaatgttaatgcacattactacctattactacaacagtgaacacaaaatgaaatgagcagatgctgatttaccttctctggtgaatcatgcatggcacgaaactgcagtcctgaagcaagctagaccatctgtgctgttttctccagatgagccaaatttgatgacaaaccattctccatatataggagtttttctttctttctctccattttatattagaaagtatagtttccccaatagaagatgcagaaaactattttgca

SEQ ID NO: 178140 - DNA, 161 bp, Homo sapiens
gttaggcaaagtcggagacaaatacatagctaccaattgttgtagttatttatatgacttaattcaagtatgtaaaacaaaaacgtagaaaggatagaattttgcttcttgtattaaataaaaagcatttttgtaatttatgatccagccctcaccaagtg

SEQ ID NO: 178141 - DNA, 370 bp, Homo sapiens
aggtaagatcctcctcccttccttcctccctagggcaagaggcttgcaaaattcctgggccctaggcaagtggcttcctccctgggaccccaacaggaaaatggaggagagagatgggcccagagagggtgcctcacctctgatttggtttggaagcagaagactaagtgcacagcctagaggaagccccttcattagctcaggcagcctgcaactttatcatcagcagtgggacctgctgcctcctgaagggtgggcggaggctgtggcagcagcagatgtaacagggcctctgccagggagttaatggggccctgggttggggtaacagggtctccggatggaggaaatgtggtgtggggacagggga

SEQ ID NO: 178142 - DNA, 263 bp, Homo sapiens
aattaggtgagtatgtgatgtgctaaactggattcctcagctatcattaggaagcaacatagccactctgtgctctcagtggctgctttgtagaaatagctacctttggccaggcatggtggctcacacctgtaatcccagcactttgggagtcgaggatcacttgaggtcaagtgacttcacttggtggatcacttgaggtcaggaggatcacttgaggtcaagagtttgagaacagcctggccagcatgtgaaaccctgtc

SEQ ID NO: 178143 - DNA, 226 bp, Homo sapiens
agtgtgccagctagctgtagactaactaaagaagaattaggaaaacctaggttttagttctggcccactccctgggtagtaacttcacctttctgacaatatcagcatctttcttccagggtcatgttgaaaattaaatgagatcctggatataaaactggtagataaactgtagaatgcaacacattttctttctttcttttttttttttgttacatagagtctc

SEQ ID NO: 178144 - DNA, 323 bp, Homo sapiens
tgtctggttctgtggctactgctggagcagtgaagacatgggaccgcaggcatctcacagcaatccacttgggctagaggacaccagcgaagtggcagcaggagtgacagctacaggagagtggaggaagggatgagctgcagttctcactgacctgctctagccaggatgccagggatcctgcagaggcagcctgggcccagacaatagctggggaggttgttctgtggatccctctgttccgcctgaggataaagtgatctttagagacttgtctcagcctagaggggatgggttcaagtgatgatgagggtggaacctac

SEQ ID NO: 178145 - DNA, 276 bp, Homo sapiens
ctcttttgttaatcacatagttgcattgtgttttcttttttcaaatatgtatgagcagcataaaattggatgttcctttgaaacaacagcagtcagaagtccatgaggaggtgtcttctgactgcgaggataagggtggatcaccttaatgcaatcagggaatgatgtgttagaagcatctatagttcctgcttcccctaatttctagctgtagccatttgaagattctaagcaagtcctcaactgttcagcagagcctctggtccagcatgagac

SEQ ID NO: 178146 - DNA, 455 bp, Homo sapiens
cccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaag

SEQ ID NO: 178147 - DNA, 267 bp, Homo sapiens
tttgtctgatttgcaagacctgtttcttgtagatttgatcataaccctgagaaatattggcagactagtctgtcagggagtaatattctacccaaactcacacaggaacattttgaatgctgctgagagtccaaagtcaatagggttgccaggatgagcaaataaaaatctagttaaatccaggacacccagttaaattggaatttgctcaacaaaaaaagtaagtataattatatcccattcactatttgggacattcataaacta

SEQ ID NO: 178148 - DNA, 320 bp, Homo sapiens
tccactgatgggatactaatacaatagagggatcttcactagttgaggtcaaatcatgaaacagttttatttttccaatagctgtatcagcagtgttctttctatcactccctcccccacttcgcatggggcaatgggcttctttaactacatttctgtccagttctccaacttttcagtcactactgcttattaaaatagtttcagtcagactaaagatttggttctattcattttcaaatgccaatctcacttttcattctgagtcctcctggtgcctccagggcagattagaattgaggctcctgggcttgaaacat

SEQ ID NO: 178149 - DNA, 285 bp, Homo sapiens
tgcatgatacgactcgagcttgtaccctcgataaggtcaaacacttatagccaactgaccttcaacaaagcatacaaaaacataaagttgggaaaaggacaccatattcaatgaatggtactgggaaaattggcaagccacatgtagaagaatgaaaatggatcctcatctctcaccttatacaaaaatcaactcaagatgaatcaaagactcaaatctaagacttgaaactataaaaattctggaagataacattggaaagactcttctagacattggcttagg

SEQ ID NO: 178150 - DNA, 533 bp, Homo sapiens
tgaatgggtagtgaaagacagagatatgaactatagccttgtgtcccattatagaaacaaagactgtagtaagtagctttttgcattttctctttgcttactatatatatagtataagatattgaaggtaaactttataaggtagtctttagttaacagaatattcagaggcactatgacagattacatacaaatatagctagcaatgattgttgttgtgtgtctccttatttgggggagagggtaagaactccatttgtataaaggatagttttgtcttgttacgtagacacagattgttgaatggaatttcaagtgtgtttagaagcattcataaggaagctgagcagccaggggagtggactgtgacagttatttactgcctctccaaacatactggctctcagcttcaaatctaccctttattgccatactttgtgataaggatgagaattgtgtaaatgttctcctttgctagctgaaaatgttacagttttgtcagcagagggtgctagagtaacactgcagtaaga

SEQ ID NO: 178151 - DNA, 888 bp, Homo sapiens
caagcttacttgaaaccaggtcatccttttttcacagaatcttaggagactaatgtttcatgcctgggggaaccatatcctaacctcttagccagaaacgaaaccagaggcccccatatatagagatccttggatgagtattcatgtgtgatactgctcattaatctgtgatgatatttaaaaccccagacaatgtagtagcttttcttgtactacttgtttgtcccttattctgaaattacatgtcgtgtgtgtgcgcgcctaagtatcctttttaaatggtagtgttaggaaatggtaattgtctcttaaatgtcctttattaacaattcatgatagataaaatgttcttttaaaatgtttaattattttgtgaattctaaaagtttgctttttaggagagatttttttgctccagggaataccattcttaagctataagactatatctgagatatagtctagggtctatgaagtccagaattttgtaagtccatgtttcgtcttcatatgcccataattgacttttaaatacagatcccaaagccttacttatttggttgcataggaacctccccgttaccatggtgcccagcactgccttacaactccagatggcactgagcggaccctgctgtgagcagctccctattccatgacagtgtgttgagctctccattgtcagaggctggtagggtgttcagctagaggtgccgaggatgaggtaactggaaattctgaagcgcacaagagaaggcatggcttgaaacactgacctgaccctcagcataaactgaccgttgaggaagttggtgaaactggaagagaggccccttgccaagcacatctgagagccaagagtcagcagagaaagagcagcccccagag

SEQ ID NO: 178152 - DNA, 649 bp, Homo sapiens
gcatatgcagtctttctttgactgaaatgccgttgtgcagtgcatgactgtattttataagatgagcctaattgtgttatacttctcgggaatgaaggcataccctgcagtaggtttggattctgtgtttgacagatgtggctgcttttctttgctttcactttcccctaaaggaaataacagtagtaagatgaagaaagaggaaactagtagtgaaaattaagcaggtgaaatatttatataaggcaggacagctgtggtctagacatttacacagaattttactagagtaattgcttatctcagaattcattcaatatgctaatttctcgtagcagattgcctgtccggcaatgcacatggcatacaatttttgaaattctgcagtgatgatggaataagcatttctaacccatttctctgttatagcaattgccacattgcctggtgtttatacgtcttttcatcactgcactgagttactatcaattactgggtctttagctttctactatatttgggatatagaacagagtaagtactcaatacgtatttttgatgaattaatgataaagagaaagaaattccatcaacaacgtatgttatattgttttttctccagaggtaactaacctaacttgatatatag

SEQ ID NO: 178153 - DNA, 523 bp, Homo sapiens
agatttgtagcatatccttgaatctgagacctcggattcagagttgaaacgcctgtagagcacgtctcgcctgtgaagagattctcctcctataatctgctatgaattttttggatgtatttttccacagaatacacctacgggacattttaacatatacagttgctgaatttgtattgaggcatagggtgaaaaagtgatttttaaatcttaattcaaaagcccaactgataaacaaatacaatttttgaaattctgcagtgatgatggaataagcatttctaacccatttctctgttatagcaattgccacattgcctggtgtttatacgtcttttcatcactgcactgagttactatcaattactgggtctttagctttctactatatttgggatatagaacagagtaagtactcaatacgtatttttgatgaattaatgataaagagaaagaaattccatcaacaacgtatgttatattgttttttctccagaggtaactaacctaacttgatatatag

SEQ ID NO: 178154 - DNA, 643 bp, Homo sapiens
agaagaccttccttttcactctcaagacagcatccttggatattaattaccttttgttcattatcccctttcttatgagcaccatctagttgttgaagcaacagattttcatgttgtagttgagatattctctcctctacgtagtcccactttccaaaggatttacttggcttaggtccttttgtacactttataaaaccaaaaccttttctctgagagaatttcttgtgtcatggagtttactttttagggtattgaattcgagcttcggaaagttgctcagttaaaaactcattattatcttttagttcagaaatatcagaactcattttctttcttgtaaagaaacgtcttgtgctctctgtaaagcaagttctaggtctctttttgttttcacactttgatcacactcacttatagcagcagccagtctagcatggaatgactcaacttcagcttccagtctttccttgttttgattttccttctccagtttagacttgagcattgtattctcagttttgaggtcgttaagctgttgaccatactgggatactgtttttgttaatgtttttccattcagttttatagtctcttgaaggtcatcattcatttctttaacaatttcaatgtcctttttccc

SEQ ID NO: 178155 - DNA, 369 bp, Homo sapiens
ttggagacttcaaggaaagctttggaactgacttttgctctaaaggatgaatagagagaccttgccctgcccccattgcacagaatgcaccaggctgctccagtagctggaatagcatgaccagaagccaagatgacaagacagagcaccgtggggcccagcaggtgggagagcaccacagagcttcttgtgtgaggtcacatcttggaggggagatggatgcaggctatggatgggctaaggaaggtcttatttgccatgctgggattacaggcgtgagctaccacgtccagccttagttattatatttttaaatgtacaataaattattctctagtcactttgtgctatcaaatactagagcttatt

SEQ ID NO: 178156 - DNA, 530 bp, Homo sapiens
ataagaaacaaatgagtccccagaacatacaagttaagattattcaatcaagggaggcagtcattaccctttaacctctgaaagaaaactgcaagtaggcatcaaactaaccctgagatgggagagagtagaagttcccacacccagtgaattgtaggacattaggtaattattggtgggaagtaaatttgagtggggaactgaatttcaactgacttttatccttgaagatggtgcttctattttctcaaattagaaggttatgaaaattgcatctgaacaacaagttgtattagcataagttctagaagaaactgagaaagcaaggctagtctgaggaaaatttataccgctcacatttcccttctgaattggagaatagaattgaatagcaaaattgtaacctacctttcaaagatgcattttatagtgaagtatattttgtgaacttttatatcttctattcttatttttctattgccctattttaaaatctatcttgaatttattaaatgtatatgtctctgttt

SEQ ID NO: 178157 - DNA, 355 bp, Homo sapiens
tttgtacctggagagaaagagaagcacgccttttgggagcaaggagagcttatcgatgagcgttatcagaaacccccagcaaaggctggctgggtcactaaaggggcagggtgggcgcagcgctgctacgaccgtgaggcgcgcgtctcggaaacaggctgacttgccccggacgcgtcatcagcttcccgagggtctctcctccctgccctttccccttgagccgccccgcctcattctcgggaagtttcaggaacttccaggggagttgcaagtgcaatttaagcacaattcccaaggtattcaggttttcttaccaacgcggagatagtgggattcagcaagtttaagagga

SEQ ID NO: 178158 - DNA, 739 bp, Homo sapiens
cacgcaggaagctgaggaggagaacagacgcctctgggccactggccgggccacttgagcgtgggaccgccgagtgtgaccctgaggccgagtgcgtgcgggactgggcgatagctccgccaggcaggattttgtttgtttcacctcttgaggtagtcccggcgtgtagtacataataggcgcttaatatgtgtattgtaaagaatgagtgcctggccatttgtatttgccttgtgagcgcgtgtgtgtggcactgtgagggttgcgggaccgacggaacctctctggctctggcgggttgtgtttccgcgtgtgtgtaatttgagtgtgagtcagtgtgtagtgagtgaagggatctgactggagaaaaccacagtaaatacccggggctgtgatttttgtgactttggtcaatgggacgacaggctctgtggtagactggctgtgcttgacgtaacaatgtggtactatgccgtgtggttgccggcaaggctatgtgaagatgagaatgtgtgatttggaaaatctggatgtggaacatcacgggtgccagtggaattgtgactctgtgtgtgtataaaagtttgcaaccataggcctatatgtctgtgggataaagagaatatgttgcgtcttcttggagtatcagctttatttaaacatttgcatcagagagttgcgatttatgtgccaaagatttttgtctttttatattgaattaaatgaattttttacaaag

SEQ ID NO: 178159 - DNA, 432 bp, Homo sapiens
ccatttacatctcttaggattggttgaatagagtatggcctattgaatatacttttgatgttgttgccagtctcttttcaaatgtacacgtgacactatctgaagaaatactagaaacacctagtaaacatttttctaatatctattgttaagctatattcaggtgatcacattttgaggcttggttttctgcttggctatcagtgataatcaggtaacatatagggtatctgtgagctgctgactttaataggtcagcctgtgtaagtgtataagacctacctttttggagaccaataatgtggtagtttcctgtgcttagacttgaagggagcacttgttttagacctctataccatggtttgagaaatcttttccttagtatgtaatatccatttgcattcctgatgatcttaccctgtgtgattagta

SEQ ID NO: 178160 - DNA, 234 bp, Homo sapiens
gttcatctagtaacttatagctctacccataacacattatcacattactgaacagcatttattccaacatatatttatttaggcatacactgtgtgcacttggctaggtacataggtagatttaggaaggccaagacagggcccctcttcttgcttacacatacgatgtttaaaaagcatgacaaatgtcataaaaatgcaaataaaatacagcaagggaaggacttataatta

SEQ ID NO: 178161 - DNA, 332 bp, Homo sapiens
tccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagaactttttaattttcgattcacggggtgcacctgcaggcttgttac

SEQ ID NO: 178162 - DNA, 425 bp, Homo sapiens
tcataaagctttcctcagtacttgggaagatgaatcctctaaatgggctggtttcccattaaggaacacaactcatggctcattctatacatgtaactcacacacatcccaattaattcaggctacagtgttttcctgccagtgtaattctgtagactgtgggggctgtggctgccctgactaacatttctaattaccctggcactaacaacactcgaagtgggtatttccaacaccgctggcactaacagatgaagctggctgatattttcaactgcttttaaattaatagattggaaacgatacttcctgttcctctttataactgcttcattcctggcacaagattaagaatggccaacacaaggatgctggaattcatggtgaactttctccctttggtcttgtgacttactcctcctgat

SEQ ID NO: 178163 - DNA, 603 bp, Homo sapiens
tgaaatggaaaaggtaattgtacatatttagatcagaaattgcttggagttgctgggatttattataaaggcttttattcatatgttttaattaaacttacatttttaaaacacatacaaatatattattatgaagtatatgagaaaaaaagaaaagctttctctctacaatttatttttaagaccagaacttaagaaatgagaggcacaccaccgaggtggctgccagtgtcaggcaagggtttggcagagaacaacctaagacaggaccaaccactgacagattctactataggagcaagaggaagtttcagggaagagaaggcaatgacctacagaatcatgacctaaataaatggtggtggtttaagcctttagattataggttagtttattttgttccaaatggtaattgatacgtaagtagagttagatccttttagaaatctttcccagcaaactttcaagtaaagatggtggattgagcaaacacatctgctttcatcttctctttgtccccagtaaactcagagtaaatgataattttagaagtgcataaatccacaaggataggaatcaagtataagaaggatagacaagata

SEQ ID NO: 178164 - DNA, 457 bp, Homo sapiens
aaacacatatcctctctggattttatcctagatcttaagaaacctaacaaataattatctaagcaatgagcaacaaatcatagtaaataaataaataaataaataaccaaagaaacagagcaggagaaacaaaagccagcagaaacaagtgatggcagaaacagacttgcagagaccccaaatacagaaatgatcaaatagaggctcaataactatacttacagagtttaaagaaataaaagacaattttaaacccagggtacagtaaattgtataaaaaaattgcaacagatttgaaaaatataaaattgaactttcagaaatgaaaatctagtaatagaaatttaaaacttaatgagtagccaggaaacattttattattgaggtatagcagcttaaaaattgttcacatatacatttataaagggtctcacaatctgagggaaacattttccac

SEQ ID NO: 178165 - DNA, 610 bp, Homo sapiens
cagtgaggcatcttatctgccagagactctgaaagaatagacatcaagttattggggttttagcgtaaatgacatgaaaaagcttgtctggtccaagagccaatacttttggcatgttggatgcctgcgcagctagctaaccagcaactggctagatggatggaggagacaataactgtaggcagctccatctgcatgggttggtccctactactggtccaccagtactctaagctcttggctcttcagtcctcacattgttttgcccctgcctctgctcccacccaatataaaggcaatctaaccacagaaggtctgttactttatcctacattgaaagccccttaacaatggattgacatgcccaaaggtgtatttgagagatatcatcttggctgcagtatagacagtggagtggagaataaagagcaggtagactacatgaaagctattgcaataatctctgcagtgaaatgatgaaggcttcagctaaagtggtggcaacagaaacagacatgagttgggacaaaggagatggagacaacatgacttggtgatggattaaattttggagataaggtagagaccagggtctagacctttactactt

SEQ ID NO: 178166 - DNA, 196 bp, Homo sapiens
gttccgcgccagtgggtgagcaggggttaaattggtgggagttttgatctagcaggacttgggttggctctggggaataccgtgggccagttagtaagagaagaagtaatgatgggcaagaagagtcatggcttatttcatggaggctctaggaaaactaattaagctgtgtgtggtaaatatgaagaggctaggt

SEQ ID NO: 178167 - DNA, 941 bp, Homo sapiens
ttatctctgtcttgagttatctctagagacaccatttcttctcaatatcaaatgacatatttagttaggaaacagaagtaaactggcattgtggactctatgatattttaaaggttaatattattcattactaaactaattaggctaattgccttctcagaaatgtagatttgaatatgctgtagatgttgacagtttattcccacatagctgatgctgcaattggagtttaatcagcaattctatgatgctttcacattcaaccttcaaattcaggcattctttctgggcaaaagcatcagcgatgttactgagtttcaaccttgccctccccaaggggttttcagctgacagcagggcctagtggcaacagtcctgagataggagttgaaggcccaggtcagtgagtcccaaagtgcccttcttttaatagcagaatgagaatcccccaggcccaattcagggagccttggaatctgcatttccacaaggtgattctgatgtaaaagcactgatcaagattttatcttctttatcctgggtcagccaagataaagtatataatctcttacaccttgatttgcaagtctctatggtggaataatgatatttgtatctccttttctcctaggaatattaaagagacaacattagtgaatatatatttaaaagtaaaaatctcagagtttgagagaacagcgtaacgtggtagtaaaataacaggttagcattagaaaaacttggttctagaacccagtcagccacctactcactgaacttgagtctcgattttcacatcttcaaaaaagagattaatacctacttcccagagttaggttaaaggagatagtatgtgtataaaatttgtcttatgattaccacactgtagatattcaataaaaagtagatattactaagaatgagaggagctataaatttac

SEQ ID NO: 178168 - DNA, 471 bp, Homo sapiens
ttggcagggctgttttcttcccaggtctctctttttggcttgtcttctcccagtatcttcacacggtcttttctctgctgtgcctgtgtcctaatcttcttttcttataaggtcaccatattgtattagggcctgccctaatgacctcatttgccttaattacctctttaaagactctatttccaaatacagtcccattctgaggtactgtgaatgaggacttcaacataggaattttaggggcctcaattcagcccttgacagtgtggttcaggaatgcagttccaaaatacactcatgttacctaagccttgagttcctcaggtgggcctctgagggccagcagggaagacaaggtcagccagctttaggcttgggtgtggacttggtggccaccattactagtttaataagatcttactggtggcttaggcaagttggctgttcctcaggaggttattggcataggcc

SEQ ID NO: 178169 - DNA, 423 bp, Homo sapiens
acgttgacacttcaggaaggtaaactattaaggcaactgcagtataaaacagtataaacatgttttaaggagctaaattaatcaggtggtagaatcacaaaatgtttaaaatatatactaactcggaacatcaatactgaactcattctaaaaataacttcaatcatcttctaaatctaataatgaagtccaaatgcacatgagcactatacaatagcatctagtcaactatggcattgtgacacactatcactgttataaagagtgaaatattactcaagcagccacagtacccaagtttatacatgatttgttcttacaaattataaccgatcaaacattacacttaatactaccatgggccgggcgcagtggttcgcgtctgcaatcccagcactttgggaggcagaggactgacatact

SEQ ID NO: 178170 - DNA, 111 bp, Homo sapiens
ctcacagtacagtagcctcaaactcctaggcttaagagatcttcctgcctcagcttcccaagcagctgagactataagcatgcgccaccatgcctagctaattaaaaaaaa

SEQ ID NO: 178171 - DNA, 449 bp, Homo sapiens
tgctgaatgaatgaatgaatgcaggcatgtgtgaatgaacaacagaggctgggtcttgtatactgtggctggctgtggccatcagatccaaggatacagaagctgagacccaggcaggccagcaacttaaacaccacaacccccaactgggagcctcagttttctcatctgtgagatgccgacaaagacatctggacttaggtcacaggattcttgtggggataaaatgtgatcgatgatctgaaggtattttgaagacttccttctgcataactgagggaggtactcctggaaggtgcctccctaaggaagataggaatatggtggaagagaaatacttccctgaggccacatgggaaaatgtgaaggacaaaggttcccttcacagcaggagtgtcctggaagacctgtcccaggcgccatgaatggcagcctatatctggtccaca

SEQ ID NO: 178172 - DNA, 358 bp, Homo sapiens
tctggttttcaaaatctcaccttcacttcctcgtgaccagaatgcttgaggctgtcttctacaaatcatttttttctccttgttctattcatgctgcttctccatttttccttatgtatatgctcctaaactactactgtatgatcctagggctctgtagtgcccctggctctccagaatacttcctgtaaatatgcctgccacttctgcaacagatttgggggtcactaaagactttcaaatttaatgagttaatccctttgacttcccagcaaaaagtgggcaaagcaggccaggtgcagtggctcacacctgtaatcccaaaactttgagaggccgaggtgagtggattatttga

SEQ ID NO: 178173 - DNA, 254 bp, Homo sapiens
gtttggtgggaaaaatggttatgacagagcaggtaatgagtcagggtgcaatcagtaatcagaatgagtcagggtggagcaggtaatcgaaaaaggttgctttgtgaggaagtttaaaagtagaaggtaaaggattgaacatactgacatattgattctttgaaaagaaatttagaactcatatctaacagcatggtggcacacacctgtggtcccagctacttgggaggctgagtcaggagaattgcttgaac

SEQ ID NO: 178174 - DNA, 319 bp, Homo sapiens
ccagagaggctgttgctttcctccctccccagcccttccacccccagactgtatgttcttctttaaggttgagtcttggaattcagaacttggtgagcaagacctgactagaacagaaatggaaatgaccttttcatgcacagcatgagcatgacagagaatgggctgtgtgttaactcctctctgatattgctgaggtcctttccagccctaaaattctgtgatttttctgatacttgggcctttgaagatcctaatacccaatcctttctcaaacattaaatttgtagcagaggggaaaaattaaattcctcctttt

SEQ ID NO: 178175 - DNA, 309 bp, Homo sapiens
ctgagatcacaccactgcactccggcctgggtgacagagcgagactctgtctcaaaaaataaaaataaaaaataaacaaataaataaacagcagttggtatccaatttctacatacaatttggtaaacagtatctaccaaacataaagggccaaataattccatcttacccaaactgaaccacgaacactccccatcactaaggctagtaaataattaatactgaaaccagatctggaacacaagagaggatctctactttgttcacaactccctccccagtgcaccccaaaataaaaataattctctg

SEQ ID NO: 178176 - DNA, 411 bp, Homo sapiens
cagaatttttattaacatatttttattgaggctttttctattttgaattattataacttttatatacactggaaggtaagggaggtgttcaactttattgtttgcatatggctatctagttgtctcagcactatttgttgaaaagactattctttgccaccactgaattgtcttggcactcttgtcagaaatcaatttactgtatatgaaactgcctcagttctattccatctgtctttatgtctatccttatgccagtgccatacagtcttgataactgtactgttttattgctttgaaatcaggaagtgtgaactctccaactttgtttgttttcaaaactcttttggctattcagggtcccttgcaattccatatgaattttaggatcaactttttcatttctgcaaa

SEQ ID NO: 178177 - DNA, 700 bp, Homo sapiens
tcttctgggcagcgctgcctctgctcctgacagcccaccagcttcctcggagccttcctgctgcagccgctcagggagagcaggcctttcctccagccctgtggcctgcacagacctcctcagctgggcctccaaggaggagcaggagggtactaacatttggaacctgccttcaaggcacgtattcatgctttttaagcatttatagtttaacatcagtggctcggagaagacccatgacttaggaagtgaatctcttaagtactaatggattaaaataaagttgtagaaaacataggaagcccctaaatctgaacactgtgaatgcacctttctctgtcttcactcttttccctgcaaaacttaaagcgttaatatgtccttcaggaaaaggcaactacaagaatagagaaagagtttacattctggaacacaaaactctaccctaaatgacaaaaacaacagttacttgctctattttcatcttaccttagtgtcaaatcaacagtagcatagacacagctaataaaatgacagttttgattttggaaggcatgtaacataagccacaggcacaacttctcagaagagctgtgatcttttttttttttttttggagatggagttttgctcttattgcctcaactagagtgcaatggcgccatctcagctcactgcaacctctgcctcctgggttcaa

SEQ ID NO: 178178 - DNA, 183 bp, Homo sapiens
acatttccatcactaatagtgagtcacactagcaataatttgcacctagcttgtgaatcttaaagcccccaattattgaaggaggtagaacatagtgaaatgcaaacacatacctagtctatgtagttttatcttgaggcagttcacacatgaaaatgtaatctgttcttttgaatttcttaa

SEQ ID NO: 178179 - DNA, 523 bp, Homo sapiens
gagcttgaggcataaatatggatttttaaaatattgcattaagtattatttactataattaatgagctatttgggaacgcccttaaattttgtgctggcccttgagtgactatgcaatactgatcaagaccatagctcatccacacgctttccttccttcactaaacaaactcttcagagcattgctttgcatccaactgtactaggctgtaaggatgcagaggtaattaacaccaagtcaggccttcaagaatgtcatttgtctagtgggggggaacaaatcaatgccactttgaattctacatgcaccaataaagggagagtacaggataagcatgcccataaggcaggaagtctcagttcaaccccgtatgaaaccttccagaaaatgtttcccagggctatgatgctccagctaactcattagaatgaaaagtgtgtccgatgaagaacaaggctaagaggagaggtgccctgggcagaggagttagcacacacaggcgtgtccagattcagtcagtgg

SEQ ID NO: 178180 - DNA, 694 bp, Homo sapiens
gctcagtctgggagggtcttccgctgagcactgtgtgcccatcacgcgtggtgtccactgccagctgcccctgtgagtccctgtccttgcttggagcctgctgcttgtctcagatccttggacccagccctgaccccagtccagctaagctcaaccctgaccggtcctccttcgagactctttcagcctaagatctccaaccagacctgcccgccatgtcggctgcgcccggcctcctgcaccaggagctgtcctgcccgctgtgcctgcagctgttcgacgcgcccgtgacagccgagtgcggccacagtttctgccgcgcctgcctaggccgcgtggccggggagccggcggcggatggcaccgttctctgcccctgctgccaggcccccacgcggccgcaggcactcagcaccaacctgcagctggcgcgcctggtggaggggctggcccaggtgccgcagggccactgcgaggagcacctggacccgctgagcatctactgcgagcaggaccgcgcgctggtgtgcggagtgtgcgcctcactcggctcgcaccgcggtcatcgcctcctgcctgccgccgaggcccacgcacgcctcaagacacagctgccacagcagaaactgcagctgcaggaggcatgcatgcgtaaggagaagagtgtggctgtgctggagcatcagctggtgga

SEQ ID NO: 178181 - DNA, 662 bp, Homo sapiens
tttaatgaaaaacatgaacagtaagtgttgaggaggatgtagagaaattagactctcctacattgctggtaggtatgtgaaaggatgctgtgttccctcaaaaagttaaacaaaattgccacatgacccagcaattccactcttggctctttacccaagagaatgaaaaaatatgttcacacaaaacttgcacacaaatgattacacagcattattcataatagtgaaaaatgtctgccaaccaatgaataagcaaagggtggtatatctgcatggtggaatattattcaaccataaaaggaatgaagtactgatacatgttacaacatggacggaccttaaaaacatgctgagtgaaagaagccagacacaaaggctacaaaaaaggccatttatatgacatatccaggataggcatctttatacagacagaaagtagattcgtggttgccgggggctgggggaagggaaatacagaataactgctaatagggatggagtttctttgtggtgagttgaaaacattctggaattaaaaagtgatcatggttgcacaacgttgtgaatgtgataaacaccagtcagttatgcactttaaagaatacattttgtagtatgtaattgtacctcaaaaaataaagtgacaatcatatacactcaaa

SEQ ID NO: 178182 - DNA, 1088 bp, Homo sapiens
acaacttttggtgcatatgtgtcacacgccccgtttgtgacaagtccgtcccagacacactaatcacttgttgaatcagtcctgggctttctcatgcaactccatatggctgccacagtgcccagtcagtggaggaggcttttcattgtcatctccacatttctatgggtttcttgaggacaaggactactcattctgggtccctagtggctggcactgtgcatggctttccctctgtaaataagcatttgctggaatggggtggagttgagacttctccctgtgtggatcaccttctgtcttcaggttccagtttgacgatatcccttgcctggaattacctatgataccctcagtattatccagagttcagtggggactgcgccctctctggtcctgtgactttcctgtaacagtgcatcctcagtgtctgtggtcagctgacgtcactaagccatttttccacatatgccgcttttcttgtgtaattgtcttacttgggttcccaaactcagggtcttaatataagctctgagggaaaaaaaatccctctgtttttctgtgtctctgtcccccgggtgtgcctggcacagagacaggcagcattacctttgctgacctgaagtgaactcacggttttccccattcagtcctgcactattcgtctcatcccaactctaggctgccgagggatcttggctcctactcctgtcacctgatatgccacctgccactccaggcccagtgaatgagcttgttaacactgcctttctattctgggattcgcttggtcattcagaatggtgaaagaggccagcaatcgaggtgcacagggcctggcagcgtctggctttgcacactggacacacagcctatgacagttggtgaaagccgggcttttgtgacctatcgccagggtttgaagtcagccctccattgacatcagccctccagaagtgagggtagtttttttgaggctctttccaagtaatacttcccaggctgggctctgggatcttagggctttggaaaggtagcagcaaagctcgtatgatacagccagtatttgaaaagccacattttgcatt

SEQ ID NO: 178183 - DNA, 443 bp, Homo sapiens
ttcattccagcctggacaacaagaacgaaactccgtctcaaacatagaaaccattagtttatactcattaatcaaatttctaaaatgggacccaaaaaaaaaaaaaggtcactactccatagtactccatgagcaacctcaggtttctgacaacatagtactccaaagtatggcgccttgacatagtaaatattctaagacattagtagaacaacatagacaagaatgttcgtatgaccttcctctgaagcaggtcttaagaccctcctgggagtcttgcagagtatgcgaggaatctgaacaaataaaccttgctagatttctccttgtttattatccttagctcatattatttttgtcttgttatatttctgcatgactctcttcatcaaacctagtgcaaacacactcaggtttaagcccttcttcaggtccttatttcc

SEQ ID NO: 178184 - DNA, 1257 bp, Homo sapiens
gaccagaggtcactctcatggacatcttgcttttggtctgatttgtccggcttctttacaacctgttttatcagcaaggtctttatgacctttatcttgtgccgacctcccatctcatgctgtgacttagaatgcgttaattgtctgggaatgcagcccagtaggcctcagcttcattttacccagctcctgttcaagatggagttgttctggttcacacgcctctgacaatacaattcccaattgataagtgataccttggaatcagtgtgaattatttttacactactgcacacctgggaatggtgaatgtgtgaggcctgtcctctctcaggctcataggaaaagacagaaatgatcttgcttctttagggattgacagaacaaagacaaaggaccctagactttgggaatagaaatctgttgaaatgagctggaattggtaaaataattgattttgtttatgaattgataaaagcctactttcaattcatcaaatattgttgagcatgcaacagtatgctcccgtacctaaggtgcagtctctgccttagagttgtaatccaggaaggggctgcaagagagactcagaagatgtggtctgacaatatataagcacaatgtctgacccttaaagaatgacaggatttcaacaggcagacaggagaggaggaggaattctaagcaaaggctttcacatgtaaacggtgaattcttagataagatctgttttctatataccaggaacagtttgctggcatttgaggacgaggagtaagttcaaatgaaaactttaaaatgtttccccaaagtgttcatatgaaattttaaggatgtgcctatggactgggaataatcaaataacataaaataaacataaataacataaaccataaaataataccattttttttctacttttaaaattgggcccagaatatagcttgcagtgttttcttaattgataaaacttcagttcatcaccttcaattaatatgttaatgcatgaccatttgctttgtatatatctaggctatatttataattgtggtctgtcttctttggccaagtatgtatgtattccgttatctcttagctcctttgtattcaggctatgcacatttattataatattgctctattccatctttaattaggcaagcaaatattctaataaaaagtttcaaagtgaattttgcattatccagtactagatacatattctgtaactttggggcaagatatttgccaggctta

SEQ ID NO: 178185 - DNA, 724 bp, Homo sapiens
tccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaaggcaagtcttgggatctgatcactcggctgggagtgggtaaaatacctggacctcaggaggccggattgcagcgccagtgttctctacctgtgtggcctgttcctgcctggggttgggtaccaagtccaggtggaagtggtccctggagcatcctctctctgaagtgtttctttgtcaaacagaatactccctgctgctgccccagaactcatcactgttgacacatggaccaagaactagcagaggaggtgatttataatctctaaatgaattgctctaaaagagacaacaagcactctgacttaagtaaaggaagggagggtgggtggaaaggaaggaggatcataaagaacattctagattgcatactttggtaatcacagcagggccttattgcagttagaacaaaagcctggacacacttacctctcagttcaggaaaa

SEQ ID NO: 178186 - DNA, 799 bp, Homo sapiens
tggagtgcagtgacaagatcatagcatagttcactgcagcctcaaactcctgagctcaagcagttctcctgcctcaggcctctcagtgttgggattacaggtgtgaaccaccatgcctggcccatatcaaaatttatttgaggggcagagattgctactagagtcaggagtactaatagtaaattgtaagggacactttactacctgctagcagagagaaatataatgggaaagccacagatttggtgttggagagaattccagagccattaagttagagaagacagcctcactagcacctagagggcatctttgtacagtaaaatacttgaaatggttcaattggaggtacatggttcaagaaagcaaagatgtctataagacattttagggcaattcataacacaattattaaaataagaccgttttggcacttttaaaagcggtgacctattcaagaactagaaaaccggaatttttcattatattcaatttttgcccaaaagtttaagaggaagtattatactagtttcagtatatatttgccctaattttatcaaggtgtaatatattttcgtgatggtgagggtggagagagaacacagtgttcacatccaaaacataacttatgttcaaagggagaagtaaatctaaaccaccaagctgttacctttgaaaacaattaatggagtctattgtgttttaaccaaacattttagattaaaggattttgtattaaaggcaattcagatactccacaactcaaagataatgttggaatctggtttaaataaaataa

SEQ ID NO: 178187 - DNA, 637 bp, Homo sapiens
ggtttcaccatgttgggctgggcaggctggtctcaaactcctgacctcaagtgatccacctgccttggcctcccaaagtgctgggattacaggcgtgagccactgggcttggcctgagcactttttatagtgtagcaattatttgagcattcagatttctaaagtaggatgcatgtggatggtgagtaaatggtagcagaactcagataagagtgggatgcagcagtcaggaatgacacccattcttttaaaccaagaccctgagtggggaaggcaagtcaaccaacactgactgtaggatcaactcaaaagctggtctttacatgggaacacattctggttactctaatggctttaagtcttagcaaccattactccgacatatactgcgtttttgactgtgactataactgccagcccatatctaaggtgcatttgcataccataccttttcctttttgatgtagccgtgataaccatcagcatgctttgctcaagtacttcatattcagtaggacttaccagataagaaactcaggagctgctcctctctgagccaatgagaaactcagttgctgctcctcccaggggcacttatctttagttgagttagcctttaatcagattgccattataa

SEQ ID NO: 178188 - DNA, 585 bp, Homo sapiens
tgtatcctcactgcctagtgcaagcctgccaaaagcatctgtagaatgaataaatgaatacataaatgcattttttgcatggatttaaacattaatgtttcatatttgaattttagattcaagagttggaaaaaaacagagacctagccaaaatgctggcatacaggaaatggttaatgaggcagtagagtatgtatgtagtaataggaacatgtgtttttcattctcattactgtttcaggacgaggctcataatgtaagccaaatggaatatggttaaggcttttgggtctggagtccacagagtctgcatttcaggttcagtttctgcagtttactaagtgtgaccttcggccagttacttaatctctctaagccttttctgtcatctacaaaatgaagatattaatagtactgcttatagcatataaatgttgagacttaaatacaataaattgtggttcatacctgtaatcccagcactttgggaggccgaggtgggaggattgcttgaccctgggaggcggaggttgcagtgagctgagattgcaacactgcactccagcctgggccacagagcaagac

SEQ ID NO: 178189 - DNA, 184 bp, Homo sapiens
cccactgcagatctgctgtttagacagatgcagaggtgactgataagccggggtcatgtggcttcaggagtcttaggtttctccatgcagcggtgtcaggataggctcaccagctcctggccacagtgggtaccagcgacctccttgttgctgaatccaccgaccactctcggtcctcatcctg

SEQ ID NO: 178190 - DNA, 188 bp, Homo sapiens
acgcaaacccgtgtaaatagagctaatatttcaagggaggtcatgctgtatactcttcccctgagaatagatgatggctgactgccggactgatatgaaatttatctttgtgagggagaagaaggattgtgtggcctagagggcaatatccagggcttgtgaatcctaagaggggccgagatacatca

SEQ ID NO: 178191 - DNA, 476 bp, Homo sapiens
agcccagtgaatccgttgagttcactggcccaaagctacagtgactcaggaccatatgcccctgcacccctctgtgaaggtggtcagaagaactagactcagcctgccattggccatatgcctacagactcatgtccctcaatatatgaaagccttgtccctagtaggttttctctaggaagtatacattgatcaccctttttacaggtaagttatgttatgtaatggtagccgtaagttaagaaacagataaaggcaattgtgttttatttgtaccatcaaagttatttttattaaagatttttatgggttcttttgcttttgcttttgcattgtaggctttagagttgcaaatcttagatctctcttggttacttttattgtgatcataaatataatatgattcaagaatcaggtgtaaaattaccatgtccacactgtgattctgcaagattttaccaatgaaataagctgca

SEQ ID NO: 178192 - DNA, 389 bp, Homo sapiens
aacttggtttaaaagaaaacctaaaaacctctctatcaaaatatgagtattaagaatgatctgaatatgcatcatggtacatgaagctgctccacagcaaggaggtgggaggctaagaaaacaccacctcggtagataagttaacatttaccaaatgcctagtggatgcacagctgcttattgatgaatgtcagcttcagcatcttggtgagagtgcgtcacatttcttttttcctagaagaatctctttacatatttcatgcttttggagaggcaggtatgtctccatgataatatacatgtaattagctccttaatgttaccaatctatcatggagacattccaatttacattatacacaagctcactattagtttcctgagttagg

SEQ ID NO: 178193 - DNA, 301 bp, Homo sapiens
attgtaacaggtgctccaacagaatgtgctgctgacctggataaaggatgtgagacagatgatcagggatgaatccatagtttgaggttcaaacaaatgtgtagaatgggattatttactgagatggaaagcaataggaaggcagaaaattttaggagagaaactcaagatggtaaacgccaatcagaaatccttaaaacataccatggagcttaacaaattgatagcatgatttagctagaagaagtggcagacgatttctagggagcactagagaagagccatcacttctcagagtatg

SEQ ID NO: 178194 - DNA, 217 bp, Homo sapiens
caggaaacttagactaactcacaaagcaaaagtattcctctgcaaaatccgcagggaaatgagtattgccagtgtcacttgggatctctgagaaccaggggtaggatgaaagttagtaaatatgtctgagactaaggactctggatgctgggtgagcattaatagaggttcccttttccccttgcactatcaccctggcatggttaggtctacctgg

SEQ ID NO: 178195 - DNA, 496 bp, Homo sapiens
caaaatattatttaatgctaaacagctattctgttgatagtacaggttgagcatcccaaatctgaaacctaaaatgctccaacattttttgaaacattttgagtgctgacatgtctcaaaggaaatgcatagtggaacatttcagatttgagatgctcattcagtaaaacgtaaatattccaaattctcaaaacaatccaaatctgaaacacttgtggttccaagcattttagataaggaatactcaacctctacataatgatgtaatgcacctttcctgtaaaacgtcatgcctttcattaacttatttcattttatatactggtattaacctagtttataatatgaactgtgtaaaacctaacataccgacccccctaccccccgccacttttttttcgagacagggtcttgctctgtcatccagtttggagtgcaatagcgcaatgactgctcactgcagtctcaacttcccagactgaagcgatcctcccgc

SEQ ID NO: 178196 - DNA, 283 bp, Homo sapiens
gtgtgaatgatgggggattgtgcggggctgctaggcttctctgactctaggagagggaatccctgaagtagaagagacccatgtccactgtcctgtggtataagagaatgtgccaaactctgggatagcttagcatgtggatgctggaaggacttaacatcaaacaccatggccctgggagccacagtcaagcactcctgtggtcccacttggttttgagggaaaagagcacgtggtttaaagttccctgggtcacttgtatgatacgtgtcatccgactatt

SEQ ID NO: 178197 - DNA, 443 bp, Homo sapiens
cttttcttcttcaaaagatgcaaactttaataggcaaattatgttgccacccactgcccacccaaaaaaaccctactgagtaaaattagcactccaggaagacaggtcatatttatcttgggccattgattacattttccaaactgctatttttggaaggcacctcagcttgagaagcacaataataaattggatggatggaggaagagatggatgggaaagagcctggagcttagaatcagaaaggcctgggtttgaatctttgctctgccacttaccagacttaggcaggtcttttaacttctataatatagttcctgcattaataaaatgaaagtaatactacctacctcattctcataagagttaaacggtgttctgcaagtcaagtgcttaaaacagttctgggacacataataaacttcgaacaaattgagcttcca

SEQ ID NO: 178198 - DNA, 239 bp, Homo sapiens
gaaatatacatctgccactaaaaacattagtgtgcatcttacatgttgacagaaatgatgtcctggacttgtgggaaaataaaatagtttgcagaattgcatatagtggatatgtgtgtagaggcagaaggagagccagtgagcaaacaagagagagagacagaaatagatactgacagacgaattcatcaaattatgagagtgttatggcacgactggtttggtgatgagactgatga

SEQ ID NO: 178199 - DNA, 249 bp, Homo sapiens
gatctagaggatcgtcattcataccagaagaggacagctaaatcagagagctatggaaagttttctggtggagttgacatctaagctgagtgcgaaggcttttgctaggcaaagaagggaagaaaagtttttcagatagaggataacgtactggaaaatgaacgaaacaaggtgaagtatctggaaactgtaagtaatttggtgtgactgaattaacttaaagcatgatatgtttgggtaggaataaaa

SEQ ID NO: 178200 - DNA, 164 bp, Homo sapiens
tctaggaaatgtggatacaacaatggacaaaacggacaaacctatgtcctcatgtagtttacattctaaggcctataaagtattgtctatttgaacacataaaatgtattctcccagtttgggcagaaacaggacttctgcaaggcctggagaagtaaggaaga

SEQ ID NO: 178201 - DNA, 211 bp, Homo sapiens
taagattgagttttccttggctcttccccattcatttagattttagtttgatgggtcaagtatatttctttaaaaatgtgtatctcttattgtataattgagtggaaagtgctgagagtacagtctgaatgcaaagaatacactagagaccgctattggaatgcctgaactgtgacactttgtaagtctcccggtgaggatgtttgcagtg

SEQ ID NO: 178202 - DNA, 446 bp, Homo sapiens
cgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcctgtgtagccat

SEQ ID NO: 178203 - DNA, 575 bp, Homo sapiens
agaaggcaggaagcttatgtgtacaattcagttttgcattatcctgggtagagccaaagagactgaattggattctaataggttagaaagacaaatgaattagaagcagccaagatctgcaaatttccacacaagtctgtccatttccacgggggtcttttgagtgattttcactgccatgccaagtgttttcagtgacctactcaaaactggaggaggagacacagtacgttgaacatctacctcttctctgagcttcatttcctgctctgggctccatcctctggtcctcatccaattacctcttgctctgacataccgaagcctgccttttaatgccaaaatttattcattctttcacacatcaaatagtttattggctaaattctgtgtacctggtaccatgccaatcaaaatggtggttcctggtcaggaacgacggctcatgcctgtaatctcagcactttgggaagccgagttgagtggatcatttgaggtcaggagtttgagaccagcctggccaacatggtgaaaccccgtctctactaaaaatatacacaaattagccagccagg

SEQ ID NO: 178204 - DNA, 340 bp, Homo sapiens
tgaaatgaagctaacgtttaactccagtcacttggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaa

SEQ ID NO: 178205 - DNA, 141 bp, Homo sapiens
agctcctcctctacaggatacatttcatccagctactcctctacggacacatttcatccagctcctcctctacggacacatttcatccagctcctcctctacagggacatttcttccagctcctcctctacagacacattc

SEQ ID NO: 178206 - DNA, 424 bp, Homo sapiens
ataataaactcactgtattttctttcattaaataagcacagattgaatgtccccttaccataggcaaatggctgtttccaaatccactgtcatacttcttattgtcatgcactgttcatgaaattatggaaggctcggtaatgttcagggcaattggattcattgatacataaataaatgcatttctgtcttcattgggaagcaccctccctgctcttggtgtccctgtttgtcagcacctctgttgtcctttatctaaataagctgcaggaggtaaggattgcctgtaagtgatttttgtagagggtttagtgtgccctgttattaatcattattaatcatctaggcattctgaaatagtatttttcagattgtgtggaaataagtatttctacttatttttggtaggattaaattatccaaa

SEQ ID NO: 178207 - DNA, 412 bp, Homo sapiens
tacaaacctttagctagacacagagcgctgattggtgtgttggcagtcctttagccggacagaaaagttccccaagtccccactggacccagaagcccagccggcttcacttttcactgctacttatccctggctgctgcataaacaacccccacaccttccctgggatcttgacaaccttgtgaagccacagtgatggtccctgcacccactcccacgcccttgtccagctctagaggcctcctgtagcccaacccacaagccacaaaatgaggaccatcatggcggtgccggaaatctcacccctcaatgcccacctggaatcggaagtctcaaaacctgtgtagcatatcacatgcagctgggtcgtttcctggctaggttaccctgtcaggatctgtgacttttctgt

SEQ ID NO: 178208 - DNA, 1633 bp, Homo sapiens
  misc_feature (696)..(696): n is a, c, g, or t
gatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagangagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagag

SEQ ID NO: 178209 - DNA, 216 bp, Homo sapiens
actgggccaggtgcagttaagggacacccgccacctcccctccttaacccattcaatgccaccgcgccacctaggcgcagtgtcccggccgcctcaggccgcaccccttcggcccttggtccccacggcctgaagggtggtgatgaaatacacggagcactgcgttaggagtcagtgaaggaaacaatccgggctgtgcactggctgagtgacctg

SEQ ID NO: 178210 - DNA, 378 bp, Homo sapiens
aaaaaggatcccatgcatcttcttaatggttcttttatcctgtctgcaatgtaagttgtgaagaattaccatcttaaagacagagtcagaaacaggattaaggtttggttagtttaaacaccattacccattaaaaattaaaacagattactgcaatagcatctccataatgttcattatgaagaagataataaaagggacaattgtgcttctgcagttttacagtgtatatatccaaaaatggtactcaccataaaatgatttaaagaaaacatcctacactatggcaaatacaaaaagcgaaggaaaacataagaatgaccttgatcactattttcatttaccaatgtaatagagctcctagcatgctcaattaga

SEQ ID NO: 178211 - DNA, 370 bp, Homo sapiens
tttgaaggtggagttttgcccttattgctcagtctggaatgcaatggcacgatctcagctcactgcatcctccgcctcctgggttcaagcaagtctcctgcctcagcctccctattggtggtgttacacagcagcatgtatgtgtgcatggctgtgtgtgtacacagacttctgtagtcacatatgtccatgtacaagcccatgtccacatgtgtgtacacacatacatgcagcagataagagacaactgcactatggtcgggcatggtggctcacacctgtaatcccagcactttgggaggccgaggtgggtagatcacctgagtcaggagttcaaggccagcctgaccaacatggtgaaaccttgact

SEQ ID NO: 178212 - DNA, 394 bp, Homo sapiens
tggttcctggcttgtagacagccaccttctcattgtgtcctccaatggcctctgtgcattcgcagagggagagatatcttctcctctttttataaggacaccagttctattgaattagggcctcactcctaagacctcacttgatctttattacctccataaaggcccatctctaaataaagtcacattgtggggtaggccttcagcatatgaatttagggggacacaatgcagtccataacaaaagccaccttggagccatgagtgggcctaacgttaggtatgcatggtacaaatataggatgaagccaactatgaggcaagaaaactaggaagctaaaaagaggttcataagtcccattgttaagtagttggattaaattcctcttttttt

SEQ ID NO: 178213 - DNA, 365 bp, Homo sapiens
acaatatcctttctgcttaaggcagggctgggctaaaggcctaaccaaggctcccactgtctcatccttcactttgcagagagctccttggtccagaaaaggtctttgtacatacacatgtgtctctgttccaatttccaaatgagcagggcaggacatacccaacgcttaggtggctactgttgcttgactgacactgggttcagcagaggtgggaaggaagtgttcccagggacagggagctcacagcggccttgagggagaaagacactgttgctctgttatgaggcacgtgcagagtaaataaggaagtggtgaaaagcctgtgtttttaactgtctggggaatgagtgattgctatgcat

SEQ ID NO: 178214 - DNA, 293 bp, Homo sapiens
ggtagaggcgagaaaaaagaggcagaagtaaacttcttcaaactgcatatatgacaagagtaactggatggctctgagaaagcagctttcatagcaaaaaggaaagtgtgtaagagaacttgatgcaacgccctgttgacaactttgtcactgtttagatactcccctcccttttaggtacctgaatgacctcaggtgaaaactgattttgaaaagagtcatctatgcaaatcctagacagaacattttttactgatgaatatagaaagggtgtcgatgaagggtttcgatga

SEQ ID NO: 178215 - DNA, 378 bp, Homo sapiens
ggtagaggcgagaaaaaagaggcagaagtaaacttcttcaaactgcatatatgacaagagtaactggatggctctgagaaagcagctttcatagcaaaaaggaaagtgtgtaagagaacttgatgcaacgccctgttgacaactttgtcactgtttagatactcccctcccttttaggtacctgaatgacctcaggtgaaaactgattttgaaaagagtcatctatgcaaatcctagacagaacattttttactgatgaatatagaaagaagaaagctcctttatctatttgacaagctctttttcatcggcctgtttaagattttgcatcagctcttcagtatcaaagtcaagatcctcccagataaaatccatgaa

SEQ ID NO: 178216 - DNA, 270 bp, Homo sapiens
tagaaggctacactggaacccagaatcccaggatgaagtggacaaaagtatgctcatctggcagttccgtaaacacaaacttaaccaagtcactaacctctgccaaccaaccaaacgctacgtagcaactcattctagtgataaatagttaagcacaagaactaggcaattctcatcagacaatgtacccagctgcaattccaggatgtggaactagaacgctaagttctagaaaaaaagaatccttacttttcttatgtcttactcctt

SEQ ID NO: 178217 - DNA, 398 bp, Homo sapiens
tcccgttgatatgatttatcacattggttgatttgcatatgttgaaccattcttcagctgaaggaaggagtccttctagaagccacaagctgtgctttctgttttgggggaggggtgacgtaaacactccattggctgccccagctggcgtctcactaggttgtgtgtacctgaagtgaactggctcagagcccagcacagcaccaggacttgtccaggaattgcagtccttgtggcctagactgcctttcatttaggaccccagagcactttggtctgcagtggcagggcttgccagaagtcaggttccaactactgggaaggacaattcatctctggctataaatatctaggtgtctaggtatcaatatatgcaaatctaccgtgacggtatcctc

SEQ ID NO: 178218 - DNA, 218 bp, Homo sapiens
tctataactgttccatgtcattggtcattgggttatgccccttctaacctgtacatgactctacacatctctcttttaactgtctcctcctctccattcctttttaacaccgaattagttaagaaccctatcagtgttgtttttgttttaattttttttttttttttgacagagtctcgttctgtcacccaggctggagtgcagtggcgcaatctcag

SEQ ID NO: 178219 - DNA, 615 bp, Homo sapiens
  misc_feature (564)..(564): n is a, c, g, or t
cccacttataatttttttctcttccctgccatatatatagtttataactttctatattatttcaactgtaaaatacaaactcgtttttacaaaacgaaaaacgcaacttaaaaaatggttaaactattaggctgagcacagtggcgcatgcctgtaatcccagcaccttgggaggctgaggagggcggatcacgaggtcaggagtttgagaccagcctggccaaaatattgaaaccctgtctctaccaaaaatataaaaaattagccaggtatggcggtctgtgcccatagtctcagcctcctgaataggtgggatttctctacacccagccaacttaatgttttataatgtctcttattttcttatttaacctcgttattgggatgttgatttacagtgaagaatccattgcattagtaagggtgatatcttagtattttgcttcctgggtgagctagctttgcttatttctgtttgttaactaggccttttgatatttttatagacaatctgcttcatcctgattctgcggcattccaaactgtggtatccttgggggttcncttaacattgctatggtgccagaagatttaaaatcaggtatggctgtgggg

SEQ ID NO: 178220 - DNA, 718 bp, Homo sapiens
cttatataacaaagtcactatttacactatgccagaaaatgaattctgagcaactttaaaatatgatgaataatcttatacgtaaactttaaaagttaagtatacggctgggagcagtgtctcatgcctgtaatcccattctatggtatgtcgacaaccatagaatggaagaaaaaaagaatttgagattttcatgctctgccatactgattttttttttttcaccaaactttctcatcagactaaagtgacagcaagcgaatacaatgttttaagaaaaggatgaaacaacccccaaatgcttcttaggactccattttcaacatggtcttgaaatcactcactaacatgaggtcacacaggcaagaaaagacagaggcagagacagaatcctgaggacaggtgttgcctccactctcctgtctttggccccacacaccctgagccacaaatcctttttccttgagaaataggatcgtacatgaatcttcttatacattctgaatgtctccttacccacatttgctcatattcaggccttgacattaaaatgacatctgatatttttaggctcaaatcatattttgtcttttaacttttaggttcaggggtacatgtgcaggtttgttatacaggtaaacttgtgtcatgggggcttgtggtacagattattttgtcactcagatactaagcctagtacccattagttattcttcct

SEQ ID NO: 178221 - DNA, 516 bp, Homo sapiens
aactgggggatcgcacctaaactgggcgcatcagatataaatggggcagaaagcgaaatacaagggtgaacacgaaaaggatgaaacaacccccaaatgcttcttaggactccattttcaacatggtcttgaaatcactcactaacatgaggtcacacaggcaagaaaagacagaggcagagacagaatcctgaggacaggtgttgcctccactctcctgtctttggccccacacaccctgagccacaaatcctttttccttgagaaataggatcgtacatgaatcttcttatacattctgaatgtctccttacccacatttgctcatattcaggccttgacattaaaatgacatctgatatttttaggctcaaatcatattttgtcttttaacttttaggttcaggggtacatgtgcaggtttgttatacaggtaaacttgtgtcatgggggcttgtggtacagattattttgtcactcagatactaagcctagtacccattagttattcttcct

SEQ ID NO: 178222 - DNA, 274 bp, Homo sapiens
cttggtttttagcacagagttcttgggggcttgtcctcacctgaacagaatgggaaatcagatgtatttttagaaccctgtagagagaagaataggagagggaaaggagtggaagaaactcaaaaccagaggggagtcctttcagagaacagggagaaagatacatggagatattttgaggtttagaaataaagtcaaactttttttttttttggaagaaaaaaagaatttgagattttcatgctctgccatactgattttttttttttcacca

SEQ ID NO: 178223 - DNA, 321 bp, Homo sapiens
tcaaggtcatatagcttataaaagccagcttatgtgaaatatgggtatacttatgaaaagtttattatgctaaagtatatgtaatacaaaatttaccattttagccttttttttcttttctttcttttcttttcttttttttttttttttttttttttggccccccaggtaaaagtgccgaaccaaaatcagggcccacgtgcgccccccacctcgtgggccccaattggaaccctctaaatagcggccccccaaggtgctgaaaatcacgaggcatgaacccatgtgcacgtggcccattttaaccctttttaaggttgt

SEQ ID NO: 178224 - DNA, 408 bp, Homo sapiens
ccctccacagaaggtacctccctgacacctcagcacctgctggcccctgcacctgcctcctctcctccacagcaggggcctccccgacacttcagcatcttcttcacgtgtatcgctgtccctgcacagcccgagcccacagggccaccggctcctccaggccagggctccacctgttgtgttcaaggccaggccccactggatctgccccacgacctccactgaggcctggggtgcagggtgcatgtcgactcccacaggtatgacaggtgctagtgaggggtgaatgagggactggcacctgctcaccccacaaaagagggctcttccctgagcaccgtcattgtaggagccgtgacccccatctgtggggaacgataggtggggggcacagtgatgaggatgtgg

SEQ ID NO: 178225 - DNA, 164 bp, Homo sapiens
acagtgagcagtgatggcgcaccactgcactcccagcctggatgacagagtaagaccctgtctcattctttaaaaaaaacaaagcaaggcaaagcaaagataatggtctggacgttattcataatcactaaaattggaaataacctaaatatccctcaactggg

SEQ ID NO: 178226 - DNA, 215 bp, Homo sapiens
aaaaatacaataaagatttacagaaaaagagaaaagaaaaacccagatgcagctcaactcccacacatgaatgggatggagcggggagtatattttaaagaaaccatgttggctgggaacggtggctcatgcctgtaatcccgtaaatgtagcctcagtttcctcagctgcaaaacgggattaacaccgttcctcagacctcatgtaagtgacat

SEQ ID NO: 178227 - DNA, 627 bp, Homo sapiens
tgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatt

SEQ ID NO: 178228 - DNA, 786 bp, Homo sapiens
tttcgcggagccttggcggaaaccctactgggagccggtgtgtcccccagtaacatttgcaaatgaaagaagaggcgacctgatgtctaatgatgacactgctcttatgaccaaaggaatgtgagctcgtatattcttttagaatttcctaaggcactcatgaaaggtggccgggtaccactgtatcaatggcccagttgcccatctcctggcgagagatttccctaagtgacctggaagtgtcactattaccaccaccccacatgaatcttgtgctggaggcgactagagctgtgtgtccctcagcagaagcaggtggcataagcaagagttccattttggtttcattttcagaggaccccaattgcgcagtctgcaagaaataatgtgcctctcaggatggttccaagctgagcccaaatcactgagggagattcactgcttgctaacatgaactttattcctggataaacaagtcccaaaccgtcttgtccatatgccaccacggtcaggtcaaaacacacattatcagctgggtgcggtggctcacgcttgtaatcccagcacttcgggaggccgaggtgggcggatcacttgaggtcaggagttggagatcagcctggccaacatggtgaaaccccgtctctactaaaaatacaaaaaaaaatccggggcttcttttgggtgcgggaaaaaagtattaaaggcatgggatttgttcttggcccctcttgttaagggaaaagcggcccccaaagaggagaatttaacgaggaacttataaaa

SEQ ID NO: 178229 - DNA, 724 bp, Homo sapiens
cctcttaaatcttctcccctctgctttggctttctatatgctactaaatcaatgcttgctcaataaaatatctgcttgcctaccagaatatgaattccacaggagcagaaactttgccttttttgttcactgctatatccctagagcctagaatggtgtcttatatgtaacaggttgcggaatgaatggggttaaattcacaatataaacaggtttaaaaaaaattatctatagcaggctggaagcggtggctcatgcctgtaatcccagcactttgggaggctgaagtgggcggataacctgaggtcaggagttcaagaccagcctggccaacatggtgaaaccccgtctccattaaaagtacaaaaaattagctgggcttgatggtgggcgcctgtaatcccagttactcgggaggatgaggcaggagaatagcttgaaccccagaggcagagctgagatcgcgccactgcactccaccctgggcaacaagagcaaaactccgtctaaaaaaaaaaaaaatctatggctaacagaattcctataaaaacatatagtgttcaatacttatttacttatgaaccacaattactaaattgggatcacagtactttctattcctaaaaattgaaaaatcatgtagaagtacatataaaagtcataggacatacatgtacatatatgactaatccaactatttcaggattcaacatgcatattccct

SEQ ID NO: 178230 - DNA, 529 bp, Homo sapiens
cctcttaaatcttctcccctctgctttggctttctatatgctactaaatcaatgcttgctcaataaaatatctgcttgcctaccagaatatgaattccacaggagcagaaactttgccttttttgttcactgctatatccctagagcctagaatggtgtcttatatgtaacaggttgcggaatgaatggggttaaattcacaatataaacaggtttaaaaaaaattatctatagcaggctggaagcggtggctcatgcctgtaatcccagcactttgggaggctgaagtgggcggataacctgaggtcaggagttcaagaccagcctggccaacatggtgaaaccccgtctccattaaaagtacaaaaaattagctgggcttgatggtgggcgcctgtaatcccagttactcgggaggatgaggcaggagaatagcttgaaccccagaggcagagctgagatcgcgccactgcactccaccctgggcaacaaggtcgacgcggccgcgaatttagtagtagtaggcggc

SEQ ID NO: 178231 - DNA, 286 bp, Homo sapiens
gtgagtgatctcagcggaattcccctttaagcttcctagtagcgcgtgcaaaaaggaaaacgtgtggatctaagactgtgcacaaacaaaagctgttcttctgggaggaaccaatccctcagcaatcacacttgactccctcgagggaaagctggaaggggagagggcgtcaggatgcgggtcccggtgtctctgtgcagctcatcctccttcagaggcccctctgcttctgtccatccctccaattgccagtggtgtcagcatttggggccgtgatcagatggag

SEQ ID NO: 178232 - DNA, 180 bp, Homo sapiens
aaaagaagccaggcacaaaaggctacatgctgtccagttccatttatataaaatatccaggataaattcacagatacagaaagtaggttggtggttatttggggttgggaggataaaagaatagagagaaactgcttgataggtaagggatttttgctgtgaagtgatggaaatgttttg

SEQ ID NO: 178233 - DNA, 619 bp, Homo sapiens
tgagatggagtctcactctgtcgcccggctggagtgcagtggtgtgatctcagctcgctctaacctctgcctccagggttcaagcaattcttctgctgcagcctcccgagtagctgggactccaggtgtgcgctaccacgcccagctaattttcgtatttttagtagagacggggtttcaccatgttggccatgatggtctcaatctcttgacctcatgatccgcctgccccggcctctcaaagtgctgggtttgcaggcatgagccactgcacccggcctttttttgttttgttttgttttgttttgttttttttgcactccagcctgggtgacagagcaagactgcctcaaacaaacaaacaaaaagagacagcctgtgtattagtaagatttctttcagttccaagtggcaaaacccagttcatactactttaagcaaaagtaagaacttactggccagtgtctggagaggccagggttagtgcaggcatggctggatgcaggccctcaaagggtgctgtcaagaatcagcctctccccacatcactcagctctgctgttctttgagttggcttcattctgtggcttgctttttttatatgatggcccatagcggc

SEQ ID NO: 178234 - DNA, 881 bp, Homo sapiens
ttgggtgtgggaaaggctaaataaactcccatataaacctgagaattgtttcttaaaatttccatagcttgaaacacattcttgccccttttccacattgacttaccatgaatcgctgatacagtaaacactgtattcattttaaactaagtattcaagggctgggcacagtggctcatgcctgtaatcccagcactttgggaggcagaggtgggtggatcacttaaggtcaggagttcgagaccagcttggccaacatggtaaaaccccatctctactaaaaacacaacaattagccaggcgtgatggtgcatgcctgtaattccagctacttgggaggctgaggaaggagaatcccttgaacccaggaggcggaggttgcagtgagccgagatcacaaaactgcactccagcctgggtgacagagcaagattcagtctccaagaaaccaaacaaaaaaaaaacaagttttcaaaatagaaccaacacaggagctgtctagaaatataagaggaaaaaaaatcaagaaaaggaacagaaaaagaatgggccaaaaaacaccagaaaaaatatccctatagagcaggtgaaaatttaggccaaatattttgtcatgaattataaaaatttaatgaaacaattatcactgtagaacaaaactaaaaagcagaaatacaaaaactcaacagagctcagttagaagcagaaataaaaatatcagagaaatgaaaaaaatgagggaaagaatagactacggaaactgaaaaagaaggcaggaatgagaaaagcaagcagagctgaacaaacatggaaataatagagtaaaatgtgaatgttatgaagctctacagtgtataatcagcaaaaattgagtggcaacc

SEQ ID NO: 178235 - DNA, 302 bp, Homo sapiens
acagagctcaggggcagctctcgcagaaggtggagaacttagacaaattttcattcatagtcaacagggtcccaggctcccctttcttcgtttttcatttacatgtaaatagtggggggtcgggggggtggtaatggagaggggattctggagctcagttcctggggcaaggggtggcaggagaccttgaagccagtgaggccggttctattgcactctttcaactcggtggaagcagaagtactataaactttgtagattcatccttgagggccctgcccagaaatagaactgtacagtcc

SEQ ID NO: 178236 - DNA, 185 bp, Homo sapiens
catatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgcc

SEQ ID NO: 178237 - DNA, 283 bp, Homo sapiens
cttgctgcgtctccagctagtgacacaatctaattccgtttcagtgtgtcctgggacccatggcactgtcacaggctcagcgctttgacatttttcacctggttgtctgcgctgcccactcacagatctttctcactctagcctggcggcccctttccaattcatccttctctgtgcttctgaaagatctgttaaaaacgtaaatctgggccgggcgcagtgactcacgcctgtaatcccagcactttgggaggccgaggcgggcggatcacgagatcaggag

SEQ ID NO: 178238 - DNA, 273 bp, Homo sapiens
atgatgtgcatgacagcttgggctcaagaggggaggtgaccttagcaaggaatagaagtggcagttctgatagtgtggagatgatctcaggcagaaactcccaacagcagttggcaagggtcccagcatcaattccaaagccccactcgtagaaggtcacccttaaaagatcttcttctctattacctttagtatcctgtcccttccaaatgttcctttcccattccctaattatccattttcagtgagagcacgagattagccaagcttgca

SEQ ID NO: 178239 - DNA, 438 bp, Homo sapiens
ccaggctggggtggagttggtttcaggatgattcaaatgcattacatttattgtgcactttattattattacattgtaatatataatgaactaattatacaactcaccataatgtagaatcagtgggagccctgagcttgttttcctgcaactagatggtcccatctgtgggtgatgggagacagtcacagatcattaggcgttagattctcataaggagcaggcaacctagatcccttgtgtgtgtggttcacagtagggtttgtgctcctatgagaatctaatgtcaccactgatctgacaggaggcggagctcaggcggtaatgcttactcacccactactcactcctgctgtgcggcctggttcctaacagaccctggaccaataccccatccatccatggcctgggagttggggatccctgatctacactaca

SEQ ID NO: 178240 - DNA, 310 bp, Homo sapiens
catggataggaaagtgagataaagaaaggtgaaggcctagggtaccgagaaagtgggtgtagtttcaggttgggagtggagggagataagctgactacagtcacagccacaagcctgaggaggttttcagacccataggaacttgaactatgttctaattccacctcctttactccccagtcttcagaagagtctgtgctaataacagctttgggtaaataaagctttgagaaatgaaggagagggaaattttctctgcttgaggcaatgagatccgagagggggcagcaatcatgggtggagagaacta

SEQ ID NO: 178241 - DNA, 401 bp, Homo sapiens
atacttttactcaaccacagattttgatgtataggaaattctttatataggttcattaatttttttaagaaattacagcatcataaaaatccacactggaagttcttaagaaatgttggccgggcgcagtggctcacacctgtaatcccagcactttgggaggccaaggcacgtggatcacttgaggtcaggagtttgagcccagcctggccaacatagtgaaaccccatctctactaaaaatacaaaattagccaggcgaggtggcgcatgcctgtaatcccagctactcggaaggctgagacacaagaaccgattgaaccaggaggcggaggttgtggtgagccgagattgcaccactgtactccagcctgggtaacaaagcgaaactctgtctcaaaa

SEQ ID NO: 178242 - DNA, 324 bp, Homo sapiens
ctccaaccgagggaaacgaaagcctgagaaacaggacggccctgtcaatactcgttgagcagaactatcactcaaacttgataaagggagattagaacaggctccctaatgccagaggtattcattataagttggagttctttatttattttttattttcttaaacaagcacaagtggtcaatggaaaatacatttttacaaggcaggttttcctgcaggaaacaaaagtaggcaggcttcagtgcctgaccaggcttcagtgcctgaccaggcttcagtgcctgaccaggcttcagtgcctgaccaggcttcagtgcctgacc

SEQ ID NO: 178243 - DNA, 493 bp, Homo sapiens
ttcgtcagaggtttttggggttgagtttttatatccgttagtttagttttgtatatttgatggttattagtgtctagattccatcaaactctcagtgatgtagcatttccagagttgggtgattttaacttgtcatcaagatgtcttttcaggattatagtcagtaatagccagatattgcccaatactggtaccgagggtttactagcccttagctggtaagggtcctttctttctcagcaattaagtgtataagacttattcttaactcccaatcacaaaaggagatgtttggttccggtagagctctggggatgtggtttagtaaacgcttccctgagggcaagatgatctgacttcatttctaaatgacgttaggattggagaaggataatgcccaatttaaccttctctggggaattttgaattaggccttctgtgttctctgttataaatactagaagcattgtaagtattagcacacatgtagaat

SEQ ID NO: 178244 - DNA, 502 bp, Homo sapiens
tttatataaaataaatttactgacatctcttctactttgtagacaagagtaaaaaaatagtggtacagggatttggatatcaaaaaggttctgcagttaagctgatcagttccagcaagatggaagatcaacctcaccattcatgaaaagaaaacaatggctttaagtcaccaccaccaccaccatgaagacaaagccaaggacagaaaaggggtgaccggccttcgctcaggagtttgtcaaaagagttaaaagttggccattttgttttactgcctattttatttctccccgactttaagaatgggtcctaagcttgcaccacttgctcgacatatatattctttgccttcatctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaa

SEQ ID NO: 178245 - DNA, 571 bp, Homo sapiens
ggtttccctgagtgggcttcaggagatccagtgttactcaaagtctagtatatattcaggaaaagagaaaaataaaaaggctaggctccaaaaggtcttgaatagcttactaaggaatttgtccattaatccacaggatacatagttgaataagctaggaactatttgtagtgagaagagttgcttttttcttttttctttccctccctcatcatcttacctggataactgttacccactaaactaaggtaacaatgggataatgggtggtcacagatgctccaccaggagaactaatcatgagagtctcatttctcagtgccctcccacaaagcccttcctcaaaacacccatctgcctcctccaaaccccaataatcaatgaaacttcatagcactaaaaggctgacacagttgtattagaggtgtaaatgagaaatattcagcacctagagcaggaggcaatagcaccagtggggtcaaaggaaatctgtgaaggaggaaacaaagagagaatccaaaaacaaaagaaggttttccaccaaccacatgatcaactcacccaggctgag

SEQ ID NO: 178246 - DNA, 166 bp, Homo sapiens
tccgcttatgagctgcgtgatcttggccaagttaatcattcaatgcttcagttttctcatctgtagaataagtatgataacagtacctgccacattggaatgttctatggaataagtatgtggaaaccatttacaacacattgatcaacaaataagaatcatcatc

SEQ ID NO: 178247 - DNA, 504 bp, Homo sapiens
tagaataatgataaaatgcattaaggcaaaaccaagtcaagatattctaccaaatgacctaatattttattcagtctgagttcctctccagaacaggtggaatttgtaacttcataaggcctttgaggggtagaggggtgagacagacccatcttcctgcctcctctcaaagctggtaccaggctgcctccagaaaggaggatgggaataattagaaaatctttattggatctggaacattgtttagacaactaggtacaataaactgctatggatattaactttacttttgaaaacacgcagctaaaatgggattctttgaagatccagtcaagatttcctcattcttggggaactaaatacattctaaacgtttaaaatcctggaaagcaactaatcacttctaatgagctgccaattgcttgtgggaaactaaaaaataggaattttgccaatcacaagataagcagcatgctgaagtgggaatcatggagcttgtgggaa

SEQ ID NO: 178248 - DNA, 287 bp, Homo sapiens
tggagagtatgtctcattgtctgtataaacaattacaacaatgtacctgtaattttccagttcataatcaggctgtaagaatgagaacaatttgttttatgaaacatggagaaagactaatctttgctattactctcagtgcaggtttatcagcaagacttggagtagataagccacaggcatacagatgaggaatcacattttgaaagctttaataactccctagtggtatgcaacaagctgctgaattaacttgtctttgcatactcattgcacatgcatcactg

SEQ ID NO: 178249 - DNA, 645 bp, Homo sapiens
agttttcttcaattagttaagattttgttttccaaatcagttagattggtccatgagcaactggactattacaatcctgtataaaaacagagattttgaatttaaaggtgtgccagcattcctagtgctatgtaggaatttagtgtcgtttttaatctctatatgcttgggtatctatctggaggtgattttgaaagttaacgtgcacctcttatcagcatgctttgaggagcagagcagtgcatttgtgtatgtgtgtgaaaatgcattataactgaatgcacaaaaatgttttctcattgtcttgctttttccccacctctttcttacacacgtgtgaataaggttcctgaactggatgtagtgagatttagtcactagcatcagcagctacatttgcttttggataacggtgtccatctcccaaacttttttgctagtctgtcttcctaactcctccttttctttctcttcctcttctttctcttcctgtctctatccttaccctatgctactttgtttgcaaaagtaattcttgagcttttgctgagttaaggagacaaggttctcttctgatgtgaatgaaacgacatcattctaggtgtgaatgaaacgacactggtttgtcgatgtttgtttagtcta

SEQ ID NO: 178250 - DNA, 353 bp, Homo sapiens
tccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaa

SEQ ID NO: 178251 - DNA, 801 bp, Homo sapiens
gtcctaatttcactgctgtgatgggaaaataatgagacaaccaacaaaaatccccttacagtggggggagataccacagtgaattcatgatggttcttaaatgaagtgaaattgtttggtttgtggctctgttttcttggtatgaatgaaagaagtatgcaaccgtcacgtaactttattttatacctcagtttcctctctagttccctaaaagcatggaaagagaaaagaaacttgccaggccctttagtgaccaaactaatgtttactctcctctgtaggagagtggtagatttggactctggagagttgattgctaatagccattttaaggacttaccacaaatgtgacaccatttcgccctgattcacattattaagggtatgaacgcattagaaaagcaaatggctcccttgttgggctagaaatgataggaaagagtgttggcaatctagtcaacagtattctcctagattcataaacacttcgctttcatctgcatcacctcatcccatcctgtgaggcgaagcagtggtgatagagggcaattttggtttttaacagatgggaacattgaaatataaggaaatcagcctgggcaacatagtgagaccttgactccacaaaaaataaagataaataaataaaaattagccaggtatggtggtgcacgcctgtagtcccagctactcaggaggttgaggtgggaggattgcttgagcctgggaggttgaggctgcagtgagccgtgatcataccactgtactccagcctgggtgacagagcaagatactgcctca

SEQ ID NO: 178252 - DNA, 842 bp, Homo sapiens
gtcctaatttcactgctgtgatgggaaaataatgagacaaccaacaaaaatccccttacagtggggggagataccacagtgaattcatgatggttcttaaatgaagtgaaattgtttggtttgtggctctgttttcttggtatgaatgaaagaagtatgcaaccgtcacgtaactttattttatacctcagtttcctctctagttccctaaaagcatggaaagagaaaagaaacttgccaggccctttagtgaccaaactaatgtttactctcctctgtgatagagcagaggtggctactaatggtagcgacctcgtggcagtagattgactagactaatagaccattgtgaagggaactctaccacaacatgtgacagccaaatttcgcccggaattccactttctactcacggcttctgacacggcctattagaaaaacgacaaatggctcccttgttgggctagaaatgataggaaagagtgttggcaatctagtcaacagtattctcctagattcataaacacttcgctttcatctgcatcacctcatcccatcctgtgaggcgaagcagtggtgatagagggcaattttggtttttaacagatgggaacattgaaatataaggaaatcagcctgggcaacatagtgagaccttgactccacaaaaaataaagataaataaataaaaattagccaggtatggtggtgcacgcctgtagtcccagctactcaggaggttgaggtgggaggattgcttgagcctgggaggttgaggctgcagtgagccgtgatcataccactgtactccagcctgggtgacagagcaagatactgcctca

SEQ ID NO: 178253 - DNA, 814 bp, Homo sapiens
ctgaagagtgtaagcctttctttcttcccatgtgttcagctctcccagggcaatatgacatactctgcacaactcctacaatatttgaccccaggtcagacatagaggtccactgcgaccccaggacacacagaggacttggatggtgccattagaaacagccacttatgggcctgggcataggagggcattcctttggcagaggatctgcctgactaacaagcccagaacaagtcacctgaattaaaaactttggacacatgactcagaagaccccaggtgttttaccttttctaccagtgccagaagtagagtgagattatttaagttagtctccatggcttggggcaacttcccaacccaaatgggtcatttagaaagcagggaatgtttcagaggtcagtgggccagcaggtcaatttggccagtagcgcttgtaagttttttgaattagctgccaacattgaaaaacctaaagattttaaaataaaattccaagttcaaagcttctcttgaatattcaaaaaatggcagccacatggccctcatccccacataacaacagtcacccccactgtccaagtccttggccttatgatgaggcaggagccattgtcctgacagcaacactcacttagataacttgcaagagcctgctgggattttggatttcccaccaggcatcaagagtctcacatgagaggttgagaggagatctctggtcgagttttctccaaccaagcaacatctgggtgctgtgagcagtgggcaaaaacagaaaagcaagagaaggacctcatttcaaggaagaaca

SEQ ID NO: 178254 - DNA, 751 bp, Homo sapiens
ggctggaatgcagtggtgcagtcatggcacactgcagcctcggcctccctgggctcgggtgatcctcccgcctcagcctcatgagtagttgggactacgggcatgcatgcaccaccacatctggctaattgttttgtattttttgttgagacggggttttgccctgttgcccaggctggtcttgaactcctggactcaagcaatccactcatgtcagcctcccaaggtattgggattacaggtgagagccactgcacctggccagtactttattttcatacagagactgagagtaagacttcatttccaaataaaagtaggttattaaatattgctttatatatttttaaagttcttacagaaagaaagcttccatatactctagaccattttgagattctttcaggctgtgactcttaaggtcagctacatttttattgacagcaatcctggaagaaaagtaaagagaagtgagaatataatgttgtgattctgttaaaatcactcaaaatgcttgaaattgataatactttttggcatgtttctttctaaaatcaatgtgataatatccgctgcattgataaacatagttagcaagcatttttgtacttagcgtttgtgtataaaatgtaaaggaaggttttttaattcagagaaggtgctcatgtttgaaagacaatatatggatctggaagaagtaaaagtaaatctttaaactctaattgcaaggctgtctgctcatatttaattg

SEQ ID NO: 178255 - DNA, 404 bp, Homo sapiens
tctcctggaaccaccagggggcatggattctgccgcagccctctctgtgcctacactcatacccttcatcatgccatcctgcgatgcacagactcagggcaacctttgtccttctatctagacttctgctggcagagtggcagctcaaattgtggatttgtctatagctcatggagcagggaaatgggtctgtctacgtcgacaaagagctccaggctagggttccccaggcaacacccagcaggaggcacaccagagccctgcccagacaggccacccattctgatgggccagagatagactggaagaggccaaccctgctgaccatcccagcctcctggaggcttgtcagaggaccccagcttccaagggcaggaaggaatagggaagttgctgcctttgtg

SEQ ID NO: 178256 - DNA, 269 bp, Homo sapiens
cttgttaatatctggccaactgttagtgacaaaatgaagttttaacattccctgcccaagaggatccttgagacctagaccagtgtattttctcatttgttcctttaatctatctaaaaattctataggcccttcatctttcccttgctgtatatcaaatattcgggtaagatactgagttcggggtaccaattttttttttttttttgagatggagccttgctctgttgctcaggctagagtgctggagtgcagtggcgtgatctcgg

SEQ ID NO: 178257 - DNA, 345 bp, Homo sapiens
ccccaatggcgtgcattctcacgatcttccaacctactaccttttgtgatagctatttttatcctctttcaacaactgaaggaactgaggcctaaagctctgcagttaacttgtggtgaaactggaccataaacccaggtccaaaaaactcatggtcttggctgttacatgatgttttggcattagagagaaaaaatctaccacatggtaaagggaaaagtagcttgggttgaatttcaaatacttggattggaatccaagctctgtgaccttggacaagtttctttctttctttctttctttttttttttttttttttgagatggagtcttgctctgccgccca

SEQ ID NO: 178258 - DNA, 255 bp, Homo sapiens
tagagtgcatcttgaaggcagagattctgtgtcacttaactttgaattctacccacatgtgacactgcctggcacatagtatgcattccctaaatgtttctcaaataaataaataaatgagggatgaaagatactcccatatggtcacagtgtaccattataacatttgcaattcttactatattatacaacatctgtaagccagttttataaatccaataatcatgatatggctaaagggaacatagatatctt

SEQ ID NO: 178259 - DNA, 399 bp, Homo sapiens
ttgtttggtgccctggaggttttaatcttgtcctcccatccgccccacctcggggcactgcatcctactgagatggggggttgttctctttcttttgcaaagtggagagaggggtgatcaggtcctgaacccaaagcaggtttgcaggcagttttaggaatgacatggagtttgaagctctggaaatagattcctttaggacaattcatgttgcaaaccccgcttagaggtctgctgctccaggggcagctttgggcagtgagtattggggttcaaagcacatttctgttgtagaacagtctcagcactggggaaggcctgtggattaaatttccctgactcttagtcagtctttgggatgtcccagggaggatttggggtcccctttgactcctggcc

SEQ ID NO: 178260 - DNA, 137 bp, Homo sapiens
gccaggcaactccttactcttggctctcactcatctgttagctggtgctccactctatcccatgttagagatacacccacgctcctcaccaaagcctcgcactgggcataagcactcctgggccaagtccagttcag

SEQ ID NO: 178261 - DNA, 590 bp, Homo sapiens
atcttttgcccattctttccatgcatttcttctacaggcataattgtgtcctttgcttgttccatgtaagtaatacaaaagcaatgttgaaaaatgtccaatgtctcacttttgtcatggcttcagcccccagcatgaatcttcctaggtctagatgcatgaatatttaacaggcttaatccatttaaagtgatagaaccttaccatgccttcatgaatgcttccttcaaggtctctatcaatactagccccctccatgaagtcttccctaaataatttatcaaataatcttttggcttctgctaaattcctattaattgtactttcagtctatctacatcttctggcacttgaccaacatcggctcctgatccccagagaagtaaacaggcaattacaatgtgctccaacaacagtacaagaatttgagggcacacaaaaaagaagggcacataacataatcatgaagaataagaaaaggcttctaaaaagaaaagaaataaaggatttgggtgagggaattcaaggtttagaatctgaaccctactttaggtagaggagcatgtacaaaaacttgaaatagggcaatc

SEQ ID NO: 178262 - DNA, 1346 bp, Homo sapiens
ttggtgtctatgttgaaaatcagttacttttttttttttgagatggagtctcgctctttcacccaggctggattgcagtggcacaatcccggctcactgcaacctccacctcccaggttcaagcaattctctgcctcagcctcccgagtagctgggattacaggcgcctgccaccaagcctggctaatttttgtatttttagtagagacggggttttaccatcttggccatgctagtcttgaactcctgatcttgtggttctactacccacctcagcctcccaaagtgctgggattgcagatgtaagccaccacacccggccaaaatcagttacttatacatgtatggattggccacctattcttgacgataatgtcttgaaatgttgtttggggttaagatggtgcagagctcactggaaagacaatcaggtaagcaacttgaattctaaaatcctcatttccataagcccaaattaagcagagcttcatgtatcttctggacccagtccaagccatcagggcagatgcagggaggctttggggccttagacagcctgtggccacctgaaccaggctttgcccatgacatgctccactggttttataagcagaagagagagcaaacgggtttattttcaaaatggagcttggatcctcagaagaagcctcaggagagggaggagcagttgctagtcagtgcacattccagagggcccagggcatgtttctgtgcagtgtgtatgtgtgagtgtggtgtacacgcacgtgtaccaaggcagtaacatttgctccctgtggccccaggaagcagcacggaggagacagggagtggcagtcccaccatggagactgagcaggggcacatctcgtgtgtactcatatccaccctcacacacctggtatacattgagctccagcagcagtttctggggatgtgaagcttctctgtctccacctccagtccagctctgaggggaccagcccttgcacctccccttgctgtcccagtgcctgcacaggaacaaagtatgacctcgcttaggaaacctgcctagccctcgcttctcctagtccctgccccagggcacagagtcctggcatctctactccctgtgctgtggaggaggaggctctgctgcataccatgtttggggaaacgattgcccacacaaccatgtgtttggctgagcaagctctccaggcccacagctagcctgctcagaatgccagtaagtcctcattcataccaagtcctcttcctctgctggggagctttttcgcctgagatcccaggctccacacatcacctgtccacgcagtctgcctaaatcctggccaggaaaa

SEQ ID NO: 178263 - DNA, 516 bp, Homo sapiens
aacgaagtcatctgtgcataccggaggttcatataaatatgtccataggttgctacaaccacattattttgtatgtagtgtcagtatctcctctactagtctgtgagtaccacgagggtgtcttcatctttttatcctcatggtagccaccagacttacgtcgagtagatggctgagtggctgagtgactaaatcgggatggaatgtagtgagaaaacagaccataaaattagatggagccaaattatgggaggccatagaggtcatactgagagttagggttaggtgtagtaaagtagcagtgaccaaccagtggctcatgcctgtaatctcagcactttgggaggccaggacaggaggattgcttgagaccaagagtttgataccaggctgaccaacatagtgagaccccatctctacaaaaaattttttaaaaaaattagctgggtgtggtggcacacacctgttgtcccaattacttggaaggctgaggcaggaggattgcttgaagctggt

SEQ ID NO: 178264 - DNA, 307 bp, Homo sapiens
gaggtcatgccatcgcagtccagcctgggcaacaagagcgaaactgtctcaaaaaaaaaaaaaagagttacctttcagaatgggctcaaccgcttgaatgatttggagaattggaggtaagagattttggtgttaatgactttcacttccctgtcttatgtccattcttcctgcacgattgttgtttgtgggtatgcgtccttctgcacgtaatctgtttgaagcctttccagtgatcccatgtctataccccctttcccctgtgtagccatcccattggcctggatgcttggggatggtttgtcta

SEQ ID NO: 178265 - DNA, 577 bp, Homo sapiens
agcggcgccctttttttacttagccaggtacaatgtgcatgcctgtagtcccaactacttgggaggctgaggcaggaggatccctcaaaccgaggaattcaaggtggtagtaagttatgatcatgccactgcactccagcctgggtgacagagcgagactccatcttaaaataaataaataaataaatatgacctattatagatatcgtcattatttgtgttgctgataattaatttttatgaaagattctaatagcataattaatttagaacagcttctgaaagccactcatctattattaaattttatataattttggaaattaagaatatgattttagcatgtctaaagattttgaccaggtgcagtggctcacacctctaatcccagcagtttaggaagccaaggctggcagatcgcctgagatcaggagttcaagaacatcctgggcacatggcaaaaccccatctctactaaaagtacaaaaattagctgggcatggtggcacacacctgtaatcccagctactcggagggctgagacacgagaatcacttgaacccaggaggcggaggtt

SEQ ID NO: 178266 - DNA, 534 bp, Homo sapiens
cccaggaaacagggttttaagctctggattcattttgttaaatcacgtaatacaggatagggaaggcagcagcggcaagctctgtttgttagtagtgaagttgcgcaggtgagatagaagctgagtcacgtgccacctgtcacggtctcttcctctggaccaggcacagttgtgctgttgtccgtcatctccttaccaagctggtgggagctaaggaccttctgtgtttctaggagacctcaattccagttttagcagagtctgggaagtttcatgttttatttatagagtgcagaagtatcacttttcattcagttacaagtttttagaagagatcatctgaaagacatcatactttaaagtgtaatttatgttattttcaagacttaatccaaagtgtattgttttgaataaaaagtattgtcattggtccaaacatgtatgtaaaagatgtaattcagtttattttactaaagaatactaaatgtgtataaatgattgcattaattacagcagatctaaaacagtgggaga

SEQ ID NO: 178267 - DNA, 424 bp, Homo sapiens
cttcagactccacttcctcatgtcccagaccatattcaactcaattcaatttggtgtttgtcactcctgtgtctttgggactgctcttaaccagaccactgatgaataataatcttgccaaaccagcaatcacttctctgccctctcctgtgactttctagtgaaacccacaatttcttcctctcactctcttggtttttctttttctttctttctttttttttaagatggagtctcactctgtcacctaggctggactgcagtggcacgatctcggctcactgcaacctctgcttcctgggttcaagtgattctcctgccttagcctcctgagtaactgagattacaggcatgcaccaccacgcccagctaatttttttttttttttttgagacggagtctcgctctgtcatccaagctggag

SEQ ID NO: 178268 - DNA, 151 bp, Homo sapiens
tcaacgtgatgttgcagtggagcatgagctgcggcagcggctcctggttcttgtggaagatagagtccaacaacttcagcttggccttgaaccctcacacggacattttattctcacctctggcaggtggggcgcgaaggtgagcccgtcg

SEQ ID NO: 178269 - DNA, 741 bp, Homo sapiens
ctggtctcgaactccttgacctcaggtgatcacctgagctcaggagttcaagaaagaaagaaaagaaagaaaggaaaagaaaagaagaaaagaaagaagaaaatcccatttacataaagaaaaccttgacttgagtagaaatagcagaataggtaaaaagcgagctgtgtctagacacagtttagtaaaattgctgaatcccacaaataaagcctatagaccaaacaagaaaaatttactaaactggaaaaggaatcagactggcatcagatttctcatctgctgcactgaatactaaatgatactaaatgatagtgtgcaaatcttggtacaatactgaagtaaagcaaatttgacccgagaattctacttatagccaagcttttactcaaatatgaaggcaataacaactcattttagatatacaaagactcaggaaatacatcaagcatgtagccttcccataaaattacttaatgaagtactatggcagaaaaaaagaacaaaaaagagaagaatcaagatgatgaatacaagaaaaagatagtaaatagaaaatagcacagcaaacaggtaaaagttacagtttattactgatgtggttataaaatttaatgcaagaaacaattctcaaaagagatttgctataaagttaaaaatgttacaacatattctccaaattattttaatagaatgtgggatggagcagggaagaaaagaatgttcaagcatcatttggcg

SEQ ID NO: 178270 - DNA, 280 bp, Homo sapiens
cagggatgtcttccccatttggaatacttctctcctctatactctcttgtttcaactgtatgttaagtattcttctcaccctggccacattctttttgtatcccttagtcctgttttaatttctaaaaagcacataccactatctgggattacattgtttaatttatgtgcctatttaccctctgctatagtgtgagtcacatgaggtcagggttttgctttgtattattcacaactgtttccccagttctagtaacagtggccaagcagattactatcc

SEQ ID NO: 178271 - DNA, 758 bp, Homo sapiens
gcccagtctgatctcaaactccagggctcaagtgatctttccacctcagccttccaaagtgctgggattacaagtttgagccactgagcctggccttttctattttaattgagtgtttttatcctttgacatacttgacaggcttcccaaagtcaaatttcaaattctaaattaagtcttttcggcctcaaactaaccttaggttatcccagaatggcccctggaagcctaagagagacgtattaggcttatttgatatgtaaattatacaggaaacctttgcattacatttatatgaacatgttattaatatgtgttttaaaagtatatgagattcctaaaagtctgatgtgtctttttgtatgttatcagtcataattatggctactatgtaaacttgttatagactacagaaaaaaacaaatttccttgtcaatcgcatcattgttgtaaactcttaccaggtctttcaccatagccattctaaatcttgttgttcgtagtaaattgctttattctaatgttttttctaaatgatctttgcaagcaaatataatcctaaagcattgtgtcttcaaagaggtttatgagaaggataaaaagtctgatacatactctggaatacaggcctctgttgattattaagttggactgaataagaacttgagaaactccaatggtaaaaactggacttaaaattgctaatttatcaagtagaacaaaaattaattacatgggacggaactgatgaggactga

SEQ ID NO: 178272 - DNA, 529 bp, Homo sapiens
  misc_feature (482)..(482): n is a, c, g, or t
cagaaggacttgggccccccacgagcggcgccggggagcgggtcttccgctgggctcttccctgttcactcgccgttactgagggaatcctggttagtttcttttcctccgctgactaatatgcttaaattcagcgggtcgccacgtctgatctgaggtcgcgcggctcggtggagagcggccgctctccacccacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctccctgganggggttccatctctgacctgtgcccattcggggtggtggcgagcggt

SEQ ID NO: 178273 - DNA, 4510 bp, Homo sapiens
  misc_feature (52)..(52): n is a, c, g, or t
accagcggagcgctgggtgtcagtgagcagcgaggagccgcgcgcccccgtncccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcggagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagccccccggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtgaatctggaagccggagcaagggccactccacaggctctttggcacagcagggctccctatgtgcctcccaaacgtcaaatgcaggctacccattctccccatcagctgcccacctcgttccccagccctcacccctcacccctcaccatccttcctcaggacttggctaaacaacatgcatctcatttcttcttggagtggggagatgcgggaagctgacccagtggtcctctaggcaggcagggtgctcctggtgtctgcccaccactgtccccttgctgatggcatgggggtccgaccaggcactgacaccgcaggcagaggttgctcggggccttgggtcgggtttaccaatcagccaggacgcccggggccaccagctcagctaccacttccccttccctctgcaccctctggaaccctggcccaattcctcagaccccagagtggcctgggacccaagctgccgcagctgagtggccccagcggacacctcctcaggcttaaatctcaggcttcacattgcaatgacgattgcagttttatttttggagatgacacacctactgcttcttttctaggataaatctaattactgtttactggtggagtacatatgcatagaaacggcttctgtcggggggagagtatataatggaggaaatattatgtattgagattatatttattttctaaatgctgtaatttgaagccatttccataaatctatttaaggattgcagacgctctcctttcttccatgaacgcggatcttttttctctgtctggaaagcgatggtgttggtgctaacatgcattgtcctctaagaagctggaggctcctggactcttgggacgactgaagggcgggacttggctcccaccagccctcaggagcagtggccaccccctgcttcctgcaagctccttcccaccttccagggctctgcccctgtgatgcccatccccccctgcccatctacctgcccagctcctcttctcacaggcatcttcagctcagccctctggcctgtggggggcagggttagtgctcatagccaccccgacttggggcctgccctgcctggtggccctggtcgtagggctgtgctaatcacgcctggagcggctgccttctggag

SEQ ID NO: 178274 - DNA, 4427 bp, Homo sapiens
gcgggaatgcacaacgttatgctcatcacctgcgtccaccaccgtcacccctgacggcgagacgcgaggtgctaagggcttgtccaggctaagcgggttctctgcgtccttaagcccactttgcagatgctaatcagaggggacaggcggccaagaacctggagcccacccgggcgtctgtgcccagtgccgaccctctaaattcccttcccacgtggctcctgttgcgtctgggctgtggaggattcctctaaacaggcacagccaccctctggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcggagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagccccccggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtgaatctggaagccggagcaagggccactccacaggctctttggcacagcagggctccctatgtgcctcccaaacgtcaaatgcaggctacccattctccccatcagctgcccacctcgttccccagccctcacccctcacccctcaccatccttcctcaggacttggctaaacaacatgcatctcatttcttcttggagtggggagatgcgggaagctgacccagtggtcctctaggcaggcagggtgctcctggtgtctgcccaccactgtccccttgctgatggcatgggggtccgaccaggcactgacaccgcaggcagaggttgctcggggccttgggtcgggtttaccaatcagccaggacgcccggggccaccagctcagctaccacttccccttccctctgcaccctctggaaccctggcccaattcctcagaccccagagtggcctgggacccaagctgccgcagctgagtggccccagcggacacctcctcaggcttaaatctcaggcttcacattgcaatgacgattgcagttttatttttggagatgacacacctactgcttcttttctaggataaatctaattactgtttactggtggagtacatatgcatagaaacggcttctgtcggggggagagtatataatggaggaaatattatgtattgagattatatttattttctaaatgctgtaatttgaagccatttccataaatctatttaaggattgcagacgctctcctttcttccatgaacgcggatcttttttctctgtctggaaagcgatggtgttggtgctaacatgcattgtcctctaagaagctggaggctcctggactcttgggacgactgaagggcgggacttggctcccaccagccctcaggagcagtggccaccccctgcttcctgcaagctccttcccaccttccagggctctgcccctgtgatgcccatccccccctgcccatctacctgcccagctcctcttctcacaggcatcttcagctcagccctctggcctgtggggggcagggttagtgctcatagccaccccgacttggggcctgccctgcctggtggccctggtcgtagggctgtgctaatcacgcctggagcggctgccttctggag

SEQ ID NO: 178275 - DNA, 464 bp, Homo sapiens
cacagcgattggcgcactttctcctgtcttctctttcaggacaatgtgttgaacatcattaaccagatcatggatgagtgcatcccccaggaccgcgcccccagagatttctgcgtcaagttccctgaggagatccggcacgacaacctggccggccagctgtggttcggtgccgaggtagcgggtggccacccgggttcggaggtcctgatgtggggtggcgtctagccatgtccctgcgaaccttgtgcatgggcgcctgcaggtgccgggacctggtgtctcctccaagagctccgtccactctgggttacgtggtgtggtctgagcctggtaggccgtgcacccctggaggatctgggaaagccatgaactggtgcccccaaaactatacatacaaatgaaatttcccatgtggtttttatgaggttcacaggcccccagacagccaggacctaaaagtg

SEQ ID NO: 178276 - DNA, 1892 bp, Homo sapiens
cgacggccccccttctccactagtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtgaatctggaagccggagcaagggccactccacaggctctttggcacagcagggctccctatgtgcctcccaaacgtcaaatgcaggctacccattctccccatcagctgcccacctcgttccccagccctcacccctcacccctcaccatccttcctcaggacttggctaaacaacatgcatctcatttcttcttggagtggggagatgcgggaagctgacccagtggtcctctaggcaggcagggtgctcctggtgtctgcccaccactgtccccttgctgatggcatgggggtccgaccaggcactgacaccgcaggcagaggttgctcggggccttgggtcgggtttaccaatcagccaggacgcccggggccaccagctcagctaccacttccccttccctctgcaccctctggaaccctggcccaattcctcagaccccagagtggcctgggacccaagctgccgcagctgagtggccccagcggacacctcctcaggcttaaatctcaggcttcacattgcaatgacgattgcagttttatttttggagatgacacacctactgcttcttttctaggataaatctaattactgtttactggtggagtacatatgcatagaaacggcttctgtcggggggagagtatataatggaggaaatattatgtattgagattatatttattttctaaatgctgtaatttgaagccatttccataaatctatttaaggattgcagacgctctcctttcttccatgaacgcggatcttttttctctgtctggaaagcgatggtgttggtgctaacatgcattgtcctctaagaagctggaggctcctggactcttgggacgactgaagggcgggacttggctcccaccagccctcaggagcagtggccaccccctgcttcctgcaagctccttcccaccttccagggctctgcccctgtgatgcccatccccccctgcccatctacctgcccagctcctcttctcacaggcatcttcagctcagccctctggcctgtggggggcagggttagtgctcatagccaccccgacttggggcctgccctgcctggtggccctggtcgtagggctgtgctaatcacgcctggagcggctgccttctggag

SEQ ID NO: 178277 - DNA, 610 bp, Homo sapiens
ttatcaatatctagtggttatcagtaggtagataattgtggcgctccttcaacctctaccctccatccttttcaaggccttctagttccttaagagaactaaatctaggcctggtgcgatggatcagttgagggtcaggagttttagaccagcctggccaacaaagtgaagccctgtctctactaaaaatacaaaaaattagccaggcatggtggcacttgcctgtaatcccagctactcaggaagctgaggcaggagaatcgcttgagcctgagaggcagagattgcagtgagctgagatcgcaccactgcactgcagcctgggcaacagagtgagactctgtctcaaaaaaaaaaaagaactaaataatctaatgatgctgttacagcatattgatcttttatatctattccttccttcctgagaataagatttattgtaaagaggttgaagactaaaaatgacctgttaaagttatctacattttccaagaaattaactacatatttacttttctctgtctcttccatgccaagctgtagatttttttacagtagagttcctaaaaatagttttattctaacaaaccatattgaagtccaaaaggac

SEQ ID NO: 178278 - DNA, 317 bp, Homo sapiens
gagacggagtcttgctctgtcgcccaggctggagtacagtggccaccatgcttggctaatttttgtatttgtattagagacgggatttcgccatgttggccaggctggtcttgaactcctgacctcaggtgatccacccgctttggcatcccaaaatgctgggattataggcatagccaccatgcccggtcgacttctagagtttcaataacagagatgtgattcaagaagggagacatgttttgtagatggcaggagcttcatgaaaagaagccaatgaagggcaggacgtgtagctgtctacctacaggaaacca

SEQ ID NO: 178279 - DNA, 266 bp, Homo sapiens
ttctacattcttaatgtcttaatgatagttttacatcattaactagtatctaaaggtacaacttaattgtagagcaaagctcatcaacaccaacagtgaataatgtactttttttttttttgagacggagtctcactctgtcacccaggctgaagtgccatggcacaatctcagctcactgcaacctccacctcctgagttcaagtggttctcctggtctcagcctcctgagtagctggcactacaggtacaagccaccacgcctg

SEQ ID NO: 178280 - DNA, 358 bp, Homo sapiens
cagattagtagatctttaagagtagtaataaattccctagtccaaggtcaactcacaaagaatgtactcattttgtaggcttgcttgaatagatttaggtgtaagattgttctcagccgggcacggtggctcacacctgtcatcctggcactttgtgaggctgagacgggtggataacctgagctcagcagtttgagaccagcctggccaacacggtgaaaccccgtgtccactacaatacaaaaattagccaggtgtggtggcacatgcctgtaatcccagttaattgggaggctgaggcaggagaatcacttcaagccgggaggcagaagttgcagtgagccgagaatgcgccact

SEQ ID NO: 178281 - DNA, 339 bp, Homo sapiens
tgtcacaaattcagacccattttgcctgagcttttttgcatttgtgaagaagtgatcagacttgacagtagagttgttgggagagtttgaaagtatgatatgggtatggggtgaaattgatttccagcttaattaaatctattgtgaacttgttagtgaagcaaatctacatgttaattgttgtaaaggagttcccctcaactcacttccatggggctttgtgttattctcaccgccccctcccctgcctaccattccagttgcttacccactcatcctcagcatggcaggctcggccattcctcaacaatgacgttatttgtccttttaaaatattcc

SEQ ID NO: 178282 - DNA, 190 bp, Homo sapiens
ttttcaaaaccccaaaatgagcaagtttaagcccagagctcagtctgtgaccagggagaaccttccggactttctttttcatcttccctccacttggggctccatgcctttccttgacccttgcttgactaagggtaaatggttttaccctggtcactgaacataaaatacttaaaaattctcgctgggc

SEQ ID NO: 178283 - DNA, 172 bp, Homo sapiens
ggaaaatgattgggcacccagcccacagcagatgcgctgaggaatccagccagggggagctgggatgcagtgggagaggggacacgcagggcctggctgagaagcctcgcgaggtaaccacaggcggaaatctgaaaaatgaagacgttcccaccagttccagaaaacaggg

SEQ ID NO: 178284 - DNA, 582 bp, Homo sapiens
tagcatgtgatgctgaggcactgtaagtcgtgaggatcacccgctttaggagccattcttccaaaatcttaagtgagtgaaaaagaagcagagatagctttttgtatttgcgcatggaggcagagttcatctgttgcctgagctaacagtatactattagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccatttctttggcttattaattggtcctctgttagccagtcaacaatactgtacccagcacagatatccttgagaaatgaaggagaaataaagtctttcctagataagcaaaaactgatggaatttatcatcac

SEQ ID NO: 178285 - DNA, 431 bp, Homo sapiens
agcatattgattacctcaaaaagaaaccccattcttttaggcattacccaagccccataataacccctccacttctgccctaagaaactacttatttctgtctctccatggattagcctattctggatgtctcataaaatgcaatcatgtaatctgtagtcttttgtgacttgaagcttcttcgtatagtctgggtataagagttttaaaaatctgatagacagtttgcaaatatgttctctcaagtctgtgggttttgatttccttctcttagcaacatcttttgaagagcaggattttgacgaagtccaatttatcaactttttcttttatgggtcattcttctagtgttatagctaaaaaaaacctctgcctaatctatgatcacaaagatttccccctatgtctatgtcttcctttaaaggtatttt

SEQ ID NO: 178286 - DNA, 215 bp, Homo sapiens
tgacctcatgatctgcctgcctcagcctgccaaagtgctgggattacaggtgtgagccactgcacctggccagaggtaaaattcttaagtttaacaggatctttctggttttctagcctcatctctgtcctcttagcgccttagcttcactggccctttttcagatccttcacatgccaagctcattcttagcacagggctttgtatatgctctt

SEQ ID NO: 178287 - DNA, 704 bp, Homo sapiens
atctcaggttgggagcaggctggttccctgttcagatcccagctctgccatctgccggctgggtggctgtgggcaggttactttgccccttggtgcctcactgtcttcccctctgaaggggatggccggggcataaccgcatagagttgtaagattgacacgagttgatgggtgtgaaactctttagcgcagcattggccattaggaacacctgttagccattgttgttgtgattatggtggtggtgatggctgtggtaattgtctgggagatgtttatgagtgctgttatattattcccagaattgattgaagtcacacttttcaaagaaaacagacacatttgtcccttcttggatccccacttgttttaaatcaatgcaacttaacaagacacatataatctgtaagcaggggcttgcattgtttccaaaacctttactaaagctctcactcacccttccagtttgcaaactattgttagagaacggaggttctcaaacaatgcaagtacccaggccccacctcctagacatctgacataattggtctgagatgcagtccaggcggttggagttttaaaagctcctaggtgattctaaggtgcagccagggctgagacccactggggtcagggggcatagcagaaagaacacaggctgtgcagtaagaaaaaccccagatcaaatcccagatctgccagtt

SEQ ID NO: 178288 - DNA, 582 bp, Homo sapiens
tactgtagttggtggtttcatcatagccccatgcacccaagtggaaacgggtgcttcttcctgctcccttgcccctacatcaatctaacaatctcattggtttttattacttaatcttttctaggatctggccctttccctctctccacctcactcctgcactgcactgacccagcctggcccacctctggccattcctccatagactgaggtctctcatggggaactgaggtcaccctttgctgcctcacgctgcctctgggatcagaggctcttggatgtgatttctaaggtcatctcctcttctctcctctcctgcctccttcaccagcaccaagcttcctacagctcctggaatggtttcctccacccacaaggaaagtgagtgacctctacacaatcctcacctcttgccaggctaattcttttcttttttgagacatctgcagatgccacctcctgtgggaagtcctccctgattacctctctctcctcccacccttgtttagcaataccatagttctttctcaatgaagcaattagtccttgaggcaactgacaactccacacccccagttccct

SEQ ID NO: 178289 - DNA, 187 bp, Homo sapiens
catgcttaagaaagtaaaatggaaagtggggggagggggaggggtcattctgatgatatagtttgaggacctggatgtagccacacctgtagctgtcaactctgtgccatagtactgcttttttttttttttccttcatatttaaatactttctagaggcaaggtctttttatgttgcttgggctgg

SEQ ID NO: 178290 - DNA, 555 bp, Homo sapiens
aaatccacagcaatgcatccgtacctaaaatccatcccaggcaacaaattgatttgaaaagctgtggtgtttagaatcataaaaatgatgaaggaagtgaaaaagtcagataagcaacattctaaaagttaagacacatgtgagtaaattagatcagctttttaactggggtaaggaattgagggagaaagaaagggctgccctgtcctgcctgctgacacacagagagccctcagcatgaaagaagtgaagaatattgtgaagtaggcatcagagaagtcaggagcacagactccagaagtgttcagtgggcaccaaccctacctctgccactttctagctgtgtgaccttggctatgttgtagtctctctaagtctcagtctcctagacagtaaaatgaaggtaatattggtactagtgacttcatcttccaccactcacccactcctgaacatgtcaagcacccccggcctcagggctgttgcttttttgttccatcagtgtggaatatccatcatccagagaaattcaaggtctactccctcttatacatt

SEQ ID NO: 178291 - DNA, 371 bp, Homo sapiens
accagccaggaaataaaaattttccaggtctgaatcctgggtcctgctgtcttggttctgtgagctccctgccctcaatctcctttcatgtacatggagctccctgccttcctaaggctgccagaaggctggaggcgagacccaccccagagtaacaagtccagagtgatgtttaacaactgtggattctctgtctccctttctcccaaaggagaaacagattgttttctttttaaatgagaaaggtaagacaggaccccctaccatcaaaaagcctacaacccatctgcaaagccaataggcgaacaacttaataataaaaagcaaacagagaaagacattataatgaatgtacaatgtactagggagac

SEQ ID NO: 178292 - DNA, 147 bp, Homo sapiens
aacccagcgtcagggacccatctcaggcttcctcttattcaacattccacacctctaagggagcgtagtccccttggggagcacagcctgcccctctcagctcagtgatggccatgaggcatgtgtgcagaggtgtcggtgcagtga

SEQ ID NO: 178293 - DNA, 339 bp, Homo sapiens
tgccaatcactcttctatgtgctggggaatcagagatgaacaagaaaatatgactccacttcccatttagcctacatttatcacccctgtattggaaggcatctattgtctggcattgtaatcagctgacacacagaattaactacgtgagggaacatcttctcttctctcacctacaaggagaggagacattctttacagcatccactctgcccctcacaacccagacaaaccaggttggtggcccagcaaagggaaacacttgtgacaactgtgaattttataaactcaaggctagagagggaggtgttaggtgagaaaaagcaagataaaagagga

SEQ ID NO: 178294 - DNA, 467 bp, Homo sapiens
caaaggtcccacctcttgacacatatgcttagagcttccacatatgtactttggggagacaaagacagccacagcacctggttagcatccccctgactctctcctgaggcaggcacctgcttagaacctggggctcgccccactctcctgacctcctctcctgggggccaggaagtgccccacgggggccgaccctgtccacctccgtggctgtgctccagctgacttgctcgggccctgtcctgtgaatggaggaaggatgttgggctcagccttcgcacctgccccggtagattccatgataagggacctgagcggcctggcccggcgccacactccgaccctgttcctgactgcacctcccgcagccactcccagcctcggtttctctatcggtagataagcctctagcacacctcagcacctgaggctgttgggagggaggagcgagacaatgtgtgcggccg

SEQ ID NO: 178295 - DNA, 483 bp, Homo sapiens
taagacacctgccagttggtgagtcatcttattgctatggcttcagaggactgctgtacagctggagtatttaggcttgaaattgtttgattaggtatgataagcacattcctctgatttacaggttgccatatataggtaacttatattgaactgtgactagttttgaggtagtggaaggaaggtaatatttgctgttgctctttaaaagttgtctcacttatttccttggtcctggcgtactacccttaagggatggacttacttttttcctgctaaaagacataagattggttgacagaagtcaaagggtggaacaccttgccattacttctgctcaatttgtcacttttaaaaatagtttaaaagctggaagcttgtcaataggaaaagtaaactcatttttaaaaatttattttcacaaggcaaataatgccttaaagtggcttcttttttaaaatttaatttaattaattctattct

SEQ ID NO: 178296 - DNA, 730 bp, Homo sapiens
catctcaggctgtgatgaggactatcaaggaaagaaagaaacaggaccatggggtagagaatgactggagataggagatcccttctgacatgttgatctgcaataaggtggcacagaaagaataaagcctggtcagctatggaaagaactagggagacttactccaggctgaggaaacagcaagtgcaaaggccctcaggcaggaaaaaaatgtgcttgtgccaggaacagtaaagctggcaaagtgggtgaaacattgtaaaccatgagaggagtgaaacaggatgagatcagagaaacaggagggaatcccactgctaggttctttagagctagagcaagcaacagttcaaaatgtatcgaacgtgcaataagattctactgaagaaagaaattgatatggcgaaatttgagagtctcagagcaatgactctagctgctgtgtggaagagggaccctcaagctgtgcatctcaaatggacatgagtcactggggatcttgttaggtgcaggttctgctccatgtctgaattggggcctgagcagcaccaggtgatgctgattctgcagttccatggacaacactctgagtagtgaagatcaaggactcagagtgaaagcaggagaccagttaggaaactttttcatgagtccagctgagtaatgatggtggtttggtctaggatgacgctggtagacatggagagaaggggatgaattcttgatttgt

SEQ ID NO: 178297 - DNA, 299 bp, Homo sapiens
gaacaatcttaaatgagtgttttctcccaaattctttttgcatatcctcagattggtgtccctgcaaattcatggtctcaactccacccagtaatctgatgttcacatagttaagtctgtctcccattgctcactgtgtctaactgagaagaggaggaggattccattttctctcagggtttcccttcctcatctgcacagacacctatcttttctctcttatcctcgtgccacaatggaagtggcgctcccatgtcccatcatctaaggctgattccttaacttgagctcttgagtca

SEQ ID NO: 178298 - DNA, 309 bp, Homo sapiens
gcaagagaattgcttgaacccgggaggcggaggttgcagtgagctgagatcacgccattgcactccaacagagcgagacttcatctcaaaaaaaaagagcaaaagatagacataattagaaagtaaggatgtttaaaagaacatttaattttccaaaagatatttttatagcaagagaaatggcgagataataaaacatttaaataagttgagatttgttatataaaatttattacatttctctggattttcatttagctttaggccgtaagtgtgtgtctatttgtttgtgttttatgtgttttgtcc

SEQ ID NO: 178299 - DNA, 709 bp, Homo sapiens
aaactttttcccctaagggaactacaaacagaggtttccctcaagcctcttctaacagcagccagttcatcaagcccacagaccagaccctgaagagccccatggaatcaataaccactttgcttttgaaagaaaggggaagagggcataaaccagagacacagacacactaacctgagttcatcccacagtggaagataggaaatattggagatgaactggagtttggtagggttgcagcagaatcctcagaaacaaaacacgatgcccaaggaagttctaaaccaacaataaatgtcatttctccactcccacacatatatacacttgttgcataaaacagctgtatacctttaagaacagcttaaaaatcactggatcccacaaagaacacaactatataagatgactactaattaaaagattcaaatcagatgattttgttataatgttctgcagacacaggcaaaggaggtatgtagaatgtctgtaaggaatccaggattctcagctagctgataacgacttcatgctgctgctttatttcatttgacaccttccattctcgtatcagctactgcgtgcaaaccaaacctcccaagaatggtgaccctgtcctcttcagttcacctaacaccctggccaagaagtaaattaaaatgcaatgtatttcagctcctataaatgttacctacttactctatttaac

SEQ ID NO: 178300 - DNA, 169 bp, Homo sapiens
gcaagctgtttaacgatgcccccagcctagaaaggcccaggcttgggtgttcatgctccgctgttgccttcttgaaattcataatcatctttgaacaaggggtcccacatttgcatttttgctctgggtcctgtaaattacgtagccaggcctgcatttgtcctgggag

SEQ ID NO: 178301 - DNA, 461 bp, Homo sapiens
ctttaagtgaaaaccccacatctgagtttccaaattaccaagctatccacagcaacattcctccaacactaccattctgcctagtgagctctccattcgtgtatctgtctcctaatctcccacatttctcctctcaccctctaagagaagcaactttcatctccacaagtttaacaatctctcctataggaagcataacaccaccttaattgcattgtgctgactctcttctactagacagcatgctcctcaaagatgggtacattcttttttttgagacggagtttcgctctttttgcccaggctggagtgcaatggcatgatctcggctctcggcaacctccgcctcccaggttcaagcgattctcctgcctcagccttccaatacaccagtattaacttgccaagcagcccacagttaggtctcagggttttagtgagcctgttcctcttgactgaaa

SEQ ID NO: 178302 - DNA, 706 bp, Homo sapiens
ggcctgcatcccctttctgcccaaatgggtttttttgctaccatatcaaagaacctgacatatggcggcataggaagcagaagctaagcctctctccagctgctgctgtgtaaaatccatgcgtggccaaagagaagtcaggggattatgacataaatggtgctgggaagaaccctctgcctaaaactgtctccttctcctggtgctacaaccggaatccaccatgagagagtactttcttcggttctttcctcctgtccttgacagagtaacacgttaatctggttcttggtggtgttagggactgattctctcaggaaaggcacacatggtatgatggctcttcccagagtctatgtgatgctacataacttcagtatctagctgagacatgcttcctacatgactgttaaagcacagccaatccaggccaagaagactagtaacaggcacgttctgaaagatggaagcagcactgatagatcaaaaccaccactgcatatgtattacactgttttgttcaccattttcctaagtgtgttatttagaatattggttattacaaggaaaaataaagtggggaggctggttaggccttgtgagttgggaaacttaggttataaaaactaaataaagtttttctactgtgagactagaaaaaaaagaaggaaaaaaagggggggtatgggggggggaaaaaaggttt

SEQ ID NO: 178303 - DNA, 718 bp, Homo sapiens
ggaagaaccctctgcctaaaactgtctccttctcctggtgctacaaccggaatccaccatgagagagtactttcttcggttctttcctcctgtccttgacagagtaacacgttaatctggttcttggtggtgttagggactgattctctcaggaaaggcacacatggtatgatggctcttcccagagtctatgtgatgctacataacttcagtatctagctgagacatgcttcctacatgactgttaaagcacagccaatccaggccaagaagactagtaacaggcacgttctgaaagatggaagcagcactgatagatcaaaaccaccactgcatatgtattacactgttttgttcaccattttcctaagtgtgttatttagaatattggttattacaaggaaaaataaagtggggaggctggttaggccttgtgagttgggaaacttaggttataaaaactaaataaagtttttctactgtgagactagatgtgcaggagtgaaaggtgtagagggtcttgttttccaaattcgatctcagaatctttttgccagaagtgtctcatgggacttatctatagtggaacacatttgaagacctactgctctattaagaaggcagccggacaacatgttctaatacttcgtatgctttgtgacctagttaaaatctaaacttaagtcgccatggccagtggcctttagattaagctagc

SEQ ID NO: 178304 - DNA, 216 bp, Homo sapiens
tgaaatatgccaaacatagacaaatcccacatgttctcatttatatgtgagatataaaacaattgaactcccagaagcagagagtacagtggtgggtacagaggctgggggtaggtggaatgggaaaatgatagtcaaagggtacaaagtctcagtcagataaaaaggataagtttgatttttttggacatctactgcacagtgtggtgaatatag

SEQ ID NO: 178305 - DNA, 376 bp, Homo sapiens
tcactctagacttggtattatcttagatatatttattgtctccatactcttgtccagtcagtctccaagctctattacttcaagttactctcattgttgaccttcatttccattcaacacaggacctggtccaagcctttctttcagtgtctcacacctagtttactggtcagggggcctaatagtctctgaatgtcaaatttaccactctgtccaacatcataacccagaccaactccatcaagatgcttgtatcatcatagtgcttccccattctgaaactttgaatagatccctatttcctaccgtgtcaaattttaactctccaccctagctttcatagctgacatgtccttgccccagtcttaacgatcaa

SEQ ID NO: 178306 - DNA, 540 bp, Homo sapiens
gctggattttgttatggcacactgttaaatcacttggagtcagctgtatccttttgatgcttgctcttaagcctaatgtgtcaggtccagaataacttttagtccagggctaatgaagccccactgctacagaaacattcttctgagaattctggcagatgccccagctacaactcttcactggtagaaacacggactattctcagccttgtttgaactctaggaattgttctgcctactctttttcaggattctttgtctgacctcagatagtttcttgtcacgcatacacagatcagtactcaaaggctggacagaacccgctgtgtgtttccagagccatgtccacttccctgccgtagctccctctttcccaacacaccttttcttaaattccagccaccttagctttgatctgttcaacacacaaagaccactgggttttatttggattttcctctctgcactgcagcctgccagctgcttttaagtggtaagctcaggcaataataaaacacacattgcttctcaggaatcaca

SEQ ID NO: 178307 - DNA, 617 bp, Homo sapiens
tagtagagactgggtttcactatgttggccaggctggttttgaacccctgagcttgtgatctgcctgcctcggcctcccaaagtgcttggattaggagcgtgagccaccgcgcccggccgtatgacctcatttatatgtggaatccaaaatagtcaaacacacagaagcagaaagcagaatagtggttgcaagaggctgagaggtgggaggaaatgaaaaggtgttggtcaaagtgtgcaaagtttctcatgaagagaaactttttttttttaatttcatggggaaattaaaaaagcaaaaagcaaaaaaacaaaaacaaaaaggaaagtgtacaaagtttcagtcctgcaagataaacaagttctggaggcctaccgtacaacatagggcacatgattaacaaatacggcgttgtacatttaaaactttgctgaaagggtaggtcttatataagatcttatgttatcacaaaaggacaaacaaaaccaaagcggagtgaagaaatgaactggaagggaatttttggaggcaattgataagtttatggcattagttgtgataatagtttcaaggatgtatacttatttccaaacacgtgaagttgtatacattaaat

SEQ ID NO: 178308 - DNA, 335 bp, Homo sapiens
tggctccctgtagcctcaacctcctggcctcaaggatcctcctgcctcagcctcctgagtagctgggaccacaggtgaacaccaccatggctagcatttttaaaaatttgtttgtagaaatggggtctcaccatgttgcccaggctagtctcagagcaatcctcccacctctgcctccctaagtattgggattacagtcatgagccactgcgccttttctgataaaagggatggccatgtctggcactgcccacttccccatcttcaggccacagcggcacagacatcgtgcctggtgctgtggcagccatcttggaaccacgaggtaagtgtca

SEQ ID NO: 178309 - DNA, 210 bp, Homo sapiens
ttgtggatgccaagaaaaaagacccttcaataatggacatcactgaaatccacaagctgatcaggagacctgtactgccctggtgccaggagccattaaaagatggaatgtgctgcccttaaagagaaacggataaaggtaactaacagtgaagcctatgcaccaagtggagcataatcatcatgaaggcactttgggcaaaaaatgtgg

SEQ ID NO: 178310 - DNA, 371 bp, Homo sapiens
tctctctctgagtttgtgtgaatgtctgtgttgattgcatgcccatgcaaagatatttgctctctgcatctgagcagcaggaagccattagaagaggaaacccatattggatgagaatttcattccacacccaggaaagcagggttaggatgtgggggcaccagctcaggccctggtagctgtgccagggacctaggaccctggcattgtgaggtcccctcctctcagagccagaggatggggagaaaggacgagatgcttggctgctgaaaccatggactggtggtgaccgccattcccaccaccctaatcatgcacttgtgatattaataaaaataatttatgtcatgtgactgctttttaactagctg

SEQ ID NO: 178311 - DNA, 302 bp, Homo sapiens
ggacctgtaatcccagctacttgggaggctgaagcaggagaatcacttgagcccagaaggttgaggctgcagtgagccatgatcgtgcccctgcatgccagcctgagcaacagaatatgaccctgtctcaagtaaacaaacagataaacaaaaacccaaagtgattaacaaaataaggatgagaggagggaaagcctctttttagagaagactgccaactaatgaggagaaaaggaaagatagaaaaattaccaattcacaaccaccaatgtaatactgatttaggcaggagtcgttaataa

SEQ ID NO: 178312 - DNA, 540 bp, Homo sapiens
aggaatagaaggaaattacctcaacataataaaggtcacatatgaaaaccacctgtttcatcaatgaaacactcattgatagaagactgaatacttttcctctaagataaggaacaagacaagaatggctacttttgccacttgtactagaagtcctagccagggcaattagtcaagaaaaataaaaggcatccatagaggaaagaaagaagtaaaattatccctcattcacagacgacagaaccttatatgtacaactctaaagatgaccaaaaaacttttagaataaaacaaattcagcaaaactgcatgttattagaaataagaatcagtaacgtttctatacactaacaatgcacatcccataagggaaattaagaaaacaattccacttacaataccataaaaaagaataaaatgttcaggattaaatttaaccaaggaagcaaaattcttaaaacatttaagtatacacttaaaacgtaagtatacactggttggacgcagaggctcacacctgtaatcccagcactttgggag

SEQ ID NO: 178313 - DNA, 442 bp, Homo sapiens
cacactgggggctctggctgcacagactgattggatgattgatgactaattgctaacggctaattctaaccaggtatgaggagctgaacaggggctgccgtcttctccgccttcctccacctgcaggagtctctgtctgtcttgggcatggatcctatgctgcccgagtgtgtaaattaaggaataatagagctgcagaagcataagccctcaatgatggggaatatgtttgtctgctaagaagcaatttcagcgaaaattaactccatttcaacagaaagagtgaggcttggcataagctggccaatcccagaggacaataaaattactttgtcaaagctctgcttgcttaaattaaccaagcgagcactccaggatcctggctagatacagcaagtaactaggttttaatgaacaaaaatagcttcttggataaatgaga

SEQ ID NO: 178314 - DNA, 166 bp, Homo sapiens
acggagacatcaccacatggacacaccgtcacactaccacagggacacacagacacacaagagacatcaccacattgtcacatggacacaccatcacacacatgaacacacagacacactgccacatggacactgccacacacagacacaccgccacactgtcaca

SEQ ID NO: 178315 - DNA, 414 bp, Homo sapiens
tcctcaacaaaacactacgtaactgaatccaacagtatattaaaagataatccaccatgatgaagtgggtttcataccaggaacacagagatggtttaacataggcaagtcaataaacgtgatatactacataaacagaatttaaaacaaaaatcacatgatcatctcaatagatgcataaaaaggatttgacaaaatccagcatcctttatgattaaaaccctcagcaaaattggcatagaagggacataccttaataaaagccatctatgacaaacccacagccaacattatattgaatgaggaaaagacaaaagcattccacctgagaactggaacaagacatggatgcccacttttaccacttctcttcaacatagtactggaagtcctagccagagcaatcagacaaga

SEQ ID NO: 178316 - DNA, 586 bp, Homo sapiens
tggagacaggtctcactcctgtcgcccaggctggagcgcagtggcacactcccaggctcaagtgattctcccatctcagcctcctcataagtagctgagactacagacgtgcaccaccatgtccggctacctttttgtatttttggtagagataggtttgccatgttgcccaggctgaccagctgggcaggctcaactaatccgcccgccttagcctcctaaagtgctaggatttcaagtgtgagatgccacacccagccaagacacttttaattaagatataaaacctaatcaaaagtaaagtgcttctttagatccacactgacaattagcatcattagctgaatgtcctcttcagcaagaatgcagacgggccgggcacggtggctcatgcctgtaatcccagcactttgggaagccaaggcgggtggatcacgaggtcaggagttgaagaccagcctggccaatatggtgaaaccctgtgtctaataaaaatacaaagattagctgggtgtggtggtgcacgcctgaaatcccagctactcgggaggctgaggcaggagaattgcttgaactgggacctggg

SEQ ID NO: 178317 - DNA, 563 bp, Homo sapiens
actcttagttcattaggtaaaacattttaaaatactgatacctaattttaaaggaagtatattaaaattgaaatgcttatacactgctgatgacattacaaattgcctcaatctttttgaaaattaatgcaaaaaccagaatgatggtaatatcctctgatctagtaagttcatgtctagaaattttacttaagcaaaaaatttaaagaaatgtgcgctgtttcaaccttgcctagcacttcagagtcagtattacagtcaatttaaatgagctagagcctggtttaaggcagtgtaaagatctatatttgagacatccaaattgccatcctgtactccaaaggtgttatctgtatgacagaacaataaatgaaatctacaaaataaaactttatcaaagctaaggataagtcacaaacaagccaaattctacattttagaatctcatcactggaacacaaaggctccagaacaagaggccaacattatgaccagactttcagggtgaagaaacatataaaacacaaaagaaacgaagatattctgagactcaagaacagagt

SEQ ID NO: 178318 - DNA, 556 bp, Homo sapiens
ccagttgtgtcaatgtggatttgagtgctacatgaaagtacatttttagtacttgcttctttttattgggaaactttttgggtatgtgtggaacaacttgagcatgagaagctactttttgaactattcattttataagatctatagatcaagtctttctgatgaaaatgtaggatctaaattgagatgtactctgtttaaaatatacattggattccaaagacttgataatgcagaaaagaatgcacaatatctcaataatttttaaaaattgatttcatattaacatatttggattgagttaagtaaaatctattaattttacctgttactgtgtacttttttaatgttgctactagaaaatttaaaattacacatgcttgaattgtatttctgttgaacagagtttaataatttttggcatcatagaccttttaatagagtaaaatcttagctgtatagaacttctgggaacttgggcattctaaatagtgaaatcatgctaggtagcaaaattttctggataggtatagtttatctctctagatgtgaaaat

SEQ ID NO: 178319 - DNA, 237 bp, Homo sapiens
aaaccctgtaagtctcaagcagaggccttttttaaaatcaaggtccataggcttaggcaacagttcagtaacctttgggaaaaccacagggtgtgttttacctattgttatgcaaacattgttcttccagagctgacctttactcacagggatttaacagccatagtaagtcagggtttgaattccctgtgtctgagttgcggatcaagtttacaataaccatgttcacaattgttt

SEQ ID NO: 178320 - DNA, 306 bp, Homo sapiens
ctagaggacccactaacctaatcgccaaacagggcacgttaccatattattctttctctccaagttcttcgcgcaagaactctgagttccttacaggcagcagtgtcttgactctagatcttgggggatattcttaatctctgcttgctgtgaacacatgaggcactccttgtcagaggctacaatgtccccaggatgccgggctaggatacaaatgcttgtgcctgggggagtgcagggctctgggaatcagcacgtggaggttttgtgctctaagtgatgaagattctctgcgattagggcagt

SEQ ID NO: 178321 - DNA, 370 bp, Homo sapiens
cgggaacaaaaggcccaagtttggagtaatggggcacggggagattccaacctctccaggctgtgccacttactagctgtgtggctacagttatgtggctgcgtgagcctcaagttcctcatgtataaaacggaggtaaaaacagtcactgcctctggggttgctggtgagcattacatgagatcagtctcataaagcactcagcacagttgcggcgtgcagtaagtgtcaagcagtggcagcctctgttaggagctgggactttctccaggcactggggagccataggcggatcctgggcagggaggtggtgtgattggatttatgctttagaatggcatggagaaggggtagagtccagaaggaggga

SEQ ID NO: 178322 - DNA, 513 bp, Homo sapiens
ctgtgaatgctcacacagcgcctgggaaggcggataactcagagatgcttttctgggttacttttgttctgaggtaagagagggcagcaagtggaccccgatgggctgcagaagccggttcgcagcagggactgattacataagtgttggcagtgaccccggtaagtctggtgttccttataaaccctgctttccacagttgagcagaagacaccacagatgagagggagcccctccctcactgagtggagtcttaatgggacgtttgtgactctcccttggacacttgtactctttctacaaaagttaatattccctgagacattatttacatccggaatggggctgtgtgactggaggtcctcacctgcccatgttttttgcatgttttgtagcaaactgataatgaccaatgtcagaattatctggctttatattttgaccttgttcattagagtagtgttaatgaaggagaaagcaagttaggggctggtaccttgctttcccttttta

SEQ ID NO: 178323 - DNA, 246 bp, Homo sapiens
agaaatccatgctaatgtgcaccattgtcactctagggggtaggaaacatgctgattgagtttattaaacgtgtgaaatgcaagccgggtgcaacccagcactttgggaggtggaggcgggaggattgcttgaggccaggagttggagaccagtctgggcaacatagtgagaccccctgtctctacaaaaaaatacaaaaaattatctgggcttggtggtgtgcgcctgtagtcccatctgccagg

SEQ ID NO: 178324 - DNA, 583 bp, Homo sapiens
caaaacaaatttatttgccataggaagaagaactagtctgaagccacagcggtgtgccccagatgaacataccagaaagcactaagaatgtactctcagacacaagccaaaaaaacatggtccaaactgcccagctgagaacaactgccatatattacctaattggttaaataagaccagaatcaaatgatccaagaagttaaccaactagcaaacaaaaggtgctaaaataaaaggggcttgggtcatataattctatgggctcattactgaatttctgtgcaattaattgttagcatagttatttgaactatgactatcaagaacaacagtatgtccagaaataagaactactgtcaagaatggtggagtctgagattttaccctacttgcaaactaacttgtaagcctaacacagttttaaggatgctggcagataacacgagacccctgggccacagatacagcagtaatcagagtatcagcattttcttttacctgcttcctgatcctcaatttctacatgatgatacagagggaaaggatacataatctgaatcctttatactggacagtaagcaaa

SEQ ID NO: 178325 - DNA, 389 bp, Homo sapiens
cgctcgtaccgctgatcgcttagcccgttggtattcaaaccaatgctatagcctgtagctacagagtaactgagagtttctagcaactaaagaggaaaaaaatgtatatacatagaatccaaatttcttttttccttttttctttctttttttttttttctgtgacatggtcttgctctgtcgcctaggctgaagtgcaatggtgcaatcccagctcactgcaacctctgcctccccggttcaagcaattctcctgcctcagcctcccaagtagctgggattacaagcatgtaccaacacacctggctaattttttttatattttagtagaaatggggtttcaccatgttggccaggctggtctcaaactcctgacctcaagtgatctg

SEQ ID NO: 178326 - DNA, 408 bp, Homo sapiens
gaaaaacaattttaaaaattgacaaaactaaggttggttttttaaaatgataaacaaaattaacaaacattaactatactatgaagaaaatgcttaaataaatatacttagaaataaaagagtagactttaaaactaatgtacataaataaaaagtattatagaaactactgtgaatgattatacaccaacaaattgagaaacctaggagacatagattcattccttgaaacttaatctacaatgatggaatcatgaagaaatagaaaatttgaacaaacacacaatcagtaaaaatatttaattggaaacaatacatatatgattaatttacatttattacagtgtcctaacaatgtaaagtccagaatcagatggtatcactggtaaattctaccaaatatttaag

SEQ ID NO: 178327 - DNA, 309 bp, Homo sapiens
gttaagctgcctctgcctgttgcctcccattacattcacaaacactccctgagcatcagttattttccagtcagtgtgctagggctagaggatgtgagaaataatcctcgccatggaggagttctcgatgttgggagaaatagaaaattaaatcacaaacctcattacaacatggtaaaggcaatcatatacatacggaaaaggtgctttcatccctcttctgcaggtgtatacagtttatattgccaaacagtgtgtgtgttccctgatggcacaaactgtatcttatgtttactttttttcttccct

SEQ ID NO: 178328 - DNA, 385 bp, Homo sapiens
aggcggaatgtgatgtactgatgtgcatggttggtatcgagttctctaggtggatggatggacagacaggtggatgatggacagatgggtggatggatggatgagatacactacagatgatatgagggatgctggctgagttaaggcctaggaagtgcgttgccagcaggctcttggggacactagtgtgtgtgggcaagtgcaggtaagtgtctgcaaggccctgcctgtgcagtcctgtgtgccggaggaggggtgggaacagcagctatgctgtgtcagagtggactccagcaggtgtgtgccgccagctctggagttggggccactggactcctggctccaccacatttgccgcctgggctgcatcacttggtcttgctca

SEQ ID NO: 178329 - DNA, 590 bp, Homo sapiens
ctgtttctccccttttcctgacccgctgaatgggaatgtatctttatttcccctgggtatccagtacagagatctgtatctagtgatttcttaatagatcttgtttgctcactttccttagcatgttccctccgagttaggcagattctggactacttgaatccctgccacttgttactgcctcctaccctgcctgaagagcccctggggcctgagaagctcctctctgccccaccttcctcctcagttggtcttagcaagattctcccagcagaagctgaagatgctgaaggagctctccagggcatgtgcacactcgtctggcttcttatcaccaggaaggccgaaaacacagaggaacatgcagccctgggatagatgacaaacaaagaaatgagacacttacctgggaaaggaatgtggcttgcctaaactaaaccagctccaccgaatgaacccagaccctatccttgaacactcttctgttggaaatatcagattctacatgattcataaaatggaaatgctgggccacagcaacatacacttttttttttttttttttttgagattctgtcgcccaggctgga

SEQ ID NO: 178330 - DNA, 1634 bp, Homo sapiens
cggccgctgggtccgtgaaggggagtgaggcactcctcaccctgtggcagctcctagtcaggaggcctctcccctccacctgcacgtcatgtggctgtggctcccaggaccagcgcctggagcgggtgagtgaacgtccctctcctccgtgggcactgcctccgctgtgagccacccttcaggctacgtgcatttccgcctgttctcagggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggggaggccccacaggagaatcgatggttctgatgctgtcagcctctgggtgcaaattctgagggcccgggagcgtctggcggccctgagcagcttgctggggaagctccgtggaggaggaagtccggaggcatgtgatgtgaatcagctgacatcatcttgacgggagccctgtgaggcggacacttaactccagtttcacaggagggagccatggatttgctgcgggagctgaaggccatgcctatcacgctgcacctgctccagtccacccgagtcgggatgtctgtcaacacccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgtgcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattagatgtttctttttgcc

SEQ ID NO: 178331 - DNA, 312 bp, Homo sapiens
gcaaacagcttctcattttcccgggagtaccttctgccaactttgagaacaccaattcctaattcctgttccagtatccactttggttttatacataggacatcttttcctataagttttccctgaatgttttgtttctattttttttttttaacatttcttacagatgtctataaaactctcagaattcttataaaatactctttgatttgaagaacgtagtcatttccccttaggcttatgatgcctcagtctccctataagagatacgaaccaggttgggcgtggtggctcatgcctatagtcccagca

SEQ ID NO: 178332 - DNA, 584 bp, Homo sapiens
tctgtttatctgtggggggatcatccctttgacggctcttcccaagcccctgttcagtctcaagtcagctctccctactccctccagtgaccaggcccctttcaggtcattagtcagcaaaccaaagaaggcaaattcttcaaactgaagtcagcaaactagaaggaagaaagtgactctgatgctgctaccagaataatcatacatgttttttaaaaaggatttatttttaaaaattgtggttatatatatataacataaaatttaccattttatgttaaccattttaaagtgtacagtttagtggcattcagtacattcacactgctgtgtaaccatcatcacgtccatctccagaattctgtcttctccccaaagagaaactgtacccattaaacagtagctaccctttcctcctcccttcagctcctgggagccaccattctacttttcgtctctatgaatttgactactctaggtaacccatataagtggaatcatacagtctttgttgttgttgttgtttaatgactggcttatttacttagcataatgtcatcagggagcatttatgttgtagcgtt

SEQ ID NO: 178333 - DNA, 435 bp, Homo sapiens
tgtaccattctgattaaggcaaggatgcagatccacccccttcctcttcatcaaaatctacacaggcctctgtacctggggtttcttgatgtgattggacttactatcctgactgttgaaggcagactacatggggccactgtggaagaaaaatgacatcacactccctaatcctcccgctatgccatgagggactgggtagcattatcctttgtgttaaagtgagatactgctcatgggaccattaactatctgagctgttgtcctcaaacccagcagggaacaggaactggactccaaccccaagagcagcagcaggacatgaacagggctctcaagccctttatcacttaacttttctgagtctcagttttttcatatctatgtgtcctatgaccaacctgttctcatccttggctattttatttcccctat

SEQ ID NO: 178334 - DNA, 479 bp, Homo sapiens
gtagagacggggttttgccttcgcagagttgtggaaagtgactgtcactgtgtttaatctcggctccagcagccagcagaaacctcagccagaaacaggggctccctgcgcccctgcacctttccacgcggagcccagcgtgccctcccctggcgaagctcctgaccacagccctccatgcccgcgatggctatactgtgcagggtacccagggcacagggcagccccactcctcatttgcaactgtgagcactgccattggattcctggccaccatcctttgtttagcctgtgctatgtctggtcactgtcttttggactccttactgcctgcttgtgccagtgtccaccaaatataaggcttatccagcagggtggacgtcctgtgccagaggctccatccatggcaatagttccccgagagccacctagacacagaacacctcattcctgttttccaaccgattttgtctcattga

SEQ ID NO: 178335 - DNA, 128 bp, Homo sapiens
taaatgtggggctggtgtgcaataggtactcagtaatgctggggcggtgtgcagtgggtgctcagtaaatgctgggccagtaagcaataggtgcttagtaaacgtggggtcggtgtgcagtgggtgct

SEQ ID NO: 178336 - DNA, 391 bp, Homo sapiens
accaacgccgctgactgcatccaacgccgctgactgcatccaacgccgctgactgcatccaacgccgctgactgcatccaacgccgctggtcaccatgaaccacattgtgcaaaccttctctcgcggtcacagcggccagcgtccccaatacgagatgcgcaaggaggagcaggaagtggctaccctgggggccgcgttggatgcagtcgactgcatccaacgccgccctccgacgcacaccacacgcgcgcgcgcgcgcgccgcccccgccgctcagtgactgcatccaacgccgtaatgctggggcggtgtgcagtgggtgctcagtaaatgctgggccagtaagcaataggtgcttagtaaacgtggggtcggtgtgcagtgggtgct

SEQ ID NO: 178337 - DNA, 398 bp, Homo sapiens
tggcctgaattgatatttagtgatgcataagtggtggatattactgcaatttccttcatacaactgacaggagttgagcaccttctcttcacattgctccaggtttcagatcctcaggtgggacaggccagttctgaggtttctgatagacacctcccagcgttggacagtgccttttgttaagaggggaatgcttttggggaccacagcctgtttacacacaactcaggctctagagctcctttagcctcttccaattgcacacacgaatgtaattcactgagaggaggactggccccagccagacccacctgtcctgtgatcttagaacaatctgcctttcctgtgggtggatacttgctctctggatgatcaaatgatggaagattgcatggggc

SEQ ID NO: 178338 - DNA, 479 bp, Homo sapiens
agaaaaaagaattctgtctcaagatactagggacgctaaaagtttgctgtttataaaggggattttatacaatgcgtacctttgactttgtgccttcttgccccaggagttactccttttaaatagatagctcatctacagatcctgcagataatccttctggtataaccagaatacgtagttatttatacatatatgtcccataattttttcctttcaaggtaattgatgaattatactaaacaaacaattttctggctgacaagtactgtactttagtgaatttgcttgattaaattgtaataatgaaattaaattttatgcttgctgtgtgtctacaaatgcagttcctgttgaaaatgagacaatctgaagtgccttctaatggacatcccacttccttaatgtttcttttgtatgtgtaagggagaaagtctaatgtctgttctttccctcatagattcttagttgagacactc

SEQ ID NO: 178339 - DNA, 314 bp, Homo sapiens
ccagccccaagttggtcttgagctcctggactcaagtgatcgtccaaccagcatctcattttctaaagaaagaagtacttagaccaggtttgggacatgtctctgaaaattctgggctggtgcagtggctcatgcctgtaatcccagcactttgagaggccgaggcaggcggattgctagagtccagaagtgaagaccaggctgggcaacatagcaaaaccccatctgtactaaaactagaaacaattagccgggtatggtgacatgcagctgtagtcccagctactcggaggctgaggtggtaggatcacctg

SEQ ID NO: 178340 - DNA, 98 bp, Homo sapiens
tcctcccttccttctttccttgctttcgccgcgcactccgccgccatggagcagcgccgcgtcaccgacttcttcgcgcgccgccgccccgggccccc

SEQ ID NO: 178341 - DNA, 195 bp, Homo sapiens
attgatttactacactacatgtgtgaataaagaaaatgtgacgctttcaaacacgggtcattctactccacttgaaacaaatacataacaattgatatagatgccaataagattagaggcaaaataagctggatatagctagaataggaaatgatttacactactaagaagagagctaaaccgggtacttatgag

SEQ ID NO: 178342 - DNA, 330 bp, Homo sapiens
ctgttacccaggcgggagtatagtagtgtgatctcagcttaatgcagcctccataccctgggctcaagaggtcctcccacctccacctcctgagtagctgagactacagccatgtggcaccgtgtctggctaatttttgtatttttgttagagatgggttttcaccatgttgcccaggctggtcttgaaatcctgaactcaagtgttctgctcatctaggcctcccacagtgctgggattacaggggtgcgccactgcaccctgctgaactatatttattagtacactttttcatacatgattctgagttagaattggacaaaagagaaa

SEQ ID NO: 178343 - DNA, 409 bp, Homo sapiens
ggctgggatccagtggcaagaacaagatgaacatttcttcatgaccatctccaaatccctatttgcctttaaataattaatgacaaaagtatatctgctgtaagaatactgtttcttagcagagaactattttaaatggtatgattcttactatcttttatttgctctagttttaataacatatttaatagcaacatctctctcatgccctcactctggtgatcacctaacccccaaccccgacagacttcttcagtatggaggcacttaggacatctcgggatgtctttagtggtagtatttgaactacagagtcgttaagacgggcaacttgggagactgatagctgagatttgaatcacattttcttcacttattgggtgtggaattttgggcagattatgtaatc

SEQ ID NO: 178344 - DNA, 203 bp, Homo sapiens
cagatattagggacaagcaggaattatgattctaaattactctataaaccttttggctaacaacatatttcaaagggatttggaaataactctccccaaagtcattatttgtgaatatttattttatagagcactgaactgtttattcaaagtattgcacatccatagacatgttctctttaccacactatcctgctgttagg

SEQ ID NO: 178345 - DNA, 219 bp, Homo sapiens
gccagccgggccggcaggagggcggcgcggcacaaccatgagctttgagggcggccacggcggcagtcggtgtcgcggggcggagagcggggacgccgagcctcccccgcaacctcccccgccgccgccgccgacgccgccgccgggagagccggccccggtccccgcggccccgcgctacctgccgccgctgcccgcgtcccccgagacccccgagcg

SEQ ID NO: 178346 - DNA, 680 bp, Homo sapiens
tatcaggctctggtctttttgttctctaaattccaagacatccatatccagtagttctctctaaactgtctcacttgactttgaggaggagaattaaagaaaaatctaggaaataagatatggtggtaaatttattttctgctcacaaaaaggaaaataatctgatggattaattaagagttcaaattgacagtcttcctcccctgcaagttcaagcattgagtgtacatacagcttaataaaaaatgaattgtagtcatgctgatttgggattgacatacttttttggtcactggctgaatctacatgtaaatttcaggatcctaatttgtcatcctcattgaattattttcaaagttagggtatgttagactaagtatattcctttaaatgtccagttttatatttgcctcatttgattggtcattaaagcaggatagtttgcattaggaattttatcctctgtgtatctgcagctgcaccttttgttctcttcggtcatagcaaattggcctcattaacagcagaaccctattacttaaaagaaaaatatattcgctcacagttctggaggccagagctctgaaatcatggtgtcaagggttcattccttctggaggctctaagggagattccattccatgcctctctcctagcttctggtggttgtcagcgatttt

SEQ ID NO: 178347 - DNA, 310 bp, Homo sapiens
acgttgacacttcagtagaaaccacacttcaaatttcgaattttgattcaaaattctttataataactttatcgtaaaataggctttgtgttagatgattttgccccaccgtatggtaatgaaagtgttctgtgcacatttaaggtaggctgggctaagctataatggctggtagcttaggtgtagtaaatgcattttccgttggtttttttttttttttttttttaaaaggcacagtctcgtttttttgcccaggctgaagtgtaaacgggggccccgggctcaaattcgaaataatggccatggtttt

SEQ ID NO: 178348 - DNA, 713 bp, Homo sapiens
  misc_feature (61)..(61): n is a, c, g, or t
  misc_feature (90)..(90): n is a, c, g, or t
  misc_feature (116)..(116): n is a, c, g, or t
  misc_feature (147)..(147): n is a, c, g, or t
  misc_feature (153)..(153): n is a, c, g, or t
  misc_feature (166)..(166): n is a, c, g, or t
  misc_feature (189)..(189): n is a, c, g, or t
  misc_feature (236)..(236): n is a, c, g, or t
  misc_feature (244)..(244): n is a, c, g, or t
  misc_feature (263)..(263): n is a, c, g, or t
  misc_feature (289)..(289): n is a, c, g, or t
cccagatacatgctcccactgccccgacactcccgactccaggcccaatgactgaaccttnctttccaggctgggaaccactcccctccncatcccctccatccccatatctgggngttgcatctatatctaggtcccagtgggccntggggnactccctcttttnaagtcctcccctctgacctattnccgtttatatcccacccgactgattttagcgcctccaatatatgacntgattgtntcccgctggaaaccagtgntttgtgtctgtgtgtaaacagggccnaggatgacctagaatattgactcctgagttttaaaacttgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccac

SEQ ID NO: 178349 - DNA, 715 bp, Homo sapiens
gaagaaggtgcctgcttctcctttgccttccagcatgattatgacagtgagggccctggagaatgacagatttacaagatggagacaacctggatccctgagtgactgcatggaggatagcacccccaccaacttgagtaccctgatttcttgttacctgtgcgagaaataacattccatcattagagtcattaaacatttgagtctatttgttacggtggctcggtctatcctaaaggacacactgctctacttaacttcaggaacgggataatgaatactcaataatgaggagccccttatatatttcagcaagatatttattacttcatgtagactacactattactttgtgtagacaaggctgagaaacaaggatggttgctgacctaggtcagagaagtagtactgactgaaaaaccaaacctaaaggttaatgaatcactgtccaaccatatatattcctttgggctttattatcagttctgtccttttcaacatttgtagtaatgacttggatgaatataaagaatgctcacttcccaagcttgcaaaatccaccctggattggacaatcgtgattcacaaatatcttggcgttttatttgcattgtgttgttgtatcctaacaactatggagagaataatgaataaaaactttgacccaatgggcaggggacagaagctgggctttaaagggaaaggtgattgcgcc

SEQ ID NO: 178350 - DNA, 528 bp, Homo sapiens
ctttgttcatatatttgttgaccattagtatgccttctttgagaaatatctgttcagatcatttgcctattcaaaatgtaaatgttatgctatgtatactttaccacaattttaaaaagtacacacacggtgaaaaaaaaaaaaaacaattagctaactggtgattgtgtgaaggatgaactggattaggccaaggtgatcaagaagaagattggtagattaacgtggtcaggaggtcatgagaacttcaaatgaggcagtgaccatcaggaaaaaatttgtaagaagaatggtcaggaccaaatgagtttggtttggtcctgctgagtttgaggcatatggtggaaactgcccagctccctccttcagaaatgagacactctttccctagctggcctggtataggctgttaatggccaccagctgtgttcctttatggggctcgcccttggctggagctacaaggagttcatgggtgactttggccagaggagttgatgaggagaggaaggtctgggttgcagagga

SEQ ID NO: 178351 - DNA, 414 bp, Homo sapiens
gtggtgctgggagtggcataccctcgccagtgctgcagagaaggagagaggcctctgcggagggaaacacctgcggctcctcttccccctccctccagccccagtcatgcctctaagttacttgtctcttgccaaataggcttcccaggatggtttgacaaagtttgatatgaactcagggaggtggctagcaaatactatcagcctgagacagaggtaaggtcaggtggccagtcctgtctgccctctccgatgagcacccaggttagggtagagctctggggacccacaatctctctcagacctttcagctcagtcccagcctgtccctgcccattagacacataaagtccagatccccctgaaacagctccgtccctctggctctccatgggacagctcctctgcattttc

SEQ ID NO: 178352 - DNA, 386 bp, Homo sapiens
gcatcagttattcttctgtgaaattgggataattttacttttgtcaagggctgccctgaggagtgaatcagatgctatacgtaagctcagtgggtacaaggcctaatagtagtggcttaatgcgtgtactcttcttctttttccttaatagaagaataaggtgaaattaaaaacaaggttgataattacatgtatattttaatgattcatcaatcaataaatgataacattaacaataattttactgtcagtacttagaagttaaaaggagaatggtaaaatcagtctgttgatcctaaaagttttattttttctttcatcctttcataaattatatctgaatctagattactgaaatgcaacaaataaaaatatttacaaagcta

SEQ ID NO: 178353 - DNA, 670 bp, Homo sapiens
aaatacggctaggtcgaggcgggtgcgaatcggccgatgaatttaacttactttaatgtaggcaaactatcaatttttgtccattttcctgtttgttaacatacctctcctagatattcttttcttgacccaaatgaaatattaacctaaggtcaagctgggagagagaaacaactgagatgaatgtctttactaaaataccgataaatttgtcaaactcaaaaaaaaattgacgtgataaaattgggcatcctttgtgctggctgctgcacgaggcctcagttttagagattcctttcttaaatgaacgtggcttcttgagagatttcctgtaagtatctactcttcagggactgtaggttaatgtgctttttctctgtccataagtgtgtgctccctgacctttgcctaagtaattctttctcgtcttctggctggaagcgtcaagtcaagcactgtcttaggaatgcctttcctgaccatctagactgtcatgccccctaattcacaccctgttgtggcttcctgtactgtttgctttttaatttgatttttgtctctccctccactagattctaaactctgtgggggcaggagctgactgttttttggacttaacgtatctgtttttgctcaccactgttccacacctagaacagtgtctgtctgc

SEQ ID NO: 178354 - DNA, 290 bp, Homo sapiens
tcatagagttccacttttggaagtgttccaacctgcacccaggaggcttctgcagtcttttttgctgccagaatgtccgccctgatttacacctgacttcggcaacatctgagcattcatatctgtgctacatgctggctgtagccatgggtctcattctaaaacatccttgccttcaaatacaggcatgaggcagcagtggaggaaggagaggtaagaaactattcatcggccgatctcatgggcatgctgacggcaagagttatgaggtgtaaacctgggttcacatc

SEQ ID NO: 178355 - DNA, 378 bp, Homo sapiens
ctcaatccttaacctacaccacatggctttacgtgatttggccatgtccgccctctctacctgcatgccttgccttccctctttcagcctgcatttcagatacatcaatctttttctagcgctttcaacaaggcccaggctccttcactaaattagtgcctgatcaccctggagagttagggacatatccacaagcctcgatggactccccattctacatcagctccttgggtacaggctttcatagaatgatgttcctttccaccatagtgcttgcctcagtgtgaaattacacagcatttagtgtgattatgtgatgaacacctcactctctgaccacaataaaagcatctggagagcagggaccacacgactttt

SEQ ID NO: 178356 - DNA, 299 bp, Homo sapiens
cttcacccggacaagggtgtcactccagcacttagtcccctcatcatcaattttctcccattagcatacaaacacaatcttatctaaataaaacaaacggccgggcatggtggctaatgcctgtaatcccagcactttgggaggcccaggtgggtggatcacctgaggtcagtagtttgagaccagcctgtccaacatggtgaaaccctgtcgtctaaaaatacaaaaattagccaggtgtggtggtgaacgcctgtaatcccagctactcgggaggctgaggcaggaaaatcgcttga

SEQ ID NO: 178357 - DNA, 518 bp, Homo sapiens
agactctttcttcctcactagatttgaagaagcaaactgggctattgtcagcatctgtgtggagaggttcagatgacaaggaactgaggactgcctctgatcaacagcccggaagaaagagatatcttttctcagcaagtagcagttcttttctacagtcaagcctcaggagctaagcagcctgacacttgtgagttatctggcatgaagtaattattttctcagaagatcttatcattgctgatcaagtatgagctctaaccaaggagctgcaaaacccggcatgtgttcatatttcactgaagaatacctaaaaaaccctggtatctgcaaatgtaatttgcaaagttgacaccttatttttccccagttagcattttctttagcttctgcaacatttaggtttatagaagtgtatctaatatctaaactttatagtacatgcaccagaaatgttttgtttctctttcatgcttttaaaaaatatatgttattaaatagagtgaaggtttaactgt

SEQ ID NO: 178358 - DNA, 239 bp, Homo sapiens
aaaaaacggaccttctaaaagcaatcacagctggaagccctatgatcacaaatacagtttataataaaagagggtaaacagctctgttgtaaaacagactgtaggagatatgaaaggccatcaaatacagggatcttggcacctgttgtgtgttctttcccttactcacagctctctctgaccatcctgacagatgggctggcttgggcatgtggctcaggatgaattttcccaaattt

SEQ ID NO: 178359 - DNA, 642 bp, Homo sapiens
atttggcgaggcagtctcatttggcgaggcagtctcatttggcgaggcagtctcgaactcctgagcccaaatgatctgcctgccttgacctctcaaggtgctgggattacagacgtgagccagcattcctggcaaaactgtagttaatattgataagtataactctattccttcaagcaaaggccaaagtattttggggaatctttgtttaagaagacaggtatgtctatcacacaccttgtaaaacttttcatttgaaaacaacaaaatttaaaacataaaactccagggtggggaaatgtccagctgtctggaaaattcccttctttgccgtgcctcattccctggccatgcccgatgcctggagtgatgatgaactcatattgctagttctcaggtgggaatgatgcctcaggaaaaaacactgtgggtaaagaatgctttctgcactagcttctgactcactccacggtgatgtggtgggagcaattccaaccaaccccagcacggtgctagcatcctgaaagggagctcattaccaggaggaagggagagctcagtgcaagcatccaataattcactctctttctccaccaagcggttactccttaagggctctaaactgaatgacttacagagcga

SEQ ID NO: 178360 - DNA, 551 bp, Homo sapiens
cactttgcgtttatgttgaatagcattgctcggaagacagatctgacagcaaattatttatggtcactcaccttcttacttgtgtgcctagggcaagctgaataacctggctgggcctcagctttctcatttatgaaatggagatcctaatagcactgatgttgcagagcagacacagaaataagatcatacttttaaattgcttgtatcaatgtaagttgtaccgtcattgtaaataaattctggccaaattgcttgtatcaatgtaagttgtaccgtcattgtaaataaattctggccgttagtagttttctttctcctccccatcatagggaatattccagcctcttttgaggcctgcagcaggccagttgaggcatcaccattgaagttgctggtgcagtgtacaccctggcacaaggaccttatctgagcccccacactctcctgcttgctgatgggcaagccctgggctggctgatacctccaatctctttggagacagctggccatatggcaaaaaggctggaatggcatctccactctgtgac

SEQ ID NO: 178361 - DNA, 177 bp, Homo sapiens
atcaattactacacgtaaggtgtatatcaatttggtccggaaaggtggaacaactctaaatgggtggaggaggagccttgccaggttataagtggatgcaaagattttctgattggcaattggttgaaagttattatttcaagacctggaatcaacagaagggagtgtctgggttag

SEQ ID NO: 178362 - DNA, 639 bp, Homo sapiens
tgggaagattcagcacaccctagcagttgtcataccgtttctgtgctgtctttttgcaaaaggcttttgtgtcattgctgctagaaaaaggctgacctcctaccttgagcatccagagtggatgactgcattttttttccagaattctaagtcacactgcttttttccccttgttcaaaaaggtcagctgtgtttgattatatctttgctgcttttaacttgtcttttcaggaaactttttttccttttttgtccctactccctagcacactactaaaaaggaaaatgaaaagtcgttgaagtctttcctactggcctgtgataaaactgctcaagcagctataacccaagatgttgtctcttacgtttgataatgaatcaaatctgataggcgacacctcaggaaaaactgggcttatatttgctactagcacaatgaataggatatttaaacatgctcatcatgtaatgaaatatttatagtcaaggtttttttgtttgtgtgtttttggtttgggattgggttttttttcttttttaaattttagattgcttcagtataagatatacttttatgctgatacaaaaaaattgataacttttgttgtgtgggggtggtttttcttgagactattcaga

SEQ ID NO: 178363 - DNA, 421 bp, Homo sapiens
aagtattgggacgataacgtgtgcttaagtgtgggtaataagggagcacagatggtctagttttgcagagtgtgtgaggagcgggctttcattctttcattaacacacaggaacaaaacaaagccagcagctcgtcatccaccactctcccgcctgtccagtcagccctggggctcctttgctctctttctagaaacatttggccaatcaaaagtttgggataaggattccactcccttccctgtctcatctagcctctgctgctcacttaactatctgaattcactcaatcaaattatttaaactcgacatgcctcagcctcttcttctgtaagacaggtagagagccacctttaactgtagaattctttaaatattaaaaagtaaatgagatgatgcatatagattcacctaacacata

SEQ ID NO: 178364 - DNA, 541 bp, Homo sapiens
agcttggccttttcataaaaatgtatgtgggtacctgcaggtgtacagacacagtttacttgaagttaacgacactggaaggatccttataataagcttttaattagatattacaaacaaggaaaatataggaacatgagagctggaagaaattacctaagtccggttgcgacgactgcttgcgccaagttgttctaagacccaaggaggcaaggcatgctaacgtgaaccctaatgaggatggagaatcaagttcaagttctcccactgaagaaaatgcagccactgacaatattgccttcatgattaccgaaaccactgtccaggttctttccagtggggaggtgcatgatattgttagccaaaagggagaagacatacagacggttaatatcgatgccagaaaagagatgaccccccgacaagaagggactgacaatgaggatccagtcgtgtgcctggacaagaaaccagtgatcatcattttcgatgagcccatggacatccggtctgcctattagagacttcaactatctttgag

SEQ ID NO: 178365 - DNA, 600 bp, Homo sapiens
gctgggtagatgcgcttcctctctccacctgaggccctccagctgcaacactctctcgatggccaaacttccacaaagcattgccttccttcccgtctcccacagatgcttcaccacgtccggcccccagctcctctcttcctctgtccacagctactgctcatggactacaacatgccacgtctgcattttggattttgactgtcttgagcttgccgctcacatctgtggttacctcctggacatcactgcacatgctgcagcatctcaaactcatttcactttcttcaaaacaccccctgatgtttctttcagtgaatcctctgtccagctacatgtattgcttatggctgacacccatccctcaccacgtaccagctgtagccttgggaactacatttgatgcgtctgggccttagtttccccatttgtaaagtgatgatgaaaaatcatactcatttcgtagggctattgtgaaaattcagtgtgttaatatacgtaaagcctattgaagaaggcttggcatgttgaaagggttcaacatgtgttatcatatagctttgattctggttttacaaaagtagatcatactatgctatc

SEQ ID NO: 178366 - DNA, 456 bp, Homo sapiens
ctccaacctggaaattaaatttttatgggacatttcattaagggcaattaatttgtaaaacattctgtgggccaaagaaaacctctcagatctacaaaaccctgatctggagcccctgtggggggcatgctcaaatagttggccaggatgcttgtgtcctttaacgctgttccctgggccccactctagagattctgattgagtagatctggagtgagattcagaagtgtgcaccccggccgggcgcggtggctcatgcctgtcatcccagcactttggaaggctgaggcgggtggatcacctgaggtcagcagttcgaggccagcctagctgacatgttgaaacactgtctctactaaaaatacaaaaattagctgggtgtgatggcaggcacctgtaataccagctactcgggaggctgaggcaggagaatcgtttgaaccctggaggcagagg

SEQ ID NO: 178367 - DNA, 178 bp, Homo sapiens
aaggtggtgaaattaacagggaagagaggataatgtctccaggtctatatattaatttcccatgaaattcaatcaaatgtcatagatggcatccacattacacagaataatgggggtaaagcaaattaatatgaaatggccccgcttgtgagaccagaggacaccccaactagtctta

SEQ ID NO: 178368 - DNA, 344 bp, Homo sapiens
caaataagcatttgaaaagatgttcaacatcattagccattagggaaatgcatataaagactagaatgagatactactacatacttattagagcagctaaaattaaaaatagtgattttccaaactttttcttagtttaggcccactcaacctccattattttgtcttttaatgccttccgacaaattaaaaaaatgtgtccaggctgggtgcagtggactttgggaggctgaggtgggtggatcacttgaggtcaggagtttgagaccagcctggccaacatggtgaaaccccatctctactgaaaatacaaaaattatctgggtgtgatggcgtgcacctgt

SEQ ID NO: 178369 - DNA, 476 bp, Homo sapiens
ggcccccgttaggatactcaatttagtagctgtaaaacaaacatatttactctgttatgattctggaagttagaagtctaaaattagtctcactaagctaaagtcaaggtgtcagcagggctggttccttctggaggctctaggagagaatccttttccttctctgctccgagagactgcctgcattcctcagtttctggcccttaatccatcttcaaagccaggagtgcagcgtcttgcttctgttgtcgcatagctttcttcttctgtagtcatgcctccctctgcctcccttctatcaggacacgtgtgattacattgcacagataatccaggataatattcccatctcaagatcgtgccactaccctccagtcagggaaacagaacaagaccctgtctcaaaaactaataataattgactgagccactgcacccagcctatatattgttaattacttttaaacaaggtgtag

SEQ ID NO: 178370 - DNA, 347 bp, Homo sapiens
agatatccaaaattccactcctaagtcctaggcagatatgtctgtgtccccattcctgtaaacagccccactacaaatcacttcaggttgtttaaattaactgtttagatgtaacttttcattgccaacctgacaggttggtgccaacttgttatccctgaagtatagcgtaaagcctggaacttagcagatacttcacaggtatgaagaaataaacataattaaggcaatacaactaactgctaatttaaattttattagtgctggtattggtagtcctgtaaatacagtcagaggaattctctcaaaagatgttggctaacaggttattaaaaatactgctactc

SEQ ID NO: 178371 - DNA, 226 bp, Homo sapiens
ctgcagcagttccaggcatcacatccagagctggcaacatttgctcacattgttagaaaacttctagaatcctcccagcagagttcctcagtgtgtcctattggccagattctaaatgtgcccatttcctttttttgcttttagagacaaggtctcactcggttgcccaggctggagtgcagtggcatgattatggctcactgtgatctcaaactcctgggctcaa

SEQ ID NO: 178372 - DNA, 434 bp, Homo sapiens
cgggcaccttggctggtctgtctttccaattatcggattcagcttcagcaagagtcctaaggtaagaggtacctgtctgcgcgtggcaaagtcctttgcacaaccatccagtgcaggtgccagccttctagactctggcagagctacagagaagaacttcatgtaacttccagccgcatcaattgtgataaacagattggtctgctaactttggtatctccatgtctagcacaatccctgccacatggcaggtattctataagtatctcatgaaaggatgaatgaagtagttatgagatagaaaggataaaacacagccgggtgcagcggctcacacctgtaatctcagcaatttgggaggctgaggcaggaggattgcttgcagccaggagttaagagaccagcctgggcaacattgagagactcagtttcta

SEQ ID NO: 178373 - DNA, 443 bp, Homo sapiens
actatcatcgccactttaaaaatctaaatccgacagtctccatttactctatttgtaaataaaactttttactcaaaagttcctactcaggcagaaataggaggaaatacaattacagtttgtttgctacctttggaagtaccaatctaacttacaaaaaaatcaagaaggcaagtttcagccaggtacagttgctcatacctataatcccagaactttgggatgccaaggtaggcagatcacctgaggccaggagttcgtgcacagcctggccaacatggtgaaacgccatctctactaaaaatacaaaaattagccaggcatggtgatgtgcgcctgtagtcctagctacttgggaggctgatgcatgagaattgttttgagcccagcaggcagaggctgccgtaaactgagatcacttgattgcactccagcccaggcaa

SEQ ID NO: 178374 - DNA, 163 bp, Homo sapiens
acacgttcttcacttggcaagcccattccagcgcctagttctgattccacagtcacctttttgaggtctcctgcaccccaatgcctcccaaaatttaaccaagtggctcctctccctgggtctgcagcctgtactggaaggcatttctgaccattctgaagtc

SEQ ID NO: 178375 - DNA, 534 bp, Homo sapiens
tacaatgcataaatagcataggataaaaacataaatagtacagagatgaattatagattcaagagttggaaaaaaaacagagacctagtaaaaatgctgacatacaggaaataggtaaatagaggcagtagagtatagtatagtagtaataaggaacatgtaataaacatatctcattactgtatcaggacgaggctcataatgtaagccaaatggaatataggtataaggctatttgggtctggagtccacagagtctgcatttcaggtatcagtttctgcagttaactaagtgtagaccttcggccagttacttaatctactactaaagcctttactgtcatctacaaaatgaagatattaatagtactgcttataagcatataaatgtagagacttaaatacaataaattgtggttcatgcctgtcattccagctacttgggaggctgaggcaggagaatcacttgaacctggggggcggaggttgcagtgagccgagatcgcaccattgcactccagcctgggtaacaag

SEQ ID NO: 178376 - DNA, 408 bp, Homo sapiens
ccatgattacggttttagctgttgctaagccctgttctagaagatgagcaagacaagcgtctactgtcttggagcttacattctagtgtaagaaggaagaaataaaatctcagtataacagttactgataaaaggagtaaaaaaaacagagaatcataaaggtagagtataggaatagactggaatgttcttttgttttacttatttattttttagagatagattgtccagactatgttgcctaagctggtcttgaacgtctgggcttaagcaatcctccagcctcagcctccccagtagctgggactacagctgcccaggttagagtcttcctttggatagggttgcaggcttcaggatctaggagaatttaaccacgacaacaacaaaatagtaataataatgata

SEQ ID NO: 178377 - DNA, 438 bp, Homo sapiens
ggcagtgacaacctgactccacagtcatagaaacagcacagagctaggcaattgtgcagatggagacagggaggcaggaagcacattcactgtgtacagtatagcatcccactctgggcccatggttctacccgtgaacatggatgtgctctttgatcagatctactcttctttctgtgtgcttcagccatggacattcatggcaaaggaattattctctttgctaaaacagagatgcccagctataccctatgagagggggtaatgggtcagccatatacatcatgctgccactaatgaggaaagaatctccctctcaggaataattctcttgcatccagaccccagagaaggcaaatacttcatcctctcactcccatttcagaaatcatactttctaacatactgtctgaggaggtactttatgaggctcccaaa

SEQ ID NO: 178378 - DNA, 693 bp, Homo sapiens
tattctatttcccctccctctctcccgccccgtatctcttgtcacccttctcccaccctcgctcgcgtagccatggacggagccagtcggcggccacgtcagtcccattccatctcctcgtcgtccttcggagccggagccgtccgggcccggaggcggggggagcccaggagcctgccccgccctggggacgacagagctgcgagctcctcctgtgcggagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttat

SEQ ID NO: 178379 - DNA, 701 bp, Homo sapiens
ttactatttgctttcttctctttgggccccacactgactatatcatgagttactgtttctgcagcttttttaaattattttgcattttacattcatcttaaaaaaatcctgtgtgtgtatatatatatttatgtaatttaaaaaataaaaagcatgctgcttggcttggctagctaatgtgtaattgtacctggtaaacaatttttttctttgaaattctgatcatagagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttat

SEQ ID NO: 178380 - DNA, 690 bp, Homo sapiens
ttcctgtcacattcctcgggcatacatgtatcaagttcttactgagtacgggataggggtctggcctatactaagctaggcaggcagaagaggaatagtccatcttggggaacttgcactcagggggggaatgaagcacactcagagaataaagtaagacattaagacttccttggagggcagtggcagcatgagggtaaagagagtggtaagaacaactagaattccaagacgggacaatcaacaaacatccagtgcttctgccctaatctcaggtggaaaatgaactagtctggtcatatccctctccacctcccctcaggcctcatgtaataccaagtccttcatatcaccatgttccaattatcctgtaccctgcattggtgcccccaaccatgctttctcaacctctccagactttgaccttccttctactccttgttctgactagtagtcttgcctttgaagacccagtgccaatttcacctcctctatcaagctgtccaacccccggtcaagctactgttagtccctcccaacagtgggccttgtaggaatattgagcaatacctcttagctcttgtcactcactttggcacaccgtctctaccacaaaacagggagttccttgggcacgggagccatgttctttgccactgatgaattacctatcggggggaatctctgaat

SEQ ID NO: 178381 - DNA, 571 bp, Homo sapiens
accatgtctgttacattcactattgcagcttcagtactcagcaagggcttggaatacagcagaactcatggtagagctttcttctctcacccatgtctttggcatcactggggaacagagatgtaagcaccataaaatctatggcctaggactttgtggaatgggggcgtatatgacttaacacaagggtcccagcccaagggtcccaacccttttggcatttgaatttggatcattttcatcaactgctcagagaaggttgcagaagagaccagatagcatttgtcaaatcctactgctatgtctctggctttgtccagacacatctggaaaaggatatctcccacccaaacatctggacaagccgacctggtaagaggtctataatagctcctgggagggaggacccagcaagctaggtccagggcttgtaaggccagatcttgagatctatggggcagcttgtttacaaagcctcactggttcactggggacaaaccccaagagccaagacacactaagaaacacggcctttgttccccccagcttgataaagcgtctttccgggtat

SEQ ID NO: 178382 - DNA, 596 bp, Homo sapiens
tcacagtttgcaattatctggtgacttgtttgtgagcctccctaccagacaggagttgccacaagggcaggcccatgtctatctcctggcacatagtaacagcttaataaatacttgttgaatggacagatctgactgtataaaaattactaagttctacataaagagacacaagtagcaaagttaagagataaataatggtctggggaaaatattaggttggactacataaaattcccatgttgggcggtaaaaaaaaggttgagtattaacaatttatatgattcaacctaatatttttaacacatagcagatgaaggataaatttatctaatatacaaaaagctcttacaaaacaagacaggtcaataatccattagaaaaaataggtaaatgattaaaccagcagaccacaaaagaaaatgataatacagatgagaaaagatacataatatcactgaccagaaagtggaaacaaaaactgaaacacaaaccatggtttatctgctagacaggtgaaatacactagacttcatccatacacaggttttgctaaggaggtgaggaaaagtgcatccacacatttcatggctgga

SEQ ID NO: 178383 - DNA, 324 bp, Homo sapiens
ccctgaagaactgaatttcaaatactagtagcttgttagagaaggaagatgaaaaatgtcatgtttactccacatttcccaactggaaacttcactgttgtgcttttccagatgactaggaatgctcccgccctttccaatcaatagatactttcccctttgagtcagagccttagcaccatgttaccaaactcttcaacttagtaataaaattcatggctctggggttgaaagcccagctctgtcacttagatggtgtatgaccttgggtaaaaaaaaaaaagtgttgaaaggataagatgataaaatatgtgaagcactaag

SEQ ID NO: 178384 - DNA, 462 bp, Homo sapiens
atggctaccatcaaaacacaacagaaaattacaagtgtctgcaaggaagtggagaagccggagcccttgtgcactgctgacgggaatgtgaatggtgcagtcgctgtaggaaatggtcggtgagtcctcagatggcatggtgatcccacaggcagttcacacgagcaggaggtgggacactcaaacatccatccacagatgaatggagacacagaatgttccacaaaatggaatattactcagccttaaaaaggaaggaagttctgagacatgctacaacacaaaggaaccaggaggacatcatgctgcgtgaacgaagctggtcccaagaggacaaatgccgtatggttccacgtgcacaaggtccctggagtactcaaatccacagaggcagaaagtagagtgggaggtgctggggctgggggagtgagtgtttaatgggttcagagtttcagtttggga

SEQ ID NO: 178385 - DNA, 331 bp, Homo sapiens
tttattgggcactaactgtatgccaggccatgggggtgccggagagaacgacacgaagaccctcacccctcaaagttcccagggggaggaggggctgcttcacttgggaagcgtggggatggaattctcagccccccgatgactccgaggccggccacctgcctggtttctggccggacaccggacttcccctggaagttgctcgagactgcgcgcccccagcaaaaaatcaggtcggttctccgagcccagtctagcgcttcccgacccgcaaaccaaggcccagtgaccgtccccgctgcgcagccgcctgcgtcgccagccaaccacg

SEQ ID NO: 178386 - DNA, 356 bp, Homo sapiens
tgttccgtgtgtgtccctgtgaaatctgcgatgacacaaattaaagacaccaccatggatgttctgtaatactggaaagagggtaccctagggagaaggagaggcagaacactgcagggcagagggtccagggaatgggaggagagacacggtaggtggaggggtaaacaaggcaccgggtgggggtgccgcggtgaaggacacctggcactagggaagacaaggcacctcaggggagcagggcatcctcacgcctgagcttcagtatgtccagtttggaaaggggtgtccccatcaaaactggcagctgggggctggccgctcagcgtcgttcagcccaggagcggaacagctcc

SEQ ID NO: 178387 - DNA, 642 bp, Homo sapiens
ctagaggatccccctcgaatcgacgctttctctctcccttcaaataaacttggtgttctcaatgtatacatctaactatttgggaaagaagctatgtgatttcttttaaagctttttatatataaatagagacagggtctcactatttgcccaggctagtctttaacctctggcctcaagtgatcctcccacctgggcctcccaaagtgctgggattgtaggcgtgagccaccacgcccagccaaacactgcctgtttaattccttttggtcatgccaaaatgctctctgagatgacttagcagtctgcacttggtctgagatgagaggtgacctatttttctcctccctcatttctgatcctattcaatagcattttttttctttatttcttggtagagatggagcctggccaacatggtgaaaccccgtctctactaagaatacaaaaattggccgggtatggtggcgcatgcctgtggtcccagctacttgggaggctgaggcagaagaattctttgaatcctggaggcggaggttgcagggagccgagatcgcgccactgcactccagcccggcagcccgggtgactgagtgagactccgtgaaaaataaacaaacaaacaaaaacggggataattct

SEQ ID NO: 178388 - DNA, 747 bp, Homo sapiens
aaacgatgtctacagcacttgagggttcattttaaaacccagaaacttacttgggctccctgagccttcatttccttatggcgacaatctcaaaggctggaaggctaaatgagattatgcatatggcacttcatgtaggtcctggctcttaggactcgctaaacaaatgttagccatcaaacctgccactgcctgatgttcctaacggccccgcgtgttaggcaaggggtatcattgttcccatggtgcacttgggaatgcgaaggggagccactcatccaagggcgcaaagaacagattagaactcagctcgcaggtatcccaggccagtggcccttccacacgactggctggcagatgcagctgtagaaccagcccttcccttcccagcgattccctctccttggtgcaagccctgctcttcccacggatgcttccctagacccatgtggcatttcagatgtcttgcttatggtttaattaatagtcctttgatttcattctcagagaatgaaattggcagtgcctgggaggccacccacatctgccaactgctctgatttccgttctaagagctttgcgtcagaaagagaggtccggggaccagcaaggaaaggtgggggtaatcccagggcagccccagggcctcaggacaaaccttttccacccttagaagatgtttacacagagtagcacaaagcatagagtaccaaacaaaaccctcaccccttcctccggccctggaaa

SEQ ID NO: 178389 - DNA, 311 bp, Homo sapiens
tcaagaaaataaaacccagccatgattctagtcccaggcccattggttctagaaatgaaacagatggctgggtgtggtggctcatgcctgtaatcctggcactttgggaggccgaggcgggccgatcacaaggtcaggagtttgagaccaccatggccaatatggtgaaaccccatctctactaaaaatacaaaaatcagctgggcgtggtggcggatgcctgtagtcccagctactcgggaggctgaggcaggagaatcgcttaaatccgggaggcagaggttgggcaacagagtgagactctgtctaaa

SEQ ID NO: 178390 - DNA, 263 bp, Homo sapiens
agtcctagctgctcgggaggctgagatgagagaatcacatgagcccaggaagtcaagactgcagtgagccatgattgcaccactgcattccagcctgatcaacgagagtgagaccttgtcccctgtctcagtaaatgaatgaatgaatgaatgtttcttcagctggccccattgctgtggatttaaagaaataccttttcttcctggttttatttaacctttgagatccatccaataatctctaataccatcaattagcactt

SEQ ID NO: 178391 - DNA, 127 bp, Homo sapiens
gggttacaaagtgagactgtctaaaaaatttaaaataaccagaacttctgatttatcatggcaatgtgtcactcagtccccaatcctgctacttaaaagttatttttattttttaagtggcctgatc

SEQ ID NO: 178392 - DNA, 429 bp, Homo sapiens
ccctggcaacctccatggtcgtatttgtgcttctttttcctgataagcacagctataatttattcttccaactggtctcaatcctcaactatacaatatagaatacacggtatctcaaggcatagaatggctatcataatataccactacatttatcaaggcatctaaatttttaagatatttttgccattcaacttggtaaattcaaattaaattggtcacaagtgtgttttttctccagaaattggagattgaaaaatatagccagtacaaacacaaagcaaagctaaataaaagcccagcaccattaccacatggtatgttttcaaaatccaacagtgttccagaacgctaaacacttaagttggaagtagcactttaccatgaaaaggaaccagctgtaggtccctctttcacaacatattgttc

SEQ ID NO: 178393 - DNA, 259 bp, Homo sapiens
accgcaacgtctgcctcccgggtgcaagcgattctcttgcctcagcctcccgagtagctgggattacaggcgtgagccaccgcacctggccgaggcagcactttcatttatttccttttttattttttttttgaggcagtcttgctctgttgcccaggctggagtgcagtggtgcgatcgcggccccctacagcattgacttcctgggcttaatcaatcctcttacctcaaccttgcaagtagctgtgactacacgatg

SEQ ID NO: 178394 - DNA, 776 bp, Homo sapiens
cggcagatggggcgctgtagaggacgttcttaggcagtagaggactgcgcggccggcgaaagcctagaagacttgggaattttgcctaccttgtgttcctcctttgtctctcggtatcttcgttccagggccagaggcaggattggttttattttgcagacagaaatcacacctcaagtggacagcgctcaaaacacgttagaagcagtatagtacaacgataatactaaacaccgatatggcacttgctcgttgccgtctgcattctttttttttttttatagggacgagatctcgctatgttgcccaggctggtctcgaactcctggctcaagcgatcctctcgcctcggcctcccaaggtgctgggattacaggcatgagccaccgctccgggccccgtctgtgttctaaacacttgacatgcattagctcatcttatactcgaaacaaaccccatttcgaggtgggctctattattatactcatcctacagatgaggaaactgaggcacagagatgttaagtggattgccctagctcacataactgaatacatggtggaggtggaactggtatttgaatttagggctaccaggtctgctgtgctgtattaatagcagacgctgtgaaatcaggcagcactgacggttacccacccgtgtgatcttggtagcataaacccttggtgcctcagtttctttgtctgtaagatgggaacagtaataggacaccttctaaaaaataggacacccacctgcctcatgtaattaaatga

SEQ ID NO: 178395 - DNA, 648 bp, Homo sapiens
ggtaatcatagaacattgcagaatactggggtttaaagtgttaatagtggttgtctctaggggatgggataggagactgtcatttcccatgttatgtacttctgtatttaattttagtttctacaatgagtatatattgctctattaaaacagttgtaaacacttgtttcttggctagtgacattgatgcaaaaaatattctcgttttgcaaatcaacacaaattaatactttacaatttttcaaaagtaacttagtaaattactataaacaatttaagtgtttaaaaccctctattgacagatttgtgtattcatggacgttggatatatggatttttttttgccattggaagactgatttgcttcattagcctttattcttttctgtagttgatctggctggtgacagtgaaagttagctgggctgttacagatcattctgcatgctcagatttaccttcatctccaaggtttggattatcagataactagacagtaaggccctgactgctgctgcctagtacccctgtctaaaggtttagtcctaaaaggaagtgagagtggaaaaaattgttgcattcttaggaaaatatttccttctaacccagacatcttttgtttttccccagatggttctgttatatccc

SEQ ID NO: 178396 - DNA, 333 bp, Homo sapiens
ctgcccacagcaagggaaggtgaactctgtggctcactaagcagtgatctcaaataagtccttgcctcgttttccctcattgggaaacgtggaaggtaacagaactggcacactgggttttgtcaggctcaagggagaggaagcaggtaaaattagtgcttagcatggagcctggggctgagttgatgctggggaaacagacgccgtcatcatcattacggttattactttatgaataccagcattattatttatctctgaatctcttagggctcagcacacagtcctcagcattcagcctcatttgtggagcataaaagttccatttggcaa

SEQ ID NO: 178397 - DNA, 451 bp, Homo sapiens
tgctgggattataggcgtgagccaccacgcctggcctcactggagtcttaaagggatcataaaccccatagaatgttatgtcactgatgtggtatccactgatgtatcctccaacaaattacaattgaaaaccaaaccaaaacaaaaagaagcccttcacttttaaattaaccatatttttattatcttaagtgctgttatttattaaaagtaaagaagtagaactttatgttaaaagaacattttcatatatgtaatacctaggttatgaatttttaaatgcgtatataactaagttaatattgaacctaatcttatcttttcgatgatccaaaggcagttatggttatttcagtacctgaaggtcatggtaagcattaatcatcgtgatactgtggctgtggtagaaggtttaatagcactgtaatgcaacgggatttcctgtgtccac

SEQ ID NO: 178398 - DNA, 486 bp, Homo sapiens
ctgatcacagtgaccttctaaagggtttagccgagagagtaatccctgttcatatgaagtacccccgctgcgaaagcttaacttaaaccacattccacaaatcacacacaccccccaggaaaaacctccatcataaagagatgattgcactttttgtttttcaaatagagctcaagcccctgtaaattgtatcagggattctccataggataatgagatttgggaataggattaataccagagcatgtatccccaaagtttcaaagaattattattttctaaatcctgtttttcattgtgttagaaagtgaagttaaagggacagcaaattatttgttggcttgttttttagttaaaacagtatggagcaagaatttcatctttggtcagcttattttaaaaaaggattctctacccaactaatgtactcttgaattctagaatgtgattgctatttggtctgggcaaaaaagtaaaataaaataa

SEQ ID NO: 178399 - DNA, 490 bp, Homo sapiens
tctgcccagtttttgcaggaagattgcaatttttttcccgtttttcaatgtcacctttgagtgaaggtccattttcagcttgcaactacagaagataactaatcaataaaccaagcccaagcattcctcttccttcagtggatcatacaggtcctccaacaaccacagggaggggggatgtaggtgccactgtgcagacatggcggttggagtaattgctcttgcagtttgcttatgtcctctggtctggcttggaactgctcctgtacatatcatttccatcttccaatgggctgctgccgatcctactagcttatgacttagtgcttcccacaggacctagttaagatgagcagttctggatacagcatcactgggtctcaaagttccgtgtctaccagggcccagtagcacagcagaggctgtttttcaaaaagcatatgatcctctcctgtggttagaaccaccttccttcagggccccagggacc

SEQ ID NO: 178400 - DNA, 469 bp, Homo sapiens
gaggtggtttgtgcctataattccagctactctacagctacttgggaggctgaggcaggagagtcacttgaacccgggagacggaggttgcagtgagccgagactgagccatcacactccagcctgggcaacagagcgagactctgtctccaaaaaaaaaaaaagaaaaaaaaaaagaagctccaagaatccgtcactacacctaaacaaccactgagctggtaggaattgtctaaagtaactactgtgggactctagagtctaccaaacatttacagcatccaaaagagaacggcatgattcacaataacccaaaggtgggaacaacccaagcatccatcaacagatgaattatacaaacaacggaatgttattcagccattaaaagggatgaaattcagagacatgctacaacatggatgaatcttgagataattatactaagtgaaataaaacagacactaaagga

SEQ ID NO: 178401 - DNA, 685 bp, Homo sapiens
tgaggatccccaggccttttcccctcaaagatgtaagaccacatcttacacaggtgctgaaaatgttaagtccatttaccttgggctttcatctgaagatctttattacaggtaagtgccactgaaaaccatactgaaatcacatttcctgttttgattatttatttgaggcatagccacccaattcacaattatgggagtattttgttcctcccgaaacacaattaccgttttaaataaataagttttaaataaagtggaaataacacacccaaaaggctctcataatgtattttgaatgctttatctataaaattcagcccaaagagtttaatggaaacatgcgatttttcattttatgtataacaaatatcattactgttattttggtaatgtcttcatatttgaaggaataaaaaaaggaattggctttataagtaaattatttaatctaggatagataaaagtgggatagaaagagaactaaaaaggaaacctaagagaaaacccatattgatctgtgggcactctctggggagagattcaattcgttttaatttaggataacaaatattttaagtcaaatggtcacctatcaagtgataaatatgcctaactttagtactttactaaagacactgagaataaatacatagtggcaatcattaccatttgaggggaaaag

SEQ ID NO: 178402 - DNA, 497 bp, Homo sapiens
tttaggactaagacaatctactggccagatgagatgagatgagacaaacccttccaccattttgcctttgaaaaaaattcaatgactatctcaatgttttgccattggtttaaattccagaattcttatgaaaaataaagcaagaggcttctcagaaatttctctactctgagaggtctttcttctgtgcatttcttgggttgacactgaatctgtgccagaatttcatcaccacctagcactgcaatgtactctaccttctgaagcagtttcagggtcgtgacggggtcaaaggcaatgaccccatgagtaccagactctgggagtttgactggctaaaaccagtcacagggacctgggccatcctcttactgtaggggaagcttacctaagttaagcctcagtccttgaaactgtcagacctggctctgagatagcaacatttacacaaagaaaggaaagtttgaaggctgagcatgagcactcctctcctggta

SEQ ID NO: 178403 - DNA, 487 bp, Homo sapiens
ggcttcatccacctagatttcaaagtatgttgcaaatagcctggagccccaggcagagacttgtcacagaagcagagccactgcagagagccccaactatggcaatactgcacaaaaatgtggggttggggttagtgccagagctgccacagagagtcctcactggggtaatgcctagtggagccctgggagcaggactggcactgagactccaggatcgtggagctactagcatgcaacctcagcctgggagagcagcaggcaggagactccaacctatgaagcatgggctgggtctaggaaagccataggagtggggctgccgaagacctgtgtgcccaggatgcagaaaatggagtcaaagattattctctaaattgagggcttaaagtgttttttcccattgggttttggacttaattggagtctgttactcttctctttttgcctatttttcccttttggtccaggactgtcaatcctatgc

SEQ ID NO: 178404 - DNA, 369 bp, Homo sapiens
acattaatcgctgggtgaaagactacaggatattcacatagtctcacagtatcatttcacagattacttagtaacagcaaacagaaaagatacctttacaatggagaaatctggcatatggcacttaaatcaagtgccagaactcaacactgatagtaaaggtacaaacatggatgtgatacaaaacactattattatattatagtattacaattttctataggtttgaagggttttccaaaaagttggaaggaaaagtataaatacagtattattagagattatgaaacacaaaagaaaggctaaaaggaagattattacacatcagggagggaagaattaaagtagctgtcttgggatctattcact

SEQ ID NO: 178405 - DNA, 215 bp, Homo sapiens
tcagtgagtccctcatcctccaacacaagcctgctccaccttccctcattccaccctccacaaaggcctggggcgggggaggacgtttctgtccatgaagttgggggcacccacacacacaacctcgtccgattgtgattctagccagcatttaagggtggatacaggagatcaaagtatttgaatactcgcttcactttctatttgtgtctggt

SEQ ID NO: 178406 - DNA, 402 bp, Homo sapiens
ttcaacaccccaaaccattttttctgttttcatttctttagtccaacttctgttttcaaagcgtaggctttagctatgtttgaaaagggttaatattagccttgcctatctcacaaggcctctgaaaagatcaaattatatttgaggcatgctttagaagtgttttttcaaactctggattctaactcattagtgggtcataaaaacaatttaataggttatgatcagtactttaaacacggaacaaatcgggatacaaaaaaaaatggagtgcacactgcaataggaattgctatggttaactcctttttcagtttcatatatgcctgtgtgtccatgcaaagatatgtgtatagtcagtcacaatataaaatgtaattttctgtgattaaaaaatacagc

SEQ ID NO: 178407 - DNA, 258 bp, Homo sapiens
ccacagtggggaggttctgcctctatgctcagtctactaattcaaatgctaatttctctcagaaaaatcctcacaaacatacccagaaataatgtttaatcagatatctgggcatcccctggctcagtcaagttgacccaaaattagctgtcacacacaataagaacctataccaatagccagactatgttgagtccctgccattcacctagcaacatgcaaagtgctttaaggcagtgcttctcacactttaatttg

SEQ ID NO: 178408 - DNA, 334 bp, Homo sapiens
agggggggtggaggggcggggctggggggcaaggggagagaagagtcccggaggaagagggcgaaggaagagagcgacgctccctaaactgacccctctccagggcggacttggaagggatgttgctataatggggagcggataggcaggaagtcttgagggtatctgtgggtgtcctccttgctccaaattttccagccatgcctttcacatcagaaggaacaaacgcgggagggggattctctagtggtcataaaaaggaatgccacgccactccgatgtcaaagggcaggggttcaggaaatgcgggggatgtgggcaccacggggttaat

SEQ ID NO: 178409 - DNA, 653 bp, Homo sapiens
gaggagttctaatgaacataacaggcatgatttgggcatgcttaagactgtagaaaggcagccagaagaatggagagatgaccaagcagctagttagtagagggagcaccatcccctggaagagaggttggctgtgtccagaagaggggctcctccttgcgatggggtgtcttttagtcacctgaaaccccaagtctgcttttcctccagtctccttactccagcaagtggcactaccattccccctattcctttatccaggcagtcatcctgctgattctgtctcattaatggtcctcaaatcaattcattgctttccaccctcaatgccatgatccacagtcgtttttcccatggtcttcagcagcagctctaactgtcctctttgcatcttctcttgttgcccatcaatcttccagagagctgtttccaatatgcaaatcgaatcatgtcactccttgttttgaaaaccattcaacacttccaactgtgtcgacatggctaactaggccttcaggatctatgtcacacaccgtcttcctgccccttcttctccagccttgcctctcaccattccccagtgcccttcaccatttcccagtgcctctcaccattccccagtgcccttcaccattccccagtgcccctcacca

SEQ ID NO: 178410 - DNA, 319 bp, Homo sapiens
cattaagaagcccagtcaatgaaaatgttccattcttggtcctgtcctgggctaggccctcagattggccggctccactcaaccacctctacagtgccagttcagactagttgtacaaaggaagcttcccacaagtttggtttgtagcggatccctcagcttggttactgttataaagatggcatgtctgggaccaacctgtgaaggtttcaattaacaactcgagatatgacttctttggatgacgttgttcttaatttacccattcatctaaccaaagccctgctatgccctccactttcatggtgcaagccgtctg

SEQ ID NO: 178411 - DNA, 535 bp, Homo sapiens
tcagctcggtacctgcttattacccagtgtgggtaagttggcctgagcaccgagggggataacaaggacattcaatgaggtaaggaacatacacagatgaacagatttacaggggaaaaggctacattcagttttggacacgttgagttggatgtacttgtgacacacgcatagttgagtatgtggtatctggagctaaagcgaggggtctcaactggagatatacactgtgcagtcataagatggttgaagtcagatgtagatgagatcgccaggggagcaagtaaaatgggaagaagactatgatatagatctggggtttgatctattaacagccaacattaaggggctgctagaggagaaggagctgatgaaggagtctgagaaggaaaacccacaggagtagaaaaaaaaaggaaccagtggtggcaaagtcaggaagaaagggaaaaaattcatttttgaggagaaggaagtgataaaaactatcaaatgctatagtaaagtcgagtaaggcaggcattagaagtatcca

SEQ ID NO: 178412 - DNA, 330 bp, Homo sapiens
tcaagcgattctcctgcctcagccttgagaggagctgggattacaggcatgcaccaccacacctggctaatttttgtgtttttagtagagatggggtttcaccatgttggccaagccagtcacaaactcctgacgtcatgatccgctcgccttggcctcccaaagtgttgggatgacaggtgtgagccactggcctggcccttaaaatgctaccttttactatcaaagttttagtcctgttatgtcacgcttgctcagatttttctgttggttttctacctcgcttagagctttagcttttacagtggctttataaggtttttcttcatg

SEQ ID NO: 178413 - DNA, 322 bp, Homo sapiens
gttctgacttctgccacaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccagga

SEQ ID NO: 178414 - DNA, 533 bp, Homo sapiens
tgtgctgtcacagccagcattgctggatgctctgaagttcaccagggaactttccaccactctgcactgcattcatgcacctgctggtggcaggaaaaataacctccagtatgctactggcctcactttaatttcatagtatcaaatgggtcctcgctgtttcctgccatcacttcacgtttcctggccaaattaatctcatgtcccacatgatcatttcatgactcctgtctttacacctccaaaacttcctctctgtcttctctctcagccaatcaccttgcttcctatttcactgggggaaagaaatgaaaggagtaatcacagcaaacttccaccacagaaatcaacatgctccctgtccattcttatctagaaaaacctttcctcttgtttgctagatcctatgctttctagcattttgctctagaaaattttcccttctcctgcataataaaaatttcccacaacagtgagacattaacatcagcataacagtgcactttaatgtttatcatttaaaataaaaacaa

SEQ ID NO: 178415 - DNA, 326 bp, Homo sapiens
agcaggaacatggagagggccagctttgactgtggccagagccatgcttgagctcttcttttggagggatgggcttgggttgcagagggtcttacagggagagtgtgcttatcacactgctcctggatggactgatgaattgaacacttcctgagcacctgttttgtggctagccctctgctgagggtgcacacattccctcagccacaaagccagtatttagtgagcacctactgcatgccatgtggtccaccaggccttgggtagatggtggtgtaccagaggcaggggtcttcaccctgggggagctcccaggctggcaggga

SEQ ID NO: 178416 - DNA, 201 bp, Homo sapiens
gtggtagtatggctgccctttcacccaaaatacgaacagattttatctctagcatgtcctcatgtacctcttctggccatgggcagtatgtgtgggcttaagaaatgaggtctggagtcacatggacctgggtccaaattcctgtaccaacacttgttagccttgtgacgttgggtaagtcacgtatcctctctcagtttc

SEQ ID NO: 178417 - DNA, 424 bp, Homo sapiens
taattgggttatttaactttgcttcttgttgagttgtaggagtcttcatacattctgaatgttaactcttttcacatatatgatttgcaaatatttttcccgttttataggctgccttctcactctgttgattgtgtccctgtacccacaaaaatgtttacatttgatgtgctcccattggtctatgttttcttttgttgcctaggcttttggtatcatacccaagaaatcactgctaaatccagtatcttgaagctttccctctatgttttcttctaggagttttagttttcgtgattatgtttaagtctttaagccattttgagttattttttgtatacagtataagagttgtggtacttaaaaaaaaatagctatgctgcattccactgaataaatgtacaatcacttatgtgaccctttc

SEQ ID NO: 178418 - DNA, 456 bp, Homo sapiens
taattgggttatttaactttgcttcttgttgagttgtaggagtcttcatacattctgaatgttaactcttttcacatatatgatttgcaaatatttttcccgttttataggctgccttctcactctgttgattgtgtccctgtacccacaaaaatgtttacatttgatgtgctcccattggtctatgttttcttttgttgcctaggcttttggtatcatacccaagaaatcactgctaaatagagaagtaaattctgttacttgtgacaatatggatgaatttggggggcattatggtaagtgaaataagccaagcacagaaagacaaatactgcaagatctcatttaaatgtggaatctaaaaaagtcaaacttctagaagtagttgttactagagactgggggaaagagaatggggagatgatggtcatatggtacaaattccagttagcatga

SEQ ID NO: 178419 - DNA, 148 bp, Homo sapiens
ctgtgatggggaaacacaatcgccgagtgagcgggacagaccatcagaattctgcacttgcttccgtcccatcctttaaaatagcctttcagtacccttggttaatagtgtttttttgagacaggatctcacttcgttgcccaggctg

SEQ ID NO: 178420 - DNA, 342 bp, Homo sapiens
acctctggagtgggtggggggcggggcagccccactcaaaccaggagactgacttgaggaggtggcttcctagggaagaatggcatgccactttcacaaaagtgtccatttgccccttaacatctctgctttcctcttcatagcaacagtctatttgcccttaatcttccttgtctggtatccactctgtcctcccttgctggggtaattctttctacagtacatttctaatcaagtcactcctctgctcattaaccttctatggctcccttctgccccattggattacactcatgctgtctgcttggctttctagtcggtttgtccccacccatatctcct

SEQ ID NO: 178421 - DNA, 413 bp, Homo sapiens
ccatctcccagcaggccattcacctttagtcaaagctctccactaataattgtctcatgcagcgttcacacgccattgcctcatctcttaaccccagtttcttctagataagaaataattcctcctgcccatctccccagtcatccatcttcagtggggctcataaaacaaagccgttcccattttccattaacctctatgtcctgaaacttagagcccaatatactttctcttattcctcagaaaggggcatctatttgccatcattttcaggaggtcttacattattcagaaaggcaggcatcacccctggtgacctagccacctactttaccttttatttctctcctatttaccattgcagttgataatttgtagaactcagtaattcacaactgtcagcatctttatta

SEQ ID NO: 178422 - DNA, 331 bp, Homo sapiens
attacaggcatgagccactgtgcccggcctaaaaaaatattttaaatgagaaataacacaagtaatagtcattctttgttaggcagaagcatatgctgttatgctggccattttcattcacacttgccaggaaacactcacattttgtttctgtatatggaggcagccaagagtattatgttaatgtttaggaagagaatttcctcgtgattttattgctgatttctgaaataattcagtgtaactaattttgactgtatttgcacatctctccaattccaaaagctggcataattttctgtttggttaggaagtaggaattttatgagga

SEQ ID NO: 178423 - DNA, 534 bp, Homo sapiens
ttaattgattattcatactttctcagtttgcttcaaactgctgaatatttaattaaagagaaactttcttgggcacacaattgaatcactgaaaacacagtgctgcagtgttttgctgttttactagttataaaattggccacagaccttgaaactaaatatcaaacattcctgtactgaaccaactgccgttagtaagctgttcttatattgaacctttgttcctggaaatttttgcattagaaatccttcctggccggccgcggtggctcatgtctgtaatcccagcactttgggaggctgaagctggcggatcatgaggtaaggagattgagaccatcctggctaacatggtgaaaccccttctctactaaaaatacaaaaaattagctgggtgtggtggcacacaactgtagtcccagctactcaggaggctgaggcaggagaatcacttgaacttaggaggtggaggttgcagtgagctgagatagcaccactgcactccagcctgggtgacagagggagactacttct

SEQ ID NO: 178424 - DNA, 527 bp, Homo sapiens
acaagagccagatcacacccaaactactcagggggcagctatgctggcccgaggagctaggctcagaatctcacttctccccgcagttttttgctcctgtccagtttataggtaaggcatctgtgccacattctttaaaatccacttttctgtgaaggttttggagcccctagagatttttccacaggggaatgacgactgctgttgtgacttagaaggcgaagcagattatattttccaaaaatgaccataacaagcagtcccatcccacatgctcctcttgcagcgtgactgtgacactcctcccacttgtggtggggcgggggggggctgtgtcccctccgccttggaaccggaggagcttttgtaactttttatcatcagagcccagcacaaatgatgccctatgacttgtgagcccacaagagacaacgcggcttctccctgcctgctaaacacacaggcctggagcccactcaactgccccgaggccaccctgtgcagaagacttcctgagactccatgga

SEQ ID NO: 178425 - DNA, 349 bp, Homo sapiens
cagaggacccgaaaactgaatagaggcaggatcagtggaggacatcatagaggctgtggagtctgaaataatcaaatcttctaaatagcaaagccagtaacaaattaacatagtaccataggcagggttatttttgtacagctgcaaaaacttattcaaatcattcatattatgttgcaaagattaaaagggaaatagctatttaaaaaaaaaaaaaaacagtaaatatccagtgagaaatgtcaactgggattttcttcctaacccaaaaatgatggaaatgttcttccggcctcatagtgtcagtttccgggatacggagcctcgaatttcgtaactcagtggccaa

SEQ ID NO: 178426 - DNA, 429 bp, Homo sapiens
  misc_feature (367)..(367): n is a, c, g, or t
  misc_feature (395)..(395): n is a, c, g, or t
ctggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttgggatgaaatggtcctcattggcaaatggttttcattntgctttgttcagatttattcctttggtntcacatatataatgtggtggagtacagaatttct

SEQ ID NO: 178427 - DNA, 244 bp, Homo sapiens
tatatggtgcaaatatgttttggctttagtagatctatctaaatagtctgtctaagtggttgaactagttaaccttctcaccaacaatttatagtagtatagttattctacagaatcctccccatttgatgtgttctcaagaccactcccaggtttagtgattttctaggaagactcataagacttagcccataatcatgctcgtggctataatttattacaagaagatcagcaaagagaaaag

SEQ ID NO: 178428 - DNA, 281 bp, Homo sapiens
caaaaacttcactctagctaagctatcttgttgcctactccttgtctgtaactgagccatggcatggggctgcaaaaaaaacgcacaaccacgctgttggtctcaccttatatttatggccacaaacctaaagtgggtttcacattgtccaacaatctttctctaagcccctagttatgtcctccttcttcttttccaaaatgactattttatatttcttcattttagccccatatgcactcccgtcccttcaccatcatcattctcagtggttgactttg

SEQ ID NO: 178429 - DNA, 137 bp, Homo sapiens
gaatcagtttagtggtgccactgggtttaagatgagtgagcagagaacaataagctgactgggaaatcgatgctgggtggtcagctagacccgctcacccactgagtagcacttccacaaagcaggctgtgactgtg

SEQ ID NO: 178430 - DNA, 187 bp, Homo sapiens
aaaaacaaataaagctcttttgcttctttgagccttagttttatcatctgagaaatggagatagtctctgtgttggcaacttcactggatattgtgaggatcaaattaaatcacgtgtatggtggcagtttgtaaatatcaagtgtcctgaatcacagagtattattttcttaaattgactaactag

SEQ ID NO: 178431 - DNA, 811 bp, Homo sapiens
tcaggagggtctctcggcagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactgcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcag

SEQ ID NO: 178432 - DNA, 672 bp, Homo sapiens
agcggggacgcgggtggccaaggcccgtttcctggcggcgatcgcgcgtttgcgagcctcgtggtggtcctcagggagggcaggattcctggttttcaagcctgagctgatctctcggctggagcagggagaagagccatgggtcctcgacctgcagggagcagaggggacagaggcaccaaggacctccaagacagtgctgctgggttagggtctccctgactgaactggtctcggcaagtgacgtccattgtgggggctcgaatccaggttgaagggtcactggagcaacggagaatgtggaactaagctggaggacacccaagtactcttaaagccatccctgtggcgcggtggctcatgcctgtaatcccagcactttgggaggccgagacggacggatcacgaggtcaggagatcgagaccatcctggctaacacggtgaaatctcatctctactaaaaatacaaaaaattagctgggcatggtggcgggcacctgtagtcccagctactcaggaggctgaggcaggagaaaggcatcaacccgggaggcggagcttgcagtgatctgagattgcgccactgcactccagcctgggcaactgagcgtgactatgtctcgggaaaaaaaaaaaagtttgtgcatgtaaacacttgtactaagaatatc

SEQ ID NO: 178433 - DNA, 477 bp, Homo sapiens
aagccaaaccctaaagcgactcacatacacacacacactcacacacacacatacacgcctgctcacacacatatatgcacacatgtcaggcttttgttgtgttaaaaccaacataattactatcctttgtaaaagatttaaaaatggagaacaaaggaagtctaccctcagaagagaggaaaggtaaaaacaatggtgagggaaaagtggctatatcagaggctctaagaactctgctgtggacggcggtgagcccctctgtctttcaaattaggtcccagaagccatgccaggcattcagccgctcctaagtaggtggccagattgtcaacttctctggtagaattatggttcccgcgtattcaccacctccttccctataaggaattgtccaaccccccgtcccaatcctcatgattcacagtgctttcctgaaggagaaatggactcgcctacagccctggtttcaggctcggc

SEQ ID NO: 178434 - DNA, 461 bp, Homo sapiens
gaagagatgtgagcaggacttccaggtgagacagggagtgaaactcctcaggaatgaagaggagggcaaggattgggaaatatagagatggtttggggttgttgtatagaagatgaatgatcagtgtagcagggagtgagatgaatgagagaatcagaaatataagatgagaggagtggggactaataaggacagagaggatctcaagaaaaggctcaaaggtgaatttgagaaaagggaacttggtagcagggctctgacccatggctggccagcttgcttcctttcttccatcagttctcctacttgccaaacaaaaagtactgcagacctactatgtgcattattatggcattctttcttccttttcactccttattatcttgcccacattgctgcaggatgagatggcaaatagtgggaattaaaaaacaacgtatggcaagaatgcgtgaggtgga

SEQ ID NO: 178435 - DNA, 201 bp, Homo sapiens
ggtggggctggagacctagcatcctggcttcagagggaacagtgcagtgaggccctgttaataagtaacagtctgtctgtaaattcgggataagagtagtcagtgtcatcatggggataaaatgagctaggctagtccagagctgcacgtacaacaataggcgtttaataaatacaagctgtcaatgctcagcctctgttg

SEQ ID NO: 178436 - DNA, 139 bp, Homo sapiens
aattgggtgcaaggagttcagtcatatgtttgggatttttcggatgataggtgttgagcttgaacgctttcttaattggtggctgcttttaggcctactatgggtattaaattttttactctctttacaaggttttttc

SEQ ID NO: 178437 - DNA, 309 bp, Homo sapiens
ggcattctttagggtctataaagtgcttaaaggaatttaaggagaggatcatgaatttttttttacaactatgaatagtgtaggatggcttgggagtgactatattgaatagaactatttaaaagaactattcaagtaaatagatgtgtagaaattgaactcccttgttcactgtttaagacaagtgaattctatagtggttgccataaaaggaagttctaggtatttatagtagatgcctcttgtaattatggctttcttaaaactataatcctagcagaggacatcagatattgtgtagaaattgaa

SEQ ID NO: 178438 - DNA, 105 bp, Homo sapiens
caaagaaaacaaaaggcacagagaccccatagaaacagataactcaggttattctagacaaggctgagatttccattaaagacactcagtggtaatttcgttggt

SEQ ID NO: 178439 - DNA, 255 bp, Homo sapiens
ctacatatagaactcgagctggtaccctcgataagggcaactctcatggaacctttgctcactctcaggtgaagggatcttgcttggaggcccagacgttctggattttctctttagaaactgtggcttgaagcatcctcttcaggaaacaatatttactccttttgtatctccaaaacccctcctcaccccttttgcaacccaaacccaagtgtcttctgtgtcctatttttcttcttttgaggcagagtcttg

SEQ ID NO: 178440 - DNA, 233 bp, Homo sapiens
cccacttcggcctcccaaagtgctgggattacaggcatgagccaccatgctgggccgaaaaggatagtctttttaacaaacagttgagatagtcacctgttgcattcgtttcctagggctgcatagcaaaataccacaaactggttggcttacaacatcatttagtttcctacagttctggagactggaagtctaggcagcagggccttctgacctctctcattggtttatag

SEQ ID NO: 178441 - DNA, 206 bp, Homo sapiens
ctagaggttcccaaacgcagagaggagagcttaactccatttacatgcagttattaattatatgtgagccttttttctgtcatattaacggttttctggttgctttatatattctttgttcctttctcttattgtttgttatagtggtttgctgtctttttatggtagtaccatttgagtcctttctcttccttatttgtgtgttg

SEQ ID NO: 178442 - DNA, 389 bp, Homo sapiens
ctgctaaatcaactcactttaccatcatataacgtaggcaccagccccacaggattagtgggtttttctccctgtgtgcagagataagagattgtagggccgggcgtggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcaacagagcgagactccgtctcaaaaaaaaaaa

SEQ ID NO: 178443 - DNA, 287 bp, Homo sapiens
atagagggagacagggccattagggaagggcgatgcggtcgagaagaaggtaaagggcagacccctgaacgtaccagagggaggggtgggaaggaagacacagaacagttcagaggtactgaaaaactgagagaaaggagtgcatggaaagaggggagaaaataaactataaaaggaagtggtccaggcttgaggtttccactcctgcacatgaggaggttgaaagtcaccactccatcctaacaagcaggaagctgaacaagctgaaaatcaagcccgcttagatt

SEQ ID NO: 178444 - DNA, 149 bp, Homo sapiens
tgccatgtttaatattgttactttctaagaacaaatataatttttgtgagaacattatattactctgaaacagagaacagtactctctgtccttttagtccctcaatttttgataaggtaaaataagattatcttatatgactagtgta

SEQ ID NO: 178445 - DNA, 226 bp, Homo sapiens
tctactttggatatctgtgacattcattgacagtatttttagttgctagcgtctacttctggctcttcagtttatggctccagtcctcaaacattaggctataaatgaaaagcaataatcattgcaaaagtttttgcaaccctttgggagaagggactttatattaaaggctatgctgttcttgaggtttattaaatggatactttaattccctgccgaacccact

SEQ ID NO: 178446 - DNA, 494 bp, Homo sapiens
ccataatacagttgtttttctaagaatgaggtaataactgtccctttagttgatacacacttgattcagaaaattgtaaaattaaaaaacacatataattgcatttaactgtggttatgtgctaacttgcttcccatgcccaaatggctgtgctgccaattcatggcatagcaaagaagtctagtgcctgttgctgcattagagagtctagtgaaggtgacttctgccattcccatgtgaagtagagtaaaaagtcacccaaaaatctgggctagaatcagcctccagggtatgaagaggctagttgcagtagcaataacctgctttattgaacgacctgatagtgtgctaaatgccatctacgcattaagtgctttagtcatccccaaatgctatgaagcaggtattattattaatgcagtttttcatatgattaattggaagcatgaagtggaaatgaacttgcctaaagttacaaggccaagaagtggaga

SEQ ID NO: 178447 - DNA, 471 bp, Homo sapiens
ttcttactattgacgtccctcattcctataattatcacagaaaatagaaggcaaactattctgtttttataatgaagaagaaagtgaaattccatttattagattgaaagccaatactcaaacataaaggagagaacctggttctgacggtaaagttggacaaaaacaaaaggcaacattgtctggagtagaactaaccacttgaacatgtgttacatactggaagtcttaaagaaaaaacaaacttcactcataatcctagagggaagcagtgtgggtaaagaaaaggatgtgaatttaaaaaaaaaaatctctgtaattattagattctacggattggtttttcaaatacttatcaagtaattcagttaagcaaacatgtattgatgacatcattaagaagtattagagtcagatacaataggaatataaacataccccttgacttcataaagcttacactaaaaaaca

SEQ ID NO: 178448 - DNA, 491 bp, Homo sapiens
gacagtgcacattcttaagatagacatcattttcttcccaaactgaacattttcctttcttgctaaatatgtgtgtgtgggggggatataggcactatatatttccaactgaaattgtaatctcagcttctgagtttgccatcagtttttattatctccttattttagtttagaactccacatatacaaatgggtatttatcctttttcctcctgtattcttcttcttggaaaatgacatgatggctccaacaagtcatccaagccctaattctagtaggtggtcatctctgtctcttctctttcatgttccttataactagtctgttactaagtcctgccaattctacctcagaatactccctttcagtccccctactgctgctctgttgagcattgaggctctgcacttacatcaggccccatctgcatctctatgtccagtgttactcccctccagatcatctgccaggttgccactaaaatgactta

SEQ ID NO: 178449 - DNA, 132 bp, Homo sapiens
ccttcaaaaaacagaaaagaatggaacacttcctaacgttctatgaggccaacatcaccctgacaccaaagccagaaaaagatacgataaaattcaggctgggcatggtggctcacacctgtaatcctagca

SEQ ID NO: 178450 - DNA, 500 bp, Homo sapiens
ccaacgtccacatgctcccactatcccatctcccctagtctgctctccctcctcctaccagggaggagccatggatgccaactctccacatgggcacccacccacttcctgctgccttcccaagaatgtggctccagcaagggtcacctcttctgattcatcatgtcattcatcctctggagaattacttcaccaacactgcaaaaatggtgtggtttctcccacctcaacacctcaggatcccaaatatcccttcatcactgtggcaaatcccatgacggagctctacttgcctttctcttctctcaatccttgtgaatgctcccttccaggcttttcctgcaccaccatgtgggaacagctctcaagatcgtcgatgaattccacgctgccagagccatgagacgagtcttggtccttatctcaggtgacctcacggcagcagcactggcagaggtccccgctccatcctccgtgacaacactttcctaaggcctcaa

SEQ ID NO: 178451 - DNA, 591 bp, Homo sapiens
cttaccggcatgtgctgtaggccagcggcggtgttactttccagcctggggatgactttatggcgtgatgtctaatctccagtgggcaagtggtgaaggtactctagcatccatccagtggccagtcggccgagggcctgtctgctcatggggaagtgtcctctgatggcagcccagtgtcttgctaaccagcagaccactgcagaaggcaacgctggcctcctagaggtgtggcttgtttgcatctctatgtttgtgaccaagtcgtttccttccttggtctcagaatctgcttggcacttactaatagcatttgttcaacatgcatgatcccggtatgtgaagtacagatatgacatttataagccagacactgcgtttgactaatgttggcaaagtcacactaagagcctcccagtgttcagatggcggaagggaaggcagataggagtccagtccccaggactctgaggccccaccttgtgccttggtagaagtgaagacagatcgtctggggaagttggaagaagtagccgagacatttctcctggctcagagcagagggggatttacgctggcctacagcacatg

SEQ ID NO: 178452 - DNA, 1131 bp, Homo sapiens
tctgcagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactcatttttattttttaaaaaatcattccattaaacatatttctaaataatagtaagtggtactaacaaaataaataataat

SEQ ID NO: 178453 - DNA, 566 bp, Homo sapiens
ttcaaggaagggctgccttttcccgtttcacacagatgtgccttatgggctagcacaggccctgataaagccagactggggggacagatgatgaaatattagagcagaaatccaaaggggatgatggaacttatcttgtccccaaataggcatcctttgacccctaattaaaatgcctgtgccaagcatggggaaataagaacaagacatgtcacagccccagaaagcttacacagggcagggggagagaggcatgtgactggagacaaagcacaatagtaccattgctttaagcatggcaaccatatttatttgagtgtcaaatcaggacatagtgtacattgtatgagcacacatacagggctcacaaaaaggggtttttgactttaggagttttctggtcaacctgagcatgagtctggaggagttatagcagagttttgtacagagcatggatgcatcgaggggaaattttgctgggagagtcaggaaaagttctcagaggagatattgaatggtggatgccagtttgccgagtgatgatagcgaagggtgtctaggcagcg

SEQ ID NO: 178454 - DNA, 745 bp, Homo sapiens
gctgctggcctgttactgcagatgtcgtgtggaatacagtcagcatctactggttatgcatcttccacattcatcgcattggaaaccaggttatcacaaaaggaaagatgggtgtgcttccaagcaccgtgttacttatgttttcctctaaattcaggattaggcaaaatgttgggagaaaaaaagtctgaagacattaagtggcttataggataaatcacatagatttaaaaggagtggtttccctagaagacataagttttcttaccctgaaggaatctgtaaatatgagatatggtgcacataccagcaccatttaggatatccagtaagtgttaaaggcgaaattccacagagaaaaaataacaacaaaaagcatatccatttgttcatcaaacatctgtttacctgctaggggtcaacattgttctagacaccatgaatacaacagtataacaagagtggcaaaccccatgcctttgtagagctcataatctagtacagaatactgatataaattatagattgagtatccctaaaccaggaatctgaatctgaatctgaaatgctccaaagtccaaaactctttgagcacctacacgacaccaaaggaaagacccaccggagcacttcaaatttttggatcaggaatgttcaaccatgtaatacaaatactccaaaaattttaaaaatatccaaaatctgaaacacttctggtcccaagcattctggaataaagaatact

SEQ ID NO: 178455 - DNA, 242 bp, Homo sapiens
tcattttaatagctgctaacttatagggtatcgatccgattacgtgctcattgtcattgctgtcccctctgtcctaccgtgatccgtaaattctgtcgctagttgaagtgctacaatatgggtatttcctcaacttagacttgtacagataggtcatagtaagacgcatactggcttctctccatatctacccaaaaggttgttttagtgtgttctttcattgtattcctgcgaacctatcc

SEQ ID NO: 178456 - DNA, 427 bp, Homo sapiens
gggaaattccctggccactggggtaatgtttcagagaggaatggaaccactttcgctgcatcccatgcctttgacaaggcagatctcacacccacagacttctgctggcagaaagctgcaagggccggctgggtcccacagtgcaagactgccacacactgcaagacttcccccgcaagacagaaaccgcagctcttaggccacaccccttctagtttggcccacgaagcaggggcacctggctcctgtgtccatgccagaagcatgctttatgcttaagattaggttgcaaatctcgcttgggagcttctttcagcctgtggccatctcctgagttagctagcagattttcacgtgggcgtctgtgagttggattaggagtgtcttccttctgcccctcctggcgcctgggcgggcatgcaaagca

SEQ ID NO: 178457 - DNA, 592 bp, Homo sapiens
ggaaatgccttcagccacaatttcacagttgtttagcaacagagagtccacactggggaaaggccttatgggtgtagagaatatggggaattctttagacaggcctccactctcaatatgcatcgagttcacactaaagaaaagtctgtgcagcaaattaaaccctttcaacagcaagtgagatttactcagcatcagcaaatccacattggagaaaggccttatgagtgcatctcctaagagatgtgagttggagaccctgcctttccatctggagcagtggttaaatttgacagctactactctgatctctttcaacaccaaagagttcacaccagagaaaaaccttatgagtacagcaaatgtgagaaattatccaaagccccagcctcagtaaacatcagagagttcactctgatgaaagttttcatgagtgtagtgactatggaaaaaggtcagggctgggcatgatggctcacacctgtaatcccagcagttagggtggccaaggcagtaggatcgcttgaggttggaagtttgagaccagcctggacaacacaatgagatcctcaatctcttcaaaaaatgaaaa

SEQ ID NO: 178458 - DNA, 224 bp, Homo sapiens
tgctgacaaacagagccatgtatctaattgttaacttcccacagcaacctgtacagccctccagaatgaagaagtttagttagcttgttataaggttaaaaaaaaatccaagttctcatatcaggtttcattaggatgaccaatcatacattcttaagactaaagacacttggacctggtcctcttcctggtagaccaactttgagctgtttaaaaaaaaaaaa

SEQ ID NO: 178459 - DNA, 185 bp, Homo sapiens
actatgttttcattgcaccatcttgtcacatgccttgtctttatgtaaagacatagatatgtaaatgtagtatccccaaattgtagttaagggagcaggctcagcactggtaagtagcttgctcatcatctcatggtgaagaagtagctgggctgaaacttgaacccaagtggttagactcctgg

SEQ ID NO: 178460 - DNA, 971 bp, Homo sapiens
cgtggcttagggcaagttattctctgtggttgagcctctctccattgtccctttcagttccaaaatggatgattccacttaaaaaaacaaaatgtaaactcactttttttttttttttttttgagatggagtttcactcttgtcacccaggctggagtgcaatgcgtgatctcagctcactgcatcctccacctcctgggttcaagcgattctcctgcctcatcctcccaagtaactaggattacaggtgtgtgccaccacgcctggctagttttttgtatttttagtagaaatggggtttcaccatgttagcctgggcaacatagtgagatcccagtctcaaaaaaaaatttttttctacctaatttccctaaagaaaacagcctggacagctgtccagaaggccaggaaacagtggatactacctttttgttctgtttttttttttttttacaggtctttgcaaacttgctgttgtgtatgtaaccttttctcagcattcctctggttcaaagctgtgaattaccattttggcactgggaggcggtgttgtgtagaaggagcctggtctttcctgcaggttctcctccattcctgcctagctatgggactttgcctgagatgcttcattttctacttgttccagaagagtattgtgagccaccgcgcccggcctcttgtagatttaattggaggaactgtctaataggcccctcaaactcaacatgtccaagattgaattccaagtctcccctcatccctctaccacctcaagcctgctcctctgagtcctcagcctctcaggagtgctcaggccagaacccttggcaccctgcttgcctcctgcttgcctcctgtctttcatagccgacatccagtcagccaattctatgagctccaccttcagatacagtcagaatctgactacttctcactaaccctaccactacacctctgatacaaagccacca

SEQ ID NO: 178461 - DNA, 590 bp, Homo sapiens
tcccgagtgcgcgacggaatgagactgttgcaaaacagataaaaaaagataatttacggccaggcagtggttcatgcctgtaatctcagcactttgggaggccaaggtgggcagatcacgatgtcaggagttcgagaccattctggccaacatggtgaaaccctgtctctactaaagatacaaaaattagccaggggtagcggtgtgtgcctgtcatcccagctacttgggatgctgcagcaggagaatcacttgaaccagggagttggaggttgtgagccaccgcgcccggcctcttgtagatttaattggaggaactgtctaataggcccctcaaactcaacatgtccaagattgaattccaagtctcccctcatccctctaccacctcaagcctgctcctctgagtcctcagcctctcaggagtgctcaggccagaacccttggcaccctgcttgcctcctgcttgcctcctgtctttcatagccgacatccagtcagccaattctatgagctccaccttcagatacagtcagaatctgactacttctcactaaccctaccactacacctctgatacaaagccacca

SEQ ID NO: 178462 - DNA, 447 bp, Homo sapiens
atctctaggggaggtcccatcagcagctcccatgatcacatttgtaaaatgccaagatgccattcaaagtcccaggaagcaactaggcagccagccattctcttcccatctcagctctgttggaagttgctgacctacagctcaccagtaaatgtgtaccaagcagaaatcaattaaaatcagccacacttgctgctgcagtctcctctgtccccatcccatggcagggctgagggctaaggaggcagacagaggagctgttgcaaggacagtgggaggggggccactggcacagtacctcttgctgctccatggcaacggtagctgctagacagcagagcagcaacaacacactgcagcaagagaggaaagtctgactcctctcgccaggcaaagcaccaggccattcacaaggccagaagacaggaagaccccggccctaaacag

SEQ ID NO: 178463 - DNA, 369 bp, Homo sapiens
atgtggggtctcaagactggacagattcttaattagctgacttgagactcccaatgtaggagttttgggagactcctttggaacccaaattcctttcccccaataatgctattaatacagaaatctggctttggagtgacattgcttcctggggaaggatcgagattaattgcacttttcatgccctgtactttctgcattacctgtaataataatgtacatagattaggtagggaggatattaaacagaaggatttatgaacatttgaatattaagttggttatctgtggctaccttaaatgcaaggttgtcaaaaataattacagtatactagcaaatactggctaccagagacaatataaataccc

SEQ ID NO: 178464 - DNA, 436 bp, Homo sapiens
tctgtcatattatgtacattttaatttttatgtccatcatctgctgttgcattttaaatgacaaagaccttaaatctggcaaccccacatcaaatgtcccttctgtccctgtctcagggagagaaggtgcttcttggatgcactttactcctgtaatcaggagggccatggccagcagctctctggcctgccctggtgtgataatgctatcagctggttgtgggagtggctgccccagcaaggcctgctccttctccttttcgaagagtgctggggcagagaggggaggagaggagaggttatggttagctgtgtcgggtgtttggaagcattggcatgctgggtagacttgaattggagcttggtataatctaggtcctgtgtgattggaaagatgtgtttactgcatcagtatttattgaacaaatctaatgtg

SEQ ID NO: 178465 - DNA, 385 bp, Homo sapiens
tacttgatcttccactgctttatatacaccctaccctacacacagtctaactgtattattcattgttcccaaatagagcctgtccttctctgcctctatgcatgttgatcactacacttggaagaaaatccccaatcccttagtatgtattttgacatattttataaatcccactcatccttcatgcccttaaaaaaaaatcttttactgattttcataattttcactactaatctgctgtgtcatttctttcctattttaattaaaactttttaagcgtgaaagaatatatacacagatcttaaatacacatactccaatgtgatgaagttattgatagtttgtcttctccctattttccaaattttctacaacccctgtatta

SEQ ID NO: 178466 - DNA, 503 bp, Homo sapiens
ctatggcaattaagttggatgctgttgctacaaatgaatgagtcaattaacagggctattaatttgggatggtaaaggcaatgggatgaagggttggaggggagagtccaacaaatctataatgatgctatacttagactgcttgataaattcagattctgctgaaagtctgaaaatggaagacagtgcatttcaggtgtggctatttgggaacagtgatttagaagtccaattagcagacccaggtgcaaagaaaggcctttggtctcgcgtcacaaaatgggagaataaatagatatttacattagttaatgtaaaatgtataagccacggatacatctttctttgtttcaattccgtgctttaactagcttttacaataggaaatggctactcttgtaattctgtcttagtccatttaggcccctataatagaatacccagactggctggctcatgaacaaacatttatttgccaagttctggaagcttgaaagtccaag

SEQ ID NO: 178467 - DNA, 452 bp, Homo sapiens
gtatcaggagagaaaatgtgtttgagattagcacgttatcagaaaaatgtttgcacttatcttattctttgaataagttgcaagctatttctcttctttcacaaaggcaaaatagtaagccaaacctgtaatcagaaaaatattgatatgttagatagagaaagttatttttgtgtgtttgtttcagttgttgaatcaactggtatgtatcgagtacctactgcatgtagggggattgtagagaactttcagtgtcaagttagagattttaaactttatcctagaagtagaacgagaaattaaggcactgagttagaaaggagctagaccatgatttctcccatatctcttgtgcaaatggcactagccaagccagaagcccctatgctgttcctccatgtgcccctgcccagccattcagcagccttggtgctgagtctgcctgggatatc

SEQ ID NO: 178468 - DNA, 404 bp, Homo sapiens
agacgaccaatagacatccttggtccctcctttaccgcgctggggatggtgagaggtgttttgcttgtgacttggtggctgtatatccagttctcagagctggtttcaggcctggatgactcctcttaatttctcacctaacatgaattacttttgaccacatgtcaacatatttagactgaagttatggagaaaggttaaagtatgatcgctagagatggcaaacgttataattatgattaacaacagctaatatagtagcatttaccattcactatattgtgtcacttaaatatactggccgtgcacgcctttagtgccagctattcaggagtctaagttccagaccagcctcagcaatatagcaagacccctttgaggtcccccctttcccctctccccat

SEQ ID NO: 178469 - DNA, 176 bp, Homo sapiens
acacttttttcatctttgaatcacctgtttgctgcccggcttatatttatacttgctgtttttaaacatcatgaatatacgatctctgatatgatatgatttataaaatttgggcagcaatggctgccttttaggagaaggacaggcatctgggggacaagcaggggtggcaggga

SEQ ID NO: 178470 - DNA, 543 bp, Homo sapiens
tggtcagcaaggccagcgttcgggaagaaagccagacatagagcagaggacaaagtggattctgacagacatttctgaatctgtctctgagtgtgaaaagatcatgaaagtcatcaaagtgtattcatcatgcctcactctgctttccaaaatcttgttccatttttgtcccgctcctaacccaaaccatgtagagaaaagatttctgggaaacactgttactaccgtaaccaaattgactcagtaaaatctgtcacagaaccacatcaaatattgaaaatttaaaattgacaacagtgtgaaatttgtttttaaatcatttttattataaaatatgcataagatgtaccacgtaaagcaatttcaagtgtacagttcagtgacattaagtacattcacattgttatgaaacctgtcaccaccatccacatgtagaacttttttcatcttcccaaactgaaacttctctaaccattaaacagtaactccccattccctctccccttttagcccctgccaaccaccactatcctttctcttatg

SEQ ID NO: 178471 - DNA, 585 bp, Homo sapiens
ggcggtggctcacgcctgtaatcctagcactttaggaggccaaggcagatagatcacttgaggtcaggagttcgagacaagcctggccaacatggtgaaacccccatctctactgaaaacacaaaaattagccaggcatgagctgctggccctggccaagaacatacattctgattggggcaggatgaacataagagaacaaaaatcttctctaatctaaatcttacactaattcaccattaatggaagtccatagtcgacccctaaagttggtgaataaagacatgacaatacaaacatatatttagaaacatgaagtaaatgctcaagagatgcaagtgggctgcttcttctctagaaagacagaagatgatcggccgggggcggtggctcacgcctgtaatcctagcactttaggaggccaaggcagatagatcacttgaggtcaggagttcgagacaagcctggccaacatggtgaaacccccatctctactgaaaacacaaaaattagccaggtgtggtggcaggcgcctgtaatcccagctaccaggaaagctgaggcacaagaatcacttgaatccgg

SEQ ID NO: 178472 - DNA, 501 bp, Homo sapiens
gctagtctcaaactcctgggctcaggggatcctctcatctcggcctcccaggcatgagctgctggccctggccaagaacatacattctgattggggcaggatgaacataagagaacaaaaatcttctctaatctaaatcttacactaattcaccattaatggaagtccatagtcgacccctaaagttggtgaataaagacatgacaatacaaacatatatttagaaacatgaagtaaatgctcaagagatgcaagtgggctgcttcttctctagaaagacagaagatgatcggccgggggcggtggctcacgcctgtaatcctagcactttaggaggccaaggcagatagatcacttgaggtcaggagttcgagacaagcctggccaacatggtgaaacccccatctctactgaaaacacaaaaattagccaggtgtggtggcaggcgcctgtaatcccagctaccaggaaagctgaggcacaagaatcacttgaatccgg

SEQ ID NO: 178473 - DNA, 624 bp, Homo sapiens
ggatgcccaatcagatccttattcttagggaattcacttgcaagcattatatctcaatatattgtttgagttctagcccttctttcctggggttttgaaggtgacataccccacatcacaagcaaagatttaagaaactggtcaccaaatttgagaccaaagtcttcagtgctctcataaagcactgaagtttcacaattttcttcctactttgaaagtttaagtctggagaaaggagaaggagaaagagggtgcaagagggtgactgggaggagagaggaacacttggaaggattagatttctccaactgagaagggaatgaaagatcacaaggaatagacagtaaagtgaaggagactgcagccaagctgcccttgagttgtaagtccctcactgaccttggtttgaggtcaaatcaaggttcaacaatcttggacactgttgggcctccagaacttgggggctcacacttcttgcatgtgattaggggcactctatgagagaactaaaccaagcaactgggaatttccttaagagttgggcaataatagaaccattgtcattgttacagaggccttataaatcagcattgttgtaggatggcagaaggagcaatatggagg

SEQ ID NO: 178474 - DNA, 296 bp, Homo sapiens
cctctttcttttgctgctgttactgttctagcccaggtcttattacctcttatctggcccattgcctcctaactagctgacctatctctagtcttcgaattttatttatcctctactctgaggctaggtgagtgatcttaagttgagttttcatcatcacacttccctgatgaaaaagacgtcggtggcttcctcttgcccactgcataaaaatgtcaaatgtgctgggtgccgtggctcacacctgtaatcccagcactttgggaggccaaggtgggaggatcacttaaggccag

SEQ ID NO: 178475 - DNA, 112 bp, Homo sapiens
atgttagcatgcaataaagagtaagattagacccctgagaatttctgatgtatctactgaaataaaaaaattcctattgaaattttttaaagtaaatttgtaaatgattaaa

SEQ ID NO: 178476 - DNA, 981 bp, Homo sapiens
  misc_feature (6)..(6): n is a, c, g, or t
tctagnaggatcccccaacgctgctcacagagtagtgacggaattgtagcatcactatcatctagaaacttgctagaaatgcaagtgctgaggccctacctctggcctcttgaatcaaacactgagggtggtgttcagcaagcttttttattctgtctcaaaaaaagaaaaaaaagtcatgtttgtgggttatctgtgcctagggtctcttttttgccctcatattcttattaaaattcctgcattttgggtttggattctgctgtgaactgtaggtgcttgttgtgtctgtgtctctcttgaccaaaacactatatgtttgtctttgttggtccaatgaaagagcttaacagttttatgtgttacatattttgtagtaaaatgtgtgttgtcttgtgagaatgtaagctccacgagggcataaactttgttttatacattattgaatcaccagtgtcttacacagtaatatttattgaatgagtaaatgaaagaacccaggtgtattgattattggagaactgttacttgcatcagccaggtgtttactgttttgtttgccctggtaaagaacgtcacttaaaaatcacataggggccaggcacggtggcgcatgcctgtaattccagcactttgggaggcagaggccagcggatcatctgagctcagactcacatagggcttgataccagggaggaacttggagttatctttttcacctttgtctactgtatttaaaattactactatcagacttgggccaggaaaaaaatattgctctgctctttcataattttggaactttttttctagaaatcaatcttgtaggaattgattgggactcatcctaagttctgaagacatggaaaattgtttgaggtgacacaaaatgatggaagtttttattactgatccagaagctctaatgtaccttttgctaatcaactggattgattggatgctttacaaaggtttaacatt

SEQ ID NO: 178477 - DNA, 297 bp, Homo sapiens
gcttcaaagtatgtgtgaagattttttgtataattacaaaatactgattaattaaataagtactatgaattttatagagttgttattttgtgaaagatgtgataatggatagattccatgttttagaagattgctattacctgtgcctaaggatcccaagtgcttagcactacttctaaaaaaaaattctggtatgcccaatcacagtgcttagaaaaacataaactctaaagggttatctttttacctgaacttgtaaagttgcatcaaatgagaggatagccttcagtgaatcag

SEQ ID NO: 178478 - DNA, 317 bp, Homo sapiens
taagattcaggcttgcattttcaccggatttctgctggaactgcctccaggctttgggcttcgctgtaagctcctgtgtttgtgtgcactgcagcccagtcgcctaaacagcagacatacattttctcccattctggaggctggaaatctgagctcgaggtgccagggttgctttctcctgaggcccctcgtcttggcttgcagatggccgccctctccctgtgtcttcgagtggtctttcctctgtttatctgggtcctgctctcctacttgcataaggacaccagtcgcatcggattagggcccaccgtaaatat

SEQ ID NO: 178479 - DNA, 313 bp, Homo sapiens
atgtcccctctcgttaaaggaataaacaaaatactaaaaccattggaactttctggtgatagtcagattttttgagaacgttgtgataaatttataggatagctttggatgtttaagtctcagccaatgcattggtcatttttaatggttttcttaaatttgtgcagtgtccatctgaccatttgaaaatgtacagcctgatgtactttgaaatttttctgcatttgggatatatagatagattagattagatagatagtcctgtccttcgcagcaacatagatagagctggaggccatttttctaagcaaaa

SEQ ID NO: 178480 - DNA, 498 bp, Homo sapiens
catccctcggtcctctcgtctgtgctgtgggagtggggagcggcaggtctttcatgctccttctgctagtggaattcctgctttctagcatcccttcatttcatcactgggtgcttgtttgctcaggattatgcctcatcttcgtaagtcagacatgatcctggcgcttcagacactcagctttgcaactccctcaaaatgggagccacaggcatgtggggggttgagctttatcctgcccagcccctcgctcagtgggggtgaacagagtgagaggcaggacttgaaagtatttgcccagaatcatacagcaagatagcatcatgtgcaagaggcagccatgtgtactccgagtccacactgccattcttgttggcctttgcaggccggcctcctgaaaaacttgtctctgctcacttcttcagtctcttctccttctgtcttcccttcaacctactctaatcagaagatagagacagaagtaagcagtgaactagg

SEQ ID NO: 178481 - DNA, 475 bp, Homo sapiens
taaaatgtactataagccaatgcttcttaacatgcatttgaatcatctgggaatcttactaaaatgcagaccttgattcagtggctctagggtagagccttagattacaaattccaacaagctcccagcagatgctactgccaaaagtatacggccctcactgtgagtggcaaagccaccaccttttagcagggcatgcagtgggagtggaaacagtcacgcaatcatatctaccctgttctactgcaagtgagacgatgaactcctgtcttgggtctaattttccatggtagcactttaccccagttccacccctgttcattcactcaatacacaggaaatttacatatgtaattcaaaacaaagagactcccttctactgcaaaacctaaaacagtaaaaagaaacagcattcgagagttgattatgttcacactacagctactgaagcatttttataatcactgtgtcattc

SEQ ID NO: 178482 - DNA, 484 bp, Homo sapiens
gtgaaattatgaaaaataatgaatacaagataaatgtgtccccagtgtcagtcggatgtgtaccttctctgttattttccagtttctaaactgttagcaaattaggaaacatttccatctccgtcagtggaggattcactctgcttccaaagtaaacacattcgtgaagaagtgcgtctatagcgagaggctctttaacatagaacagaggcatttaaatcgctttcaatttggctaatatcctgaggaatcttaaagctatatctttactaaagagcatcaaatacttccaaagcaattgggattttccctctcatttctggaggcagataaatacccttgaacgaagcagcgctcggttacttcattacttctcatatgtttgctgtgagatattagtaaaccacagccatgaaaacagacattccttccacttctgcccaagaaggaaagttcataatttagagatttctgcacatcttga

SEQ ID NO: 178483 - DNA, 541 bp, Homo sapiens
tatgtgtcaggcactgggctagaagctgagaagagaggggaatgtgagacacaatccctccagtcaaagagcccttaggccatgaaggcaggcactacaaagacagaatgagatgcaatatggcaggataacatttgtatacagaaatctccatttctatgaggcaggaactttccccagcttcacgaagatttggcaggggttcagagaggttaaggtcacccaggatcatactaagagtgcctaactatagagccttgggttgccaaagggtccacagcagctcccaggagaagggaggtacatttgtgaggggcctgatatcaggaccctggggcaccaagtgggtcaggcttcccggggagaggcaaggtggctggaggatagcatggtgtggtgaggaaaggagggcaatggcaggcaggcactggtccacagatggtaagtggcagggccacaagctgcaccactgcagacagttggtagaggccagcccaggctctgaggccaatctctgttcaacgctacaaggcaagacttc

SEQ ID NO: 178484 - DNA, 496 bp, Homo sapiens
gtcttcattttcccccaccccaatcgccaccttctattttctgtcacagaacctatgagttctaggccagacctttgaccacaaaactgactgttgtttccctctggccatacggagatcattgctcagggaaaactttggctcaaatggtgaatttaaggtttctaaaggcactagatagacatatgattataaaagcaagagcttctgtacagtctggcctggaggatattgagaagcttttctctctggcctagtgtatttataagaactggatgtacttgatctcgggacctcaccaggcttggaaagtaagccaaccgaaggtaagtagaaatggaagatgtacacctggagccctctaaagggaagcaggctagggaaatgactgatgtctggaaatggcatgaaagtggcataatatgcagggctacctgggcagccagccgtctttatgttcatctggaacagcagtccctgtgtgatttggtcaaag

SEQ ID NO: 178485 - DNA, 601 bp, Homo sapiens
ttaaaaacaaataggataggtataaaaactttctcagctcaacagttttcactaacgcctaaaatacgagcaatcctactctaagaccctattttctttctaaagacaatcctatgaaccgtatcttgctgggttaacacactcctgatagtagccagtgcccctacaacattaaaaaatggtcatagagatttccaaagaggtcacggggatcaaggtgaaccaaatattacagaagaaaggagttaagggtctgagattcaagcttagctgaaccatttgtatgttctccttggatttcagtttcttctgtaaaatgggacaccgccacctgcctcggaagatacttctgatgctcaggagagacatgaatacaaagtgctttagagggcaaggtttaacatttatataggtgtgggccttactgccaccttagcccagctgcctcttcaatagcccagggtaatacctcatgaggagcttgtaaacaaagtcctgaggccggatgtgccagcattaagagagacttaagaatggcaactacagtcataatgaataccctctgaatatttatgtcatacctgtcaggaggggccatgtt

SEQ ID NO: 178486 - DNA, 253 bp, Homo sapiens
acacgttcatgtgtgcacttgtatgtgtacctgtgacatagctgtttagaatggttggaccttcagatggattggccacagacctttctgtcatgacacagccttgccagtcattctttcagcttcctagctcccctggcagtggtggagaagatcccaagttgttatcaactgaacaagtgaaggaaagttggttattttaaggcacatgaattattttaggatttctggttgtccctggctaagtttttga

SEQ ID NO: 178487 - DNA, 349 bp, Homo sapiens
  misc_feature (57)..(57): n is a, c, g, or t
aaaatagatagatagataaatagattgttttacttgcatgcctgcagttgactctancagtaccccaaagaaaagttgaaaaacctccgagctcaactaagaatcagtttctagaataaacagaagtataaataattatacctctttactttaaaaatattacagacattataagtattttaataacaaaaaatcaaatactttatatatgctttgtaatctgtcctttacaaaatcatttaacctttatgacaggagctactatggtgctcattccacagatgaggtgctgaggtttagtgaactgaatagcttgttcacagacagctggagacagagactcagtttg

SEQ ID NO: 178488 - DNA, 235 bp, Homo sapiens
ggcttttccttacacaccaaacatttctcacagagaccaactgggtgtcctcttattcaattcaatcctgacactgtctacctgcagatagtgtccaatcccacagattgacggctcgatcccatgagaccagccccacttcaggcactaattccaagtccaggcgacgcatacttctgactgcctggctaaaaactacatccacggccggtcatggtggttcacgcctgtaatc

SEQ ID NO: 178489 - DNA, 402 bp, Homo sapiens
tatatagtgaggagtggattcacgtgtggtttgtatgttgtattttaatatgaattactatgatggttttggcaaaggaagtgtggaggatcctgacaaatatttggtgatttataccagctaatatttaactatggaaattaaggatcagtggttcaaaacatcttgttcaacctcagctccttagcacgatctttactgcatgctggaatgggctgctttattgtggccaaatatagcggccacagtacatatctgcatgtatctagagattccatccaaacaggtcctgttcttgcctgagctgctaatgctagaacgttaggtttcagatcagcctaaccttgatctaaggttgccccggtattttgtttagttattgtaacgtcaactgccgtagta

SEQ ID NO: 178490 - DNA, 196 bp, Homo sapiens
tttccctagacatgcacaagccaaccccactgtcactgcagatacaggctggcctggaaccaggcaccttttgtccatagtccttcacacagttggtaatcacatctatttggagttcacttaaggtcttgtcttccaggactagatcacagtgtccaagaagaaagggatatgtttattttgttcccattatagc

SEQ ID NO: 178491 - DNA, 350 bp, Homo sapiens
ggagtgctaagtcaatttcagttttcaaaggtgtgtaagtctttaagaaattactcttgttgtaacccaaactcatgaaatgcatgcctcttaaagcacccagtcttttttgttgttttttttgagatggagttgctctctcacccaagctgttgtgcagtggtgcgatctcggctcactgcaacctctgcctcccaggttcaagagattctcatgcctcagcttctggagtagctggaattacaggtgcccgccaccacgcccagctaattttttgtatttttaagtggagacggggttcactgttttggccaggatggtctcgatctcctgacctcatgatccgctcg

SEQ ID NO: 178492 - DNA, 324 bp, Homo sapiens
tttaaacccttgttagatggcatcaattagacttctcaatgtttcttcatgttttctatttttatctaatttttgtgaattttgtaattctccatgttagttagaattatttagaaatggcttctttcaagtagagatgatttgtgtaagtttagtactctagaggatgaaattatacaaacattaaaagttgagtaaaacattactagaaaatatttgggatgagagacaatacttgctgaagtctctttagtgccttttacggcagacatgacagccaatcctgatccagactttgctcacgctctgtagaaaagagaaagt

SEQ ID NO: 178493 - DNA, 470 bp, Homo sapiens
ttaccccagggccttagtcggctcccaagtctctgcctttcacctgagaaagaatttccaaactgcctgatgagggagaaaaccatatccatggtcccagcggtctggaggatcccaagaatctggatgggaagccagaagatatgccagaaaagacccacaaatggtaccctgggatacaaaaggaagactcctttaacgccagccaagagatgtgtgtgttactgtaagaagccagtgtcatgagctgaagctctaacttgcctgtgatccattagtctcacctggtgcttgccgctgcccctgttccggccggacatggccctctgtgtctgtgcctgccaatcagcctcttgcccatgcctggctgtgcccttcacagctgcctctgccagggcactggctgcgggctgggccaggtcaggctgcttcccagctgggctccccacagccacagtcaactcccattt

SEQ ID NO: 178494 - DNA, 349 bp, Homo sapiens
agagtgcagtggtatgatcacggttcatggcagcctcgacctcctgggctcaattgatccttagcctcctgattagctgggactacacgtgtatgccaccacccatagctaatcttttttttatatacttgccaggcagtagagggaacaaatactttagctttgagccatggctctccaccctaatggaacaataaaacgattaagggatgctaaaaaaatacagatgccaggcctctctcaggccaattcagaatctcaaagagggcagtgtagacatttaaagctgcccaggtgtttgtaatttgcagccaatgtggagaaaaccactgaactgggctggccacgg

SEQ ID NO: 178495 - DNA, 182 bp, Homo sapiens
ctagctaatgagaccaaacaggaatgatgagagaagtacgcagggcagaaagaatgccatatccaaaaccaggagaaaagaagtgcaaggagggacaggttagtaatgccatgtaaatcaatgataccaactcccagaaagtctgataaatcattttttaaatttggcaacgtgattgcttt

SEQ ID NO: 178496 - DNA, 287 bp, Homo sapiens
gcttaaaataaaatatgtacatctactaggaaattagtaccaacacatgaatctgtctgatgggcagatattaggaatgaagtcactccagatctgagaaattaaagttgtaaaggactgcaagttctgtgtttttgttgttgttgttgttgttgttgttgtttgttttttcatttttgttttttgggtttttttgagacagagtctcattctgtcacccaggctgtagtgcagtggcacgatctcaactcactgcaacctccgtctcccaggttcaagcgattctc

SEQ ID NO: 178497 - DNA, 390 bp, Homo sapiens
cgtctaactgctctcctgctgtctcctttcctagtcgcggtcctcgatcttgcctgggctgccagatcacccgatctccgggctttactccgttttgtaggccctttagtgatgtgtttaactttatgttcctctcgagagtctcattaggtatttttggcatttcattttttaaagacctagcaagttgagtctcagagtctcctctttaaaaacaaaacaaaaaatacggggtagaaagttgaaagagctattgagtggggtaaaacgacgctcagaacaaaggtcctagttgtgttagaaaaaaaggcaagaggcctgtatatgaggcctgtgtgtgtcgcatttacaccccgggggggttgaggaatggaattagcagaggtttag

SEQ ID NO: 178498 - DNA, 378 bp, Homo sapiens
tgtgtgtgtgtatttaaatttaaaatacaatataactttggcctcaactactttattttcaaagttatttaggattgctgattctcacctgtctcgaatcttttatgctattaagacatccagacttgaatgatatgattgcaagttacttctgggaacagctttaggagtaggcagaacagactgcagatgataaagtccaccttgtcttttttttttttttttttctttttttgagacggagtcttgctctgtcgcccaggctcactgcaagctccgcctcccaggttcacgccattctcctgcctcagcctcccgagtagctgggactgcaggcgcccgccaccacgcccggctaattttttgtatttttagtag

SEQ ID NO: 178499 - DNA, 499 bp, Homo sapiens
acatgaaggagcaagttatataaatatccaaggagaaaacattgttgatggaacaagaatagattatgtttggcatatttgaggaatagccaggaagtcagtgtggctggagtggagtattagaggtagattgtaatgtatagaagaggtcagagagggggtctagggattaagtcattagtgccttatggatgttggtagaaagcctttgaattttattttgagtacctaatgagaatcttttagaggatttttagttaataaatgacatgatctgagtgaatggtttgctgggctataagactggaagcaagcagaacatttaggaggctgttgtgtgagtccagagtagatgagaagtggtcagatttgggatatattttgaaggtagaaccaataggatttgctgatggaaaatgtgaggcatgagagaaagaaagaaatcaaggatggtttcaaggtttttgctataacagttacagtaggtggtcctatataa

SEQ ID NO: 178500 - DNA, 310 bp, Homo sapiens
atcacctgcgtacatccccctccttcttccctgaactggcatcctgctgaggtgtcctcgtatccctcagcctcatccacctgcatttcatccccctccttcatccctgaactggcaacccactgaggtgtcctcttccctcagcctcatccaactgcgtttcatccccctccttcttccctgaacgggcatacccactgaggtgtcctcttccttcagccttcatcttaccggggcttggtgggggcacaaagccatcttgaagttcagctcttctcattcctaactaccccactactgttgtctcatc

SEQ ID NO: 178501 - DNA, 494 bp, Homo sapiens
accagggagggtggctaaaaataccttggtcaggggcctagagattgcacttaggagactgctttccagaggcagcccggggagagccgacagcagtgtgggcgccagggcccccaccagctacaaaggtcagccagcccccagctgccttcaggtgggtgtttctgccagttctcctttagtgttcaggctcaaatgaaaggccactttcagcaagttttcctgacattgtcggagactggagccaaggccctgtctgttttactttctgaaagagccagtctgagagatggatgggttggcgactgaacaccacaaacaacagcagtgggctttaacctgatggtggaggctccggcacaggtggggaaggccagtggctcagaaggcctgacaaggacaggaccaaagctccaacagctcagagctggactccttcccatcccagatctgagctctttggttctccttcacagaggtgattatggttcata

SEQ ID NO: 178502 - DNA, 883 bp, Homo sapiens
cacaccactgcactctagcctgagcgacagaacaagatcccatctctgaaaaaatggatgagtgaattaaatttcaaaatagagatttaatggaaaaatgagaattgttgtgtacatgatttatgaagtggcttacataatataattttggacatgaaagccctgaaaaatagcttcttattttaaggatgaacagactgggatttatttctgaaattctataattctcagtcagttgtaaggctttcattatataatagacttttttttttaaccaacggaagttggacctcttcaaaatgtgagatccaaaaaggttttggatattgtttgaataactctcttctccaaaggagactgtttttgaaaaatgattctttctgacatgttaaaattgaatatttttgacacgccaaatgcaccaaagtattatatgtcatgtttattgccgagagtagctatatagcttgtgggagacagttaacgtgaagctttcttgcatctggaagtatggggagagagaaggcttcttcacaccccctttcatgttatattctacagggaaagaatttctatcatgtagacactaggtgactcccttgtggataatttcatttaacaatgatttctgggtgttgctctatgccaggcactgttctaggagctgatgcgaaggctcagctgatgggctacagacctgaaggcctgtgctcctcagtggcactctgtaggtagatacagagccaccatctactgggtgcttctcctgagtgtgacagtgtaggctgggacacgatgctacccttcaaggagcttgaagctaaggttctgtgcacagataaaattagaataaatgcagagatgctataacaagatgtcttag

SEQ ID NO: 178503 - DNA, 213 bp, Homo sapiens
cctagagaaggagacctgagacccactcatgttaactgaggagctgcagactcctgaagaaagggaattccattgcggtctttgtggaatcgtgtgactttgtcccctcccacagaggcatgctgctttgaagcacacaggacagacgttctctgttatcttaactgcattttctaagctatgccgagaacatgtgctaacgttaggtgataa

SEQ ID NO: 178504 - DNA, 323 bp, Homo sapiens
gcgggctcggcgcgccccgcactctgagcggtcggctggcgccgccggccctgggcagtgagaggcttagcacccgggccagcagctgcggagggtgcactgggtcctccaacagtgatggcccgccggcgccgcgctcgaattttcgctgggcctcagccacctccccgccccccgccccccaaccgcgggctcccgcgcgccaccccgaggggacgggcgccacctcctgctacgcggcatccggtcccgtcaaccgcccaacggctgaggagtgcggcagcgcgccagagactggcgggcagctccgcccgcggccggga

SEQ ID NO: 178505 - DNA, 724 bp, Homo sapiens
gaaagggagaaggcaagcagtgaaagaggatgaattcaaaacagcaaaggtctatttccaaccaatacagaataaaagcactggcaaagccccccatcccaaattattggaggtcaccctcaaagttctgggaaacctgcaacatccttcctgtgtggatgggcaaactacacatggtgcctgtagctaagacatgcaatataaacttgtcaaaacagctctctgacatgatactctaccactctttaccacacagagcagaacaaaagtagaacagaaggaggggactcaggaacattgcttaaccctaactcagacaaaattggaggcaaaagctttactaatcaccccacagattaatcactggcttaagggtattttagctttctgttaaaacacagaatacaccccaacaacttttgttaaatctaaacaaggtgagatagactcgtggaacatgaataaaagccctttcagccttagagactggtgtacttatccaaatatttaccaagtgtgccaagcactttgggaactataaggaaactaggacacagtgcttgccctcaagcagcatataatccagcagaaggctgaagacagaaatcctaggctcacacggatacaggagcaggtcccaagagcagagaaaagagtgcaagccagccaagggctcaaggaagctttcagctgggccttgactaactcctgggaagataggtac

SEQ ID NO: 178506 - DNA, 228 bp, Homo sapiens
ggaaagggaaaatcaacaaagaaacacaaaatatagcactggtttttagaataatgctgtaggactcatttcaattcaggtatcaccaaatagaccatgtggctcaattctaatatagattttcagtccctcattgctggtgagaccaggctgtatatgatttctcccctgtgttcagatggagacatggaagaaaatgtgatatattagttatctgtaacaatatta

SEQ ID NO: 178507 - DNA, 249 bp, Homo sapiens
gattggttgagtctgcagtgagcaaagatcgtaccatatcacttcagaatgggcaacagagcaagacccttcccaccctcacccaccccctccccccaacaaaaaaaagcccacagtgaacatctcattcagtggtgaaagaccgaaagctttccccctaacatcaggaacatggcaaagatgcccattcttgccactgctatttcaacatagtattaagagtcctggccagagccaatttaggcaaga

SEQ ID NO: 178508 - DNA, 294 bp, Homo sapiens
ctctgagcatcccaagtcttaccatgagttgctaaaagagaaccagacccatgtttatccctttgaaagaaacctgaaccaagccattcctctggactgttcttccatccactggaccaataactcatagtttgaaggatttttacttaatggaagtgagaaaacagccagatcaaaagaatttccaggagccaagacagaaaacatgcagagcattagacagcctaaatggagctggctagatatgactccagttgtgaccaagccatagtgccccctaagctgggtgaagag

SEQ ID NO: 178509 - DNA, 145 bp, Homo sapiens
atcatttgagcccaggagtttgatgtaatagtgggctatgatagcaccactgcattccagcctaggcgacaagaacaagaaccccatcttgctacaaaaaagaaaactgtacagcagaaaaccctagagtatctcaactcccagg

SEQ ID NO: 178510 - DNA, 569 bp, Homo sapiens
taagtcagactccaacaaagaactggagcacttttgtttctaagtgaccatcaggcacctaatattattttcccttcagtaaaatataagtgataatccttgtcctaccccactaatgatgtaaaaataatataaccatacagtaagaaatcaaacatgctttgaaaaattgcagcatagggctaaacaagagccactgcataaagcaaagaagttttgaagaagaaagggatcttgaaggttgttatttccagttttttcattttatgaagaaagaacctgaaacaggaggtagacatttgcccagactggatcacctactgagaagtagagtttggtctcctgaccctttgtccaatgctttttctaccaaactacattattaggattattcctgttgcttttgttattagtgatgttaagaagcacaagactatttttagataaagagatagactgacctagcaaagcagccatactccttctgggtaagaaccgctggtctgcactgcagaaactttgttcttaataaccctggtgtcctaagaagtctatcaagagatgaagag

SEQ ID NO: 178511 - DNA, 381 bp, Homo sapiens
catgatctgtgatggaatttaggaaagttgatattagttggttggattagcacaatcaacagactatgccctgtatgccaaatgcagtctaaggcaagtttttgtaagtaaagttttattggaacacagtcatactcattcacttgaatattgtctgtggctgctttagtactataatggcaagagttgtgtagttgagacggagactgtgtggcctgcaaagcctaaatatttgccatctggccttttacagaaaaagtttgccaacccctggattagaggagtggaggcagaaatcctgttcattgttgttctggttagggtataaacccatgccttcctgtcaaatgaaatgaaggccagaattgcgatagccaccct

SEQ ID NO: 178512 - DNA, 683 bp, Homo sapiens
cttctaacatgttacatggatattgtattttaattaaaataactacacttttcaaaaggggaaaaaaaaaacctacttgagccacaacagttgtattccagtcagggtcaagatattccctggggttcatagttaatttaatccaccaccaccccgagtcttgacccaaaaagcagcagcctcagccaaaactcagacctactctttggtaacctgagaaagcttccaagatgcccattcattcactctaaacaggggaccctctcaaaccacaggggtgagctgcagcctgggcctcatgcactgctgtgtcctctcccaagtgtgctcaagcacatagctcacctgggctctttgtcctggtgaggttagcagtcacaaacacaagccctcccagccacaggacttccaaccaaggaaggaaggaggctataaagctagaagcaacaaactaagcaaaagggagtcatggataaggcatgctcccctgaacccagtcaaatcaacagcactcccagctccttcttcagtgaaatgtttcagaatgctccattctgttcccaaaacaagtcagccttcctgaaccagagaacgcttgtaaaatttgatctagactctgcttctgtgctgctgatgcctttagcggcctcagactccacccagatctgcccactctgtctcca

SEQ ID NO: 178513 - DNA, 266 bp, Homo sapiens
ctgtccccttggatggattaatccactcatggatgaatgggttaatgggttatcactggagtgggttagtcagcacaagcagggtctgttataaaagctagtttggctcatgctccagccctctctctgtgcgatgccctgcacctcctcagcactctgcagggtccccaccagcaagaagaatttgaccttggatttctcggcctcctgaatggtaagaaagaaatttcttttctttataaattacccggtgttaggtattcagc

SEQ ID NO: 178514 - DNA, 479 bp, Homo sapiens
ctgaaatgtggctaactacagcttgctgagattagcccagctccgagctctagctcctgcaggccaaggccactgcttctgccctgtgaaggtccctcagagacaggaagacccgggctactcttttccagctgtgcccctggggcagaatttcctgtcctttcccatcctggtcgcttctgctgcccgttccccaggcagtcaccatctctcacacagcgggagtcagcaactaaacagggtcccgtggggtctgtccagcttggccatcagtccttctggctggacacaactccatcattaacacagacactcctgagcttcggctgaactcctttttggggtctgcggacctcctgagtccccccctctcccagcccctcccaagtcccaagagacagggtcttattgacatgcaagtgtcatcaggtatagtaacactcatctcttgagcaccctaaaaggtgcatggggccgag

SEQ ID NO: 178515 - DNA, 665 bp, Homo sapiens
tgcagtggctcacgcctgtaatcccagcagtttgggaggctgaggtgggaagatcagttgaggtcaggaattcaagaccaggctggccaaaatgatgaaactccatctctactaaaaaaaacaaaatgtagccaggttggtggcacatgcttgtgatcccagctacttgggaggctgaggtgggaagattgcttgaaaccgggagccggaggttgcactgagctgagatcgtgccactacactccaacctgagtgacagagtgagactccatctcaaaaataataataataataataaaatagggaaatagtattcattattttcaaatgcatatgaaatgcttaaaaaaaactaagcatttttaaaaatcctactagattacccccaaagtaggaaatatccatgccatttccccactcagaatgcaataaaattaaatagtaaaaacaaaacagtagcactgccaacatgaaaaacattttattaaagtgggactgtgaaaacagtgttttaagtaactcttgaactacacaagaatgcaaaataacatttaaaacaatacacaaataaatgatagtgatagctgtatataagaaaatctaagggcatgcagccaaagctgtaaccaatgaaaaataatggccttaaattgcaagatgtaaaa

SEQ ID NO: 178516 - DNA, 767 bp, Homo sapiens
aacataaaaatgttctggaggacttaaatgggaagtttctaaaaacaaaataaaacttatagcctatatagtgacaagacaaagaaaagaccacctttaggctccaaaaggcctgaaaatgtggaaagataagtttatgggaagagtaaatctgtccctctatcctcgatgcttttgtctctgagctgacaaggaacattaagaggcctatctttagatgggaaaggcagccaagaggacagtaagaccttgtctttgtaaattgctgtcctactatcaggtaggcagagtgagtggaagaatatcctcctacatattttttgagacggagtctcgctgtgtctgtctcccaggctggagtgcagtggcgccatctcggctcactgcaagcttcgcctcccgggttcacgccattctcctgcctcagcctcccgagtagctgggatcacaggtgcccccaaccacgccctaaaaaattagccattttttgtgtttttaggagatcttcctactttttaacctcctccagctctgcactctttaggattttgataaagctccgatgagtggaggaacaccagggttcttgccttgcttagaattaggtaagacaacacggacacatgtggacagattttaaggagtagggagtttaacagggaagaaagaagggggaagaaaaaaagaagcagctcccttgtagagagagagaggtaggaggatccaaagctgagagaggaaaccccgctttcaggtaatgttagcca

SEQ ID NO: 178517 - DNA, 741 bp, Homo sapiens
ttcctggaggaggagggaactctcaagagcacatttttcaagaccaggcagagggaggaggctgcgtagggtggaaatggtgctctaggcaggccacagctggagtaaagccatgaagatcagaaccagctgagttattcagagaaccaccgtggtttgggtattgccggagagcccagcacaaagaagagtggagggaggctggctgcggaggcaggtggggaccagaccatggccgcttgggagtttggaccagacactgctgtacaagccagcccacagggaggactgggcagacctaggcaacaagctgctctcctcctctctgggtgaccccagacaggactcctcacttgtgagattttaccaggcaaccaaaattggatgcttagagcaggaagaagagtctacagagggactcacgggcattttggctttgaatggccgaagcctagctccccaggctcaggcacaatggtgaatgtatttgctcatgcaactggggaatcaagggacactcatgttcaggaatggttggatccagaggctcaagccttcctttcaggcttctttctctccagctctctgctctctgatgagtctctctccacagggccccagccaccgaaggctcaaaaaaaaaaaaaaaaacaaaacaaaaccctgcttggggagttgtgagaatctgaagcctgatactgcacagaaaacctatgaagccactgggtctggcctggaatg

SEQ ID NO: 178518 - DNA, 345 bp, Homo sapiens
tatcttatatctttgacttgcaaaagcctatatttttagaatcagtttttttagacattagtctgatacagaaaccaaggttctctgcagcagaccattctgaggttgtggggatattgttggaaagaaatatgattaggatttattatacattcttacctttatttgttttttgtcagagaagcagtcacccctgattgttgctttaggccatcaattgatgtgcactgcaaggggtaaattgttctacacattagtaagctgggtaagcaaattgttgtgcaaacctaatttgtttcctagagaaagtgactgacatacaattttgaaaatggaaatattcat

SEQ ID NO: 178519 - DNA, 304 bp, Homo sapiens
ctgtcatgctaatttttaagtttttgtgaatctgtctctctgttgccactacagtggatgttctcatgatcttttcatctataatatgataaaagccttatctgttcttttttcctctggatctctacctacttctccatccttcgcattgctaccagaaaactttaacataaatgccatcattctcctctgattaaaatggtttgattctctgtcactaagagaaaaaatttcagtatccataatatgacattcaaggtccttcgcccaggatatcttttcagcctaatctcctacttcgtcc

SEQ ID NO: 178520 - DNA, 583 bp, Homo sapiens
gaattcctatttgccagcattagtaaccaattctaggtagattaaatagaatggaatttactgaaagagtaacagtatctatatacaaagttatttgggaaagttaaaaatcaggctcagaaatcagacaggagccaaaggaggctggcagcagatgaatcagccaaggaccactgaaggaatagtctgattagaatgctgccagaacttggtgaagaactgttataggaagagcctaaatagaaactaaggacagtgccaccaccagacattctcttctcctgaattactgacatcatcactgtctcagtagatagcttgatggtttctgcatctttgcatcactccttctggattcaatgtgggaatcccactggacaaacttcagttatgtgctgatgtccttgctgtctagaagaggaagatatgccttttttcagttcctataacaggaaaagtgttgagatgccaaataccaaagcacacaaaccccagacacacaaacacatccaggacaccatacttgggtttgtttctggactcactgttttattggtttgtttgtttattttgctgtcattat

SEQ ID NO: 178521 - DNA, 184 bp, Homo sapiens
ttcatcccacactcattcaaaacattcaaaactaaaccatctactggacacctccaatcttgtcactacgttattgttacccagaagtcatgtttggagtcatttctgtttgtgtttcatcatttttacttaatcaacatattgaccattgtgtcaagcactgatatagacagtgatgaatatg

SEQ ID NO: 178522 - DNA, 201 bp, Homo sapiens
atggagtgggaaggagaatcccacaactgcgctgggtttcatgtcactgaaccagcctgcgtacttaatgggattctctaacccagccgtggggttactggtagcacctctctggtttcagcgaaggggcttcggtttatgaatttccttggagttaagaccctgggaatgagtgcaatcttaaagtccatcccagagaag

SEQ ID NO: 178523 - DNA, 162 bp, Homo sapiens
acttgtgaagtgttccatatttttaaacaaagcattttacttaaaaaataatacaggtgattcttgttccacacaaaaatcgaacagatgcacatctacctctcattttactaagtacaactaaaaactctggaaattgtctataaaataaacataagcaaa

SEQ ID NO: 178524 - DNA, 463 bp, Homo sapiens
ccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagatatgcatcttgggagaggggctctgaaaacaagattccagggaatctaccttaaaaaaaatattttactggtaagccagtgagttccgtcagcctgtcagactgtgggtgggtgactgaaaccggaagtgcatcataaaa

SEQ ID NO: 178525 - DNA, 793 bp, Homo sapiens
gcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggacaacggggtgtcaggggagtgacgtcccttgaggcctagtaaccacgtgaatgggattgactttggtggagagccaatgttttcacaggcggggataaagaaggtgtttctggcacca

SEQ ID NO: 178526 - DNA, 1684 bp, Homo sapiens
gcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggacaacggggtgtcaggggagtgaggggtggaggtaggggccaaagaggcttacacgatatcccatacctttaatgcctttggccttccattctgacttctctgatgagattattgtcaaccctgctttccctggtagatatttgccaggcccaatgctttaaccttaagctgatatttttgctttagatgtcaatctcgttaccagcagccttttgacccaactacagcgctctatattttagtagaggattttcacccatgtgcatggaaaagatgttcatgacacattgtaaaaaataaataaataaagaacagtttgcagaacctcgtatacggttatcagccaatatttataaaaatgtaaatgtttgtataatgcatttctgcgcaaagaaaaccctgaaagcatgtacactaaaaagcaggcaatggttattcctgaagggtagccaagaataggtctcacctgtattcaaaaatgagtcctaccacctcttgtatgtacctccatgatattcctctgctgctgtgcacatccctatgtcttccctaggtcgagccaggtcagtgggcactgttgctaggtcctctatcatgttcctgggtcttctaacatgagtgctgggtctgcatactcagacccatactaaaatataatactaaatatttgtcatactgaaaaataaataaaagctgaatacaatacatactaagaaattgaactgtttggtgcgcttacaaaggcaataaagacactcagaattcctgttatcagaacataagatgacaggtaaaattcatattatctctgggactaaaagctaaaggaatcaacctggaaattctaacagatctattgctgtaagagtcaatcttgtcatttgtaaaataagggtaatacttgcctcacaggactgcctggtggatcagatgagatactaagtatgtgagctgtgttgtgacctggtccccactaggcactcaggggaggaatggctcctaaactatt

SEQ ID NO: 178527 - DNA, 161 bp, Homo sapiens
cacacaggaggaatccttccactctgtgacagtccatctgcttcccctccagatgtgtttttcaggaaagcaggcactttgcgttgaccatcgaagaaaactccggccttctccccgcttcgccggccctctctcccctcctgccctggcccagctcggga

SEQ ID NO: 178528 - DNA, 414 bp, Homo sapiens
tggggagatgggggaaaataaccaaccacactgacagcaagttggcaaagtgcttacgtctccaagcactggtccatgtaatttgcaggtactaagtcatttatcctttacaagcttataaaacaggtactattattacttatatttaaggaggaaattggcgcaaagaaaagatcagccattttcccaatgccacacagctaccaaaggcagaggcaggaattgagcccaggcagctggatgctagcatacatggttctgccaaaagagacaattgaaaaaacaaaggatatgacttaacacaaaccaaaaccatagtaagtacagattccacttaggtaaaatcctgggtgtgcacacatgcccaaaggcagtaagagggaaacaaaagtattggagaggcctactggtctg

SEQ ID NO: 178529 - DNA, 191 bp, Homo sapiens
gccacattgtggggggcagagacaccctgggagacagagagctcccaccctcacaccacccccctgggaataccctggctggtggggagctcacacaggggaagagggacatgactccttagcagccaaagtggagtcgtaagagcagagcccgtaagtcagaaaccctgggtttaggccctggttcttgc

SEQ ID NO: 178530 - DNA, 387 bp, Homo sapiens
atggccggtgaagagtattgagagctcagcacgtgaaatgctaagaatgctaaaagcagcatgatctagtgcagtgattgtcaagtattttgtagacttttttttttccagatggaaacactgttcaaattaaatttcctgcagaaacatggtgtatataaaaacacaagcttctctgattaatgagaacagagctctttgccctcagcaccccacatcaccatggcagctactgaggcacctcaaaggaacctctacaaccctgcaaagtatagattgaaaaaggacacggattagtggcatggtcagtgggtgagccatcagaacactgggctggaatcccagccctgcccctcatataagaaatatcctctcttcaccggccat

SEQ ID NO: 178531 - DNA, 266 bp, Homo sapiens
acatgaagcaattaacagtacgacactatagtgacccagaagttctttgcaaagcctatggcacactgtaggcacttaatttattggaggagtggatggagaaggaagggacaaagagaaagtgatgcatgaattgaatagttagccatcttgactggattgatcagcgaaggctttgtgatgaggtggtacttacgttggttcctgaagttctgaaaacagtagtcttgtagatggcctcttccaatttaatagaatgaagacaa

SEQ ID NO: 178532 - DNA, 567 bp, Homo sapiens
gtagccactaaaccatgtgtgactgttgagtgcttgaaatatggctggtgggactgagaaactgaaattttaattttgtttaattttagttaatttaaatagccacatggagctaataccctatcagacagctcagttttagaataaatacagcacattaacaggtaaatacacatgttaagaacaggaagatatgttgcaaaaatgaaaatatgtattcacacatatttaatatcaaaacatttgcatctacaggtatgtattttgatatattaggttggtgtaaaagaaattgcagttttcaccactgaacataatggcaaaagtatataagtctgtataagcacaggaaaataatgggaaggatgtgcaccaaaaacaataattatctcaggatggcggtaaaagggggaaaatgaaatagagatagataatgggacctttaattttatttatgttgatacttatataaataaatgtgtatgtgtatatatgtatataataatgtgttgcagggaagaagattgaaactaattgctaatataacttcacagcaaatctcagcct

SEQ ID NO: 178533 - DNA, 497 bp, Homo sapiens
agagagagagagagagagagagagagagagaatgcatgtggcacaggatgaggtagaataggagaggggagttacaaagcaaactgagaaggaatggccagccagggaggaaggagaagtaagagagtgagcacaaggtcactgaactcaggcacaaagtaagtcctaccgagaggtagtcataggaggacagaaggatctattggaattgccaagatggatgttgcccatgaccatgataagagaagttcagattggaaactccagatccgaatggtttgaagagggaatgtgaagtgctacagtggagacaatttggcacctgttttcagaagtgttgctgtcaccagattctgatgaaaaattgctcttggatctttacctgctctgctgaaatgcccaacaaggtgctggttgggtttggaggtcgtgtcttcctgggagccagcccttctgggtatgaatgttgcatctgtgtagggagttgctaacttgta

SEQ ID NO: 178534 - DNA, 439 bp, Homo sapiens
caggtcttactactttcgcataatagtttagctttaaagcaaactgaaagctgctttcttctcagtctcaattagagctctcttctctacccatcccctaccctgcgaactctaggtgcctggggccctgcagacattcagcagtgtctcctcaactcaaggagactgttggactcagccaggtttccttccctgccctgcagcctggaaatgctctccaagcagcaagctggggcagacatagggcccatctctcaaagatcactgtcatttgttacctgaagtcctatgttttaagaacctacttttttatattcttggcctattattttcagtgtttctgatgggagggtatatcagacccctgttagttcttcttgggtagaattataagttgattttatttatttttagcgaattatttttccttgtctcaata

SEQ ID NO: 178535 - DNA, 554 bp, Homo sapiens
cgcatgtatcccccactcagcgcatgagtcactgacacacaaggtgacatactccttccctatcaagttgtcaaggacttttagaaaacagccatgctcagagctagagaggaggtgggaagtgggccttgctggtaagaatagaaaatggtacaacttttggagaccaacttggaaataaatatgaaaagcctgaatttgttgcattttctttgtttcagcaatatccattgttaggtctacctggcaggtagacctaacgtgaaaggaaagtagtccaggctgtccctgaaactgagtctgcggacactgtggaaagctttgaacaattgtgttttcgtcacaggagtctttgtaatgcttgtacagttgatgtcgatgctcactgcttctgctttttctcttctttttattttaaatactgaaggttctggtaacctgtggtgtatttttattttcctgtcgactgtttttgttttgtttttttcctttttcctccccttgaccctattcatgtctctacctggttaggtctaactgggaccagctcgatt

SEQ ID NO: 178536 - DNA, 265 bp, Homo sapiens
attcagaaatcttattgaggactgtagatgaggcctgtagcttgagagttgctctcttgagaggttctgtcagcacagtttcagctcactgcgtatatacaggtggtggaggttcaggacatgcaaaatcacatcaaacttgtccagaattacactaaagcagagtcatatcaaggtttgggcataagagtacacctggatataggttacagaagcataatcactaagactgtcagatattgtcttatgtgcagaaaaaggcaag

SEQ ID NO: 178537 - DNA, 399 bp, Homo sapiens
gtactgcctgtgcagcgtgcccagcccatttcctcaggagtgggctgagctggttttgtttttgactttgctcaagggctgaaccctaatggtagtaccttccttttcttcctgttcttctcctttgcccattgtgtggaattagctccgttaaagaaacaaattgcccatgtgtttgctgctgaggtcttttctggaggtgcattttcttactgctgctgtatgtgattcttaactgttgggagatgatagaattcagtggtgtagcaatgacttttactcctctggttttgatgctaatgtctaattttctttcttttctttctttcttcctgtcttttttttttttttcttttttgagacggagtctctgtccgtcacccaggctggagtgcagtg

SEQ ID NO: 178538 - DNA, 208 bp, Homo sapiens
aactcaggagagggcaaaagatgttggccctggaaggtaagagctgccaggatctctgagcgtttccctactcaggaatatggagcatcaactcccatccttcctgaaaaatactttattaaaagaaactgtgagcaaacagtaatacaaactatctgcaataaattatttttattgtaatcggtttcctagtgtatttgcttaaaca

SEQ ID NO: 178539 - DNA, 839 bp, Homo sapiens
ccaggtaactaaccttcctgagcaggtagtacaaggccttagttttctcctccatgccataccaatgcctacaacatttcttgcttgcatcattcatttgacacctagcacaacatggttccattttgttctggatatgttctgattcccaaactagactttcaaggagtgaggctggtggcagggctggtgcagagtgggagggtggtgagaatttaacttccgcaggcatagtttcacttggcatagagaattcttttttagccaaatccttaaggatcatcttgttttggtaaaccttatttttgttgttaggtctacctggccaggtagacctaacgatatgggattttcctccaagtattccttcagtaggaagaatggaaaatggaatttctgtaaaaaagtaaaattaggagaattcctattatgtcctgatggaattttgattttggaaagagaaagcaacctaaaataatttttggtctcattcttctttcttcctcacctctgcttttgtgcagttggttagggctggagggaggatggcactggggatttgcagattcttagcactctgggtcatctgctgccctggcagtgagcgactcttttagtccagagtgcgtcctttgaggttaggtctacctggccaggtagacctaactattagtggcaggttagttgtttgtagggctcatggtgggggtaaaaggagggcaatttctagatcaaataataagaaggtaatagctactaagaagaattttatggagaaagggacgcgggcgggggatatagggtcgaagccgcactcgtaagggggttagtctacctgg

SEQ ID NO: 178540 - DNA, 698 bp, Homo sapiens
tctctcccttttttccctcccgccccggcatctgttctcgcccgaagaagctggtccttagcctgcgctgcggagcaacctttcggtggccagctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattccca

SEQ ID NO: 178541 - DNA, 339 bp, Homo sapiens
  misc_feature (281)..(281): n is a, c, g, or t
tttattatatttacatatatattaactctcttaacacgagtatattaatttcgagcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcantttcttttcacgcgtgcccagacaggatggctttttccgggaagataaaacagaaagg

SEQ ID NO: 178542 - DNA, 199 bp, Homo sapiens
tttaaaaatacagtgcctttactttcccgaattctgccttccgatgcatgtaaaatatacaaacaaggtatcaatatcaggcttgacacaactctcatagactttactgacatgaagtgccaacgaggggatctaagcttcaataaaagagatgcgcccgtctgcgttcttgcatacacagtaccacaacaataacgcc

SEQ ID NO: 178543 - DNA, 424 bp, Homo sapiens
cgctaggatggagggggcagtgacgttgaacaggtacctgaatggccaaggaggggtcaagtgtagaattcagtttcaccaataaatgatgatcgtggttgtgaatgaagggaacaatttgcggggggaaatgatcaaatgatcaataaactgagaaattaaattttaagcagaatttggtgaagaaattattgagacctactctacatgagaacccatgttagatgctttggaggattaaaaaagaagaggccagcactttgggaggctgaagtgggagaatcacttgaggccaggagttccagaccagcctgggcaatgtagtgagagcctatctctacagaaaaaaagagagagagagagaaagcatgagaaagtcatttctgctagtgagagagacatggtataaacatttcaaaattat

SEQ ID NO: 178544 - DNA, 356 bp, Homo sapiens
cacccaaatgtattagcacgcactcctctttggagaacaccactcaagcacttgctttctgtactttactggggagaacaaaagctttcaaagaacatctttagtttataatctacacttacctatttcctgcccaaggacaaaaatacaaagggagaacaaacaaggtttattttccctttatcctcttgaaagaaccgatcgatacttttattagctcaatgggacattttaagtttaataatttgaccactaacacaatgattacttaaataaatccccattcttagtattcaggattctgatctcatttgaattatatcagtgtagtaaatgccaaactctaaacaacagta

SEQ ID NO: 178545 - DNA, 254 bp, Homo sapiens
gggggacccaactccatgctatcagaataaaggccatccttccccgtatttttctcaagttatacaagtgccgttattcttcaagcaacaaagaattccactagccttttgctaaggataaaacatttccaaaatataagttgtttaaactgcaggtatagaataatttcttcaactgtcttctttttcccaaatgaataatgctacctagatgaaaacaatttttttcttcaccttttattccaaatttcttt

SEQ ID NO: 178546 - DNA, 318 bp, Homo sapiens
gaaatgaacttattgatgtgaaaagatgtttatgatatcaagtgaagaaaaaccagttctaaggtaatatttaaggaattatcctattttttgaaaaaaaccaaaatacactagagaggagtgagtggaagtccatacactaatgtgttagggaggctgggcgcggtggcttacgcctgtaatcccaacactttgggaggccgaggtgggcgaatcacctgagatcaggagtttgagaccagcctggccaacagggtgaaactccgtctctactaaatatacaaaaattaactgggcgtggtggtgggcgcctgtaat

SEQ ID NO: 178547 - DNA, 449 bp, Homo sapiens
tcatgtggctacatctaactgtgttgggggctggagagagtggtccttgtttcaaggctgctgtgcgttggctaaaaatgcacagaaaattagagcaggttttgaggagagctgacagtttttgccacatctacaaaattttggatggggtgggggtgatctaggttgtttattctgtttctaagccactgtagcttctctcactgaattatgcctaccatttgaggagcaaaagggagttttcccatatatcattatgttaggtttgttatggttaacaggactttgttttattcagttaaattgcattgtgtagttgctaactagtgtggaaaatagcaataagcgagagattggtccgttctgctgtctaggaggggacattgactaaggaaaaaagataagtgtaggtgtagcatggtggcttatgcctgtaaacccagcatttt

SEQ ID NO: 178548 - DNA, 317 bp, Homo sapiens
ctcatgaaatctggtcatttaaaagtgtgtagcacacttttccagaatgtcatataaatggaatcatatagtgtataaccctttgagttggcttttttcactcaatatgcctttgaaattcaaccaggttgttgtatgtatcaatagttcttcctttttactgcttagtaatccactgaaagaatgcaccctaatttgtttatgtagaaagtacgacagaaatcagggagagggaggagcttggcatagcaaccctttaaagttgtttatgaactcctaggcccatgctgcaaattttgatatattttcatttttgt

SEQ ID NO: 178549 - DNA, 332 bp, Homo sapiens
aaggatggactgtgtggggagaagatgctcaacagatcaccttcagggactctgacctgctggcaaaggcaggcaagcagcaaggagctgggcttgcacggcattgtgggaataaaaagcctttccaggatggccttcctactagccgcaagggctgagctgcagagaggaagcagcggggccaggatttttttcttgaaagcactttggtgtgttttctagcttgtgaaacagcattcacctgggaccccacagttagaagggaattaccatttaagtgccacataattattcctgcatgcatgcactcactgtctcactcagtaatcttt

SEQ ID NO: 178550 - DNA, 439 bp, Homo sapiens
ggctgagtacgtcccatctctccaggagtttatctgtgtgtacggagctgttttccaagtgaggggcagtgtggcaggtagctgagggtcctggtctggggccagagctagggcaagacttggccctgccattaagagcaggcgtattgcactgtttctcaaactgtgcctctcagcccatcagtgctttgggttgtgaaatcagtacagtgggttgtgaaaccagtacagtgggttgaaccagcatttttaaaccaatgaaaaaatgtcagcatgcatcatacacgggaaagataagtgagggaactttcggtttgttgtctgtctgtgtgcctgtatatatatgtaattgccgggcccatggtgtcttacacctgttgtgggtttgaaaactgctggctttggccgggcgccgtgtctcaagcctgtaatcccagca

SEQ ID NO: 178551 - DNA, 673 bp, Homo sapiens
gggatgaactttgctatccacttgtaatattactaaaaatcatagtgctagaatgtatgctaagcattagtttatgaaattcctgaggttgggtgtggtggctcacgccttacagtcccaacactttgggaggcggaggcgggcagatcacctgaggtcaggagtttgagaccagccttattaacatggcgaaaccctgtctgtactaaaaatacgaaaaaaaaaaattagccgggtgtggtgatgctcgcctgtaatcccagctacttgggaggttgagacaggagaattgctcaaacccaggaggcggaggttgcagtgagccaagattgtgccactggactccagcctgggcaacagagcaagactctgtcaaagaaaaaaaaagaggctgggcgcagtggctcatgcctgtagtcccagcacttgtgggaggctgaggcgggcagatcacctgaagtcgggagtttgagaccagcgtgaccaacatggagaaaccccatctctactaaaaatacaaaaattagccaggcgtggtggcaaatgcctgtaatctcagctacatgggaggctgaggcaggagattcacttgaacccgggaggcagaggctgcagtgagccaagatcgtgccattgcactccatcttgggcaacaagagcaaaactccatctc

SEQ ID NO: 178552 - DNA, 367 bp, Homo sapiens
tctctgtattttcattccactaaatagctgtgcttattagatacttacatatgaatatggccaagtactaagggactttgaaaggtacttttaattagaagtaatatttgctttaccaactaattttagactaactatatatattttgtaagctataaccagtcaatgtgtgaatgctttatatattcaaacagcaggttatacccacttccttacctacacagaagctgttgctctttttgccagagagcaaccaaattttcctgagcagtggtagctacctgatggctactgcaaggaacttctcatctactttccttcctacttgctttcttcttctaatagtagtcatgcaccctcttaaatt

SEQ ID NO: 178553 - DNA, 320 bp, Homo sapiens
catatctgtctgcctgtctatgaatcatctatcaacctatcttactaaatatttcaattatttctccaggttgactaaggtacatactgtgtactaaagtacatacataacatgatgtatcatggaatataggtgcaagttaacaatttttttttcatattgcttagtttaagatctccatagaatattatcatggtcaatatgttgagcagtcctcatcaaattaaatgattagcaaattctctgagttgattctgtatacacataaacacacagacgcacacatacactcacttgagcatacacgtgcatgtgtgtca

SEQ ID NO: 178554 - DNA, 273 bp, Homo sapiens
cattgtagtcaagaagagaaaaattaatgctcctatttccacccatggcatcatgttaccactgctggctgagtgttgattcttttaaataggtagtggaagtcttccaaaggtttacagaagtaggtcatggtgccctctctttgtgcctgtgactcataagaaacaggtttaatcctcgatagttgtactcaagtagttattccctgacatttaagtggtggcagtatttaacaatacccagtagggacctttcagttaggttgtaactga

SEQ ID NO: 178555 - DNA, 623 bp, Homo sapiens
aatctgtgggagttgtaatttttaatagaaaaaatcaggagctcagtttttttgagatctagttgttcataggggtctggagtttagtaaagagaaaaactgtgctagagataaatatttgggagttgtcaccatatggatatttaaagcctgagattagatgcattcgccaagggcatgattgtcaataaaaagaaggctaaagaatgagccctggttgggcaatcaggagaaggaaataaagggtattcagttaggaaaagaggaagtcaaattgtccctgtttgcagatgacatgattgtatatctggaagaccccatcgtctcagcccaaaatctccttaagctgataagcaacttcagcaaagtctcaggatacaaaatcaatgtgcaaaaatcacaggcattcttatacaccagtaacagacaaacagccaaatcatgagtgaactcccattcacaattgcttcaaagggaataaaatacctaggaatccaacttacaagggacgtgaaggacctcttcaaggagaactacaaaccactactcaatgaaataaaagagcatacaaacaaatggaagaacattccatgctcatgggtaggaagaatcaatatcgtgaa

SEQ ID NO: 178556 - DNA, 812 bp, Homo sapiens
tgatctcctggcctcaggcaatccgcccgcctcagcctcccaaagtgctgggatcacaggcgtgagccaccgcacccagcctggattacatgatttctaaagtactttggaaacctgaaatttcattttaacagtttaatgactggaacattttttagtttattatttgctttggtgctgtctccagatcatttaaaccaatccctatttgagactgttgttggcatccagtgatgatttttagtgactgataacctttaagtaacagcagtaagaatgaaggcccagtaagaggtaataaaggagtgatgagggaatgaagaaagaaatccattagcaagcatacagaataatagtgtcatatagaaaatgaagatcctgcatacactgaattttgatactagatcaaaatgaggtccttttcactgcatttatgtcaatgctactccacttctgtagttgttttggtgtattgcttttatttacatggaggttaagtgttagaagcagttaagagacactgccacactgaatgagagttgagcgtgtccccctgggagattgagaattcagtggtctctttctcctcactccatgtggcttctttgttgccttcctccttctataaattacatagtcataatggggcaactttccactaatgattgccttactacttgagttgattcccagactccctcaccttccttattctggtcttcacatgtctttgctaactgtaaagtaaatggtttagacttagtctgtagcctgctcaataatgagagaaaagctgcctccctggaagtttt

SEQ ID NO: 178557 - DNA, 372 bp, Homo sapiens
aataaagcctacacaatatggggcacatattgtaactgaatctttttcatcacaaaatgctgacagtggagagagggaaggcagctggtagggaaaaacggatatagagcattcaattttgaaagaggggaacatgtagctgcaaaatcatgctgttattcatggtaacaagtaaaaatttcagccagcattttgcagagggtgttagagagaggaaaagtctctgtggaaatctgctgattaagatgcactttgtagaagtccatcatcagacactgaattgaattgaattggttgtgaatgacaaacagccttccaaagaggtaagaatggtatggcattaaagaggataaaaagaacttagacaacagc

SEQ ID NO: 178558 - DNA, 284 bp, Homo sapiens
atgctaagatcaaaaaacaaatccaaagtgaatcctgtcagtggcttcacaaaatagaggaaaggaaggaaaggttggaggaggcacagaggaggcacctttccaggtgtctgcccagtccgcacccttgcactgatacctgtacctcaacctattcacaaagagggctcagagagggccctggcagtcatgcttgtatcctatggccaggggcagattcttaggccccaccagatgctccccactagaaattgggaatctgcattgaggaacttaatttggtg

SEQ ID NO: 178559 - DNA, 160 bp, Homo sapiens
ctttaaagtgaacttatttattcattcaaccttattcggtgaaagggaccaggaaaatggagtggtaactagagagggagacagagtcaggggagttttgggatggtgacattaaagtgatgcacactcatggccaatctagagtgaggaatatacagga

SEQ ID NO: 178560 - DNA, 305 bp, Homo sapiens
tggctctgcattcaggttcttctcacatccctctctttttgagctttgaaaaaaaatctaggccttgattttttaaaatttttatctatctatctttctaatctattatctatctttctaatctattatctatctttcaatcatctatctctgtctacctaatatatcatctgtctatctatctatgtatctatctatctatcatctatctacatttgtgctacagcaagtcccagctatgatggaggcaaatatgggtatgtgtggtgggtggagtcaggtgtcacacattccttgatattccc

SEQ ID NO: 178561 - DNA, 340 bp, Homo sapiens
taaaaagaaagaagctgaacaatctaaggtattacccactttatgtgccaaatactggtcatctcaagcctcaagttaacttcagcatatctatggaataattctagataggtgagtctcattgacagtaaaaataaattacagagatgtaaacacatttaaagacaaggtaggagaacttgaaacaagatgtcagggacaatcatcatttctacacgctgtaagattgcaacaaaaagcaggtgtgcttacactgttcccactgcatcctgcatggcttgttgatctgtgtttatcagccagtctcctgcatcagactgtaagctcctgggctcctgca

SEQ ID NO: 178562 - DNA, 251 bp, Homo sapiens
ggagggaagctaagtcagctgctacacatccttcaggcatccatatggataggtaagcaaggatgactacatatgaagaaagctggggaaaaaagataaatacggaaaaaatgaaaccgatcccagagaagacagagatcataactcatggagctaaagcagaagagaattttagggggaaaaacatctgagtgtggtcaaagatattagaaaacacaaaatacatatataaaacaaaaacatccatatag

SEQ ID NO: 178563 - DNA, 267 bp, Homo sapiens
ttcgctgcgaccagtggggtatgtgaatatgataaggcgtagggtgatcgatcagggctgaaaggggaacctttctgtgacggctacttgctatttcaggaccattgacagtggcagagacagaggggtacccactgagtatctactatgcttcagccaccaccataggtatttgacacatattttaaatgtgctataatttcacaagaacacatcatctttatagatgaaaaaactgaggctcaaagaagctaagtcacttgtcca

SEQ ID NO: 178564 - DNA, 314 bp, Homo sapiens
cgtatcctcgatgccaagcgtacatgtttaataaatagttgcctaatgattaaactttactgaaaagcttattgaagatttagggcagtgacatggagttgtactatacagtcccaataatgtcacagattttccatgtgaaatttcctggttgttgttgaaattgttagttactctatttgccatgtttagtgttcttggccctcaggttttaaaagttctaatgtatcttaaaaacatgttaggaaaatttgacaatacatgaaacatttattatgctttgaataggtgcagtttattatgtgtaaattata

SEQ ID NO: 178565 - DNA, 326 bp, Homo sapiens
actttgtaagtgctcagtattttctgtatgtttacttgaaagaactaacacactatacatttgtgctaaccttgttagaccacaggcaatggtgggagcagacagttattgcaaatcaaaaaatttcatttagcacatatatatgaatgcccacagtgtgctttgatattatcctttgtacatagtagagaggaagtgcatctgagtagagactttggaactgaggatttaagaagccagcctttgcacaaagtctcattgagtaacagtgttttgggtagtaggtgtgcagaaaccatgagatgggaaacataacatcttgaaca

SEQ ID NO: 178566 - DNA, 595 bp, Homo sapiens
ccgagtagctgggattataggccagcgccaccatgcccggctaatttttgtatttttagtagagacagggtttcaccatgttggccaggctggtcctgacctcaagtgatccgcccaccttggcctcccaaagtgctgggattacaggtgtgagccatggcaaccagctgagtttttgattttgaaacttcctgtaagttgtacttatttttctttgggctttgtaatttggttatgatttttcattcttctttctgctaatcctctcacttccaccatgggagtgtttaaatacctgggaagctgttgaacctaggaaaccacattttacttgccagatgtgaggtttcatttctggttttgacagagatttgactcttcagcatttatttctcttttagcctatgagcttctcttagagaagatgaactgggagggtggaatgcagcaggattgcctggattccaatcccaactggacccttacttttcctgtgattttgggcaagtttctttctctttctttctttctctctctctttttctttctctctctctccttccttccttccttccttcctttctttctttctttt

SEQ ID NO: 178567 - DNA, 678 bp, Homo sapiens
ggaaatcagcaatacctcttactgaaaccatctttgaaaattataactgaggaaattatgacatgaaagaaatcagacctaactgactacatcttgcttctaatctttaagccgtccttgtttattcctgggtgtaggccgagctaactttgagaaggaattcagttcgtggtttgagtctgaaacaaaattgataatagcgctttcctgaaaggacccccttctgccaggggaccagtctgcctttgcaggactaacaaattagctacaagattagaaattacagtttagggtcatgcagactctggctccaagagtctgaacctccccatgttgctcctggggataccatcactatggtaaaacctaagatcagtacttgagatatttttcagaccctagactggatggatcagctgacaccccccagactcataatctggctcagccagttctgccatcccacccaggaacagaagatggcaagaaaaactcatttcaactccctgattcgctccagcctgaccatcagcactccccactgcccaagcgcttaccctccaaattatctctaaaaactctgatccccgatccaacgctcagggagactgatttgagtaataaaactccggtctcccacacagccagctctgggtgaattactctttctccattgca

SEQ ID NO: 178568 - DNA, 277 bp, Homo sapiens
aatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggatta

SEQ ID NO: 178569 - DNA, 199 bp, Homo sapiens
attaaccttcttggattggtgggtttataatttttatcaaactaaagatatttagtcattatttcttcagatattttatttgttctgcactgctccaaaaccatcctggacttttaactgcacatttattcatctacttgatattatcctactggttactgaagttatttttcaacttttttttctctgtgtgcttcat

SEQ ID NO: 178570 - DNA, 742 bp, Homo sapiens
tcttgtatatacatgcttctcaaaatatctatagttttgtcggtatttctttctcctactagattgtgatcttttatcggcaaagaccacctctcgtttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagcttgcatgttactaataaggaatcagaagctcatgtagagggggaactgaaagaatccaagtatatgtggctaaaattggccacgtcgacacctgaa

SEQ ID NO: 178571 - DNA, 655 bp, Homo sapiens
gggatcccctcgaatcgacggtttctcattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagcttgcatgttactaataaggaatcagaagctcatgtagagggggaactgaaagaatccaagtatatgtggctaaaattggccacgtcgacacctgaa

SEQ ID NO: 178572 - DNA, 325 bp, Homo sapiens
actaagaaaatacaagaaacaccagcacaaacaaaaaataactaaagaaaaaatatcacaaatggatgtaaaaggtacaaaaattatttaacaggaatcagtaaagaaggaacaaaggaacaataaaaggcatgagacagtaaaatgacagacataaatctacctacattaataattacattaagatgcaaattgaccaaatgctccaataaaaagacagaaattttcagactggatgaagaagcaagaagcaggatctagctgtgcacttttttcggggagtgggggacggagtctcactctgtgggccaggctggagtgcagt

SEQ ID NO: 178573 - DNA, 443 bp, Homo sapiens
tacctgctactattattattgttattgggcattggattagatgacctttgaaatcacattcatccttaagagtctacgttaccttgaagatgtatcttgttctcagaaaagtcctttcccacgattaccaagctatcttatacaaaatgattcatttttttattcatagactacaccagaactgctcaactgggctccactacacaccagtcatagcatgaaacgtttattaggtgttctcacaaacagcggtccatgaccaagtaagtctgagtaacaccgcgtaatgtatcttccctcttgaagggtcataggcaaataagcaccaaggctctgaataataattctgcagtaaagaaaggcatttcactttggccattttttgtcaaggatcctctttttatccccaaaggacactgattagcactacacagaactaatgt

SEQ ID NO: 178574 - DNA, 388 bp, Homo sapiens
ttaaaaatgaactcaaatgttcccattttttttcagatgggctaaaataggaataaacttgcagcttagctacttcccaacagttcctcagaaacctctggtctttgcctaggatttgcctaggatgtcccttggattcctcagtggcctttcagtcgtcattccaacctttgctatctctcaatccacaaagggtgacctgggaaaggacattaaaaattcacacccatctacttccagcagatctggtgtcttgaacctgaattagtcatctccaggttaactgatttcaggtctgaaaagtcctggactatggaagagaacagaatccacttaactcaacatctgccctttccaaaggtggctacacggcctatcctgatgcctt

SEQ ID NO: 178575 - DNA, 120 bp, Homo sapiens
gattatcttcctaattccctgttcctctgtctatggagtttgtctttatcattactggcattttatgattgaagaggcagaacaaaacaccctgtagtcaggatggatgaacttgctagt

SEQ ID NO: 178576 - DNA, 465 bp, Homo sapiens
agttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgactaagagtggaatagagtcagaagtctactacataccccatttaagactttacagcttacatatgtaccatcctcaagaaaatatcaagccaaaattgctgttatatttactgttttctactctaagcatttaaaaacacaaagtttaataaaaaat

SEQ ID NO: 178577 - DNA, 490 bp, Homo sapiens
atcaagaggatccccgtgatattaaacaaagtaacgttattgattattaaatggcaggctagaccagagttggtagatcaggttgtcagaacaagaaatgatttgtggtttttgagagtttctggaggtgactgtcatgtgctgtattatctggggctaatatttcaaggtctttcagggcagctggctgtactgtaccgatttagtgtttattcagcaaagagatacgaaagtatgaatttctcacagctcttcttttgattttctgtttttaacagttaaggggagtttggtttggctgaagcacgtgggacacttcttttttttgagtgtatgaaaatacttttacttcctctcgagttttctaaatttgctttttactgtttcatttcctccatctttttgcttagtttccttgtttaattttttcgattccctaccgtattattgtggtgagaattaactcttattttcagggttaatcgctgcc

SEQ ID NO: 178578 - DNA, 942 bp, Homo sapiens
cattgtccctgccccgggagcatcgccctcggggagtagacccggtccttctcctcccttcccgggggccgagccagctgggatcgctgccctgggctcaacaacggtgacttctgtccctaacgctgtgccgagcgctgtgctgtggggggcggcagtcccaggctttcccggtgctcccgctgtttgcgagtccttctcctgtaagtgcatggcggcaagaaatggctagagggacatgaaagccagccggatttgctcagtgagttcagaacgccctttgagggaattcggaggtggtgctgtctcaaaaccagggctcctaggaactggactgctgctgccagttcttgacatttagaaattaggaattggcggaaaaggattatggagacgccttgcgccaatttaaaaagtctcaccttaggtttggaaacaaatgcttctttatcttcctttgctacggttgaagtgcttaacaagtaacgttattgattattaaatggcaggctagaccagagttggtagatcaggttgtcagaacaagaaatgatttgtggtttttgagagtttctggaggtgactgtcatgtgctgtattatctggggctaatatttcaaggtctttcagggcagctggctgtactgtaccgatttagtgtttattcagcaaagagatacgaaagtatgaatttctcacagctcttcttttgattttctgtttttaacagttaaggggagtttggtttggctgaagcacgtgggacacttcttttttttgagtgtatgaaaatacttttacttcctctcgagttttctaaatttgctttttactgtttcatttcctccatctttttgcttagtttccttgtttaattttttcgattccctaccgtattattgtggtgagaattaactcttattttcagggttaatcgctgcc

SEQ ID NO: 178579 - DNA, 676 bp, Homo sapiens
ccagctgtgtggccttgggcaagttatttaacctctctgatcctccacattctcatctataaaatgcagacaataatagaatcctccctcagggggctgttattaatatgtatgtcaaagaataacccaaagacgtttcactaattattagctctctgtttatttctgtacaaggaacatgtatctatagactgatttcaacaagagttatataagagagaggggaaagaaaaactgcagacaggcaggcacaggaaatcttgtttgcacatttttgggtaaactgatttgctggtgtcttgctttggccaactctgtatataaagatgagtgtttcagctttcagattccacgggcaaccttgacagcattgctgtggtgccatgtgcgggagtgcctgtcatgtctgctggcacctaccaccgggcacctccccacccctagcttggttagatcaggtctgctccattccctcattggaaccctctgcagggttcactgagataaagtgtccattgcttacagcagctgctcgcacacagtaagcgcttaataattattcgctcttagtgttccctccatttgttcaaccagaacttgttgagcagttcctctgccccaggcacagaggtgccgaggtgaggcaaacacagtccctggcctccaggaactctca

SEQ ID NO: 178580 - DNA, 269 bp, Homo sapiens
cagagccctgcactcagaagatacccaggaagtgtttgaaaagatgaatgaaaaaatagatcaaacagatgaaagtcagttgaactctgaaagttttgacagaaagacttattgagtgtgtgtgtgtcgagtctcaccttctgcttatgacaagggcaatgtaagaggtctgagacgtgttcacaagaaatcagcagccctttggagatgacagggcggtgcttgggagtaaagggaatgaaaaaaggatttgggattttggtgaggcc

SEQ ID NO: 178581 - DNA, 182 bp, Homo sapiens
cttacagggttaagattgtatttacagcagttgaacttgaagtttgggagataaattggtgctttggacctgagaagtgagggttctggaaactgatggaatgagactgagtgagggctaggattttagggcacaggtgggagagtctgtggagtgaaggatactggagcacaagggctcag

SEQ ID NO: 178582 - DNA, 596 bp, Homo sapiens
tatttaggatcccagaataccacacatctacttttatacatgcttaccttctctgattagaaaaaccttactttgtctacccccatctctacttctttagtcttcaggactcagtgcctatacctaccacccaccctaactcccaataatgctgagttatatcatctcatagattctagtcacaattaccacagtacttaccaaaatgtactataaacacctgcttgctatgtatttatcccacagactgtaagcttcttaagcataaagattgtttccttactcctattttttgtccctagtatacgcaaaaaatgtctgccatggagtaagtgtttaatcaatgtttgaaaaaaatgaatgaaaggatgaagcaggttgtacattgagagacccatggagaagctgttcaatttttactatctataacaaagacaaacatcaaaattaataatctgataaaactgaaataccaaaattaatctttactttgtaatcagtaaaaataagtaaatcgatatactaatgtaattcttaatttttgtagttcattcttcaaaatattttattcaagcaagtgggatccagcaaaaaaa

SEQ ID NO: 178583 - DNA, 365 bp, Homo sapiens
aaataattgtgcacaatatatttaacaatacagcatagactcaaaagtgtcataaaacaaaatagtactttcccttcaaaatcatttaggaattatgctttctaaaaaatgtacgggaaagtagaactgctgaaatatgttgacaaaattaactttgaagaagcgcaagaaaaggaaataaagatgtaattataaccacagatcctagagatctcaaaaaaaagtgaacacattatccatgctcccatttgcagaaaatatgtattagagagaattgttcagagactttcggacatacacagcgtcttcaaaccgtatcaaaggaaaccccaaggtgcaataacagggccttaagatccaatggg

SEQ ID NO: 178584 - DNA, 162 bp, Homo sapiens
atcagccggtactgaaaatgactagaggcagggaggcaatagtgaggaacccatgatggagagaggtaggagggggtcttgccagagcaggagctgcaaggtcagaagtacttggaactaagtgctactcacccatgtgcaaataggaaagggtgcccctgc

SEQ ID NO: 178585 - DNA, 795 bp, Homo sapiens
taccaggagtctacacagacaaaggtcttcttcaggaaggttacattctaggggggaaggaaggacagtaagttggcaaaaaaacaaaaacaaaaacatgtaactcaagatagtgataaatcctaagaagataaagcaagacagtggtacatatggattaggcgatgctgggtatttcagggtaggcccctaagatctaagacggtcacaaatgctttgttactctccccacggaaagatggagtgtatttccccctctcctgaatctgggctggccctgtgactactgaaccaaaatcctttggttgaagtggggctatgatggttctaggcctagccttcaagagggtcgcctgcttctacttcactttggaacatgtgatggttaagtgtcaacttgactggactaaggaaaacctagagaactgcaaagcattccttctgatgtgtctgaaggggtttccagggaagactggtttgtgagtcagttgactgagtgtggaagatccaccctctgtaggggccagcaccattcagtcagctggggaccctaatacaacaaaaaaagagaaaaggaatttcttttctctcctggagcagggacacccttcttctcctgtcactggacatcagaactccaggctctccaggctttggaatcccagacttaaaccagcagcccctaggttctcaggccttcagcctcagactgaaaattacaccataggcttccctggttttaaggctttcacacctggactgagccaggctactggccttccaggatctccagcc

SEQ ID NO: 178586 - DNA, 677 bp, Homo sapiens
taatttatttttttgtagagatggggtctcccatgttgcccaagctggtcttgaactgggctcaagagatcctcccacctcagcctcccaaaatgctgggattataggtgtaagcccacaagcccagctgatgaacatcttttaatatgaatttcttctttggaaatgtgaccatctttctgctgggttatctttctcttactgatttataacatggatacaaagcctttggcttttttgagacagggtcttgctctgtcacccaggctggagtgcagtggcatgatcatggctcatgcagctttgacctcctaagatcaagcaatgaagcctttgtaattgcaaatattatttcgtctcctgactaaattttatgtttttttgtcatggcaaattattattttttaatagacaaatctatcttctcctttaaatcttcttcgttttgtgacccatgaaggcaggccctaaccatctcaagatttatacatctttatattcaagacttttacaaatttttgttttctagctgcagacaaaagccacctgcaacattttttgttatgctttgaagtaggggtctaactttcctttcaaaaacaccctttactaatcagtcttttatttattgatccaggagaatttggtctacaataaaggtggcatattgattaata

SEQ ID NO: 178587 - DNA, 235 bp, Homo sapiens
tcagatatggcactgctgaccaccgccccacgatgcgacatcaggggtcagatattaggctggcgctgtgcagataaacaagtgtatatgttggtgcgccaggaagacaaaacacgcgcctggagaggccaggagagcgggactggagggttgtgggacgcgcgggaccctcgggccgccttccgccgccgcccggtgtcaccagaacccagcctgtttaccagcggccccgccc

SEQ ID NO: 178588 - DNA, 166 bp, Homo sapiens
ttgagctggttcatgattgacagaataggcatgatcatggtggtggggatttgactgagtggggggttgtgccactcacagaagaaagaacaatttaggaagaaaaatgatgaattaagttttggatgagatgagtttgtttatcagccatgaagtttagggcaca

SEQ ID NO: 178589 - DNA, 308 bp, Homo sapiens
cctcaggcccccaggtggagtgctcgggtggtggcagcagtggtagttataagcaggcaaagcctgtcttcagggtgtgtgcaagtgctctgcagccctgcagggggtggacagagttgctgtcagtagcagcaggtgcaggtaggtggctctcaggctctggggagcataagcttcggttcctaatggtgacagctgtggcagtagccacagcagcagtgggaagagccagtcctcagggtacatgcaattgcactacagctctgccgctagttgggatggtggttgctgtcagtggcaatagcttt

SEQ ID NO: 178590 - DNA, 380 bp, Homo sapiens
ccagagcacaccgcacctccgcttaaagccctccactctgcacactgtaattggaatacatcagtcttcagctgtggtcctgctgcacacgcctcttccctcactacctctggagcactccacctttattcatacccctgggcctttgcacaagctgtccctttgacctggactgtgctcaccccatatcttgtgtggctggctttgccacacaagacatcgacccagatgtcatctcagagaggtttctccaggcaccggccagcatggcacctcgtccctgcagtccctctctggcgacccttttgttggactttctccacagcatggagatagaccatggtatgtgtgtgtggttcatctccccaggagctaagcag

SEQ ID NO: 178591 - DNA, 542 bp, Homo sapiens
atacttaggaatgaatttaaccaataagacggaagatgtgtacacttgaaaaccataaaacattgatgaaagaaatttagatatgaacaaatgaaaagatatcctatgtttatggatcagaagaattaatattgttaaaatgttcacactacccaaagcaaatatatagatttaacacaatcctcatcaaagttctggtggcattcttcacagaacagaaaaaaacaatcctggccaggtgttgtggttcatgcctgtaatcccagcactttgggaggccgaggcaggtggatcacgaggtcaggacttggagaccagcctggccaatatagtgaaaccctgtctctactaaaactacaaaaattagccggatatagcggcatgtgcctgtagtcccagctactcgggaggctgaggcaggagaattgcttgaatccgggaagcagaggttgcagtgagccaaggttgtgccactgcactccaacttgggcaacagagtgagacttcatctcaagaaaaaaacaaacaaacaaaaaaaaaaa

SEQ ID NO: 178592 - DNA, 456 bp, Homo sapiens
tgctttctgagttctcagagatagacaccctctagtcctttgctcatcccatccctgtggctgccttgggtacaacctacaccacctaaaagtattaaccttaaaaggagaaaaacagttagtattaggaataggaggatttgcttttccaggtgcaaattataggtacagcatcttactcttattaactgaaatgaaaggcactgcggatgaacagaactgttttaccagtgagtaaaaggactccctttcatagagtgtttaaagtgtccgaataaggtaaagcttcactaccatttcttaaccaactgtctcagatttttcccattcactccattgtgcttcttatacattactttctatgaagtacacttttatcctctggtttctttcattctaagcttaagttgctactacagagaacaatctaggaaaatctccctcttggaaaatgtc

SEQ ID NO: 178593 - DNA, 535 bp, Homo sapiens
gtgtttgtgtgtgtgagtgatgctgagctagtcttagagtaaatgcagacactggatggtagcgagttcagtgcagtttttatggagggacagcttgctgcctgctgatgaagccggacaagactgggtagtgaagtcaaaggcccacacctaactctgaggctcttgggggcaactgtgttgtgcagagaaggtaggagggcagaggaagaggaggagcggcccctgggagaatgccttctacccagctgcagcttctcaagggtgtgtttgcgtctgacctaaggtgttggagctctttgtttctggctgtgttcaggctttcccccgcttgcctttaggggaagctgatgactgctttagcgtaaagagagggccaggaggtcaacttccctacagtcccgtgcctgcttctgggttggggctggggagagtgctgcccactgaactctctaaatgttaaaagatacaaagaggaagcacagagtgaaaagggagaccccagaggacagcagaacatcccgaagcatatccc

SEQ ID NO: 178594 - DNA, 361 bp, Homo sapiens
ccaagtggggtagctgacattcagtcccagtattaagcagctgtgcccacccagacaggcaacaccgtaaggcttagatgggggttctgcccagaatagttttaacatggaggaacacaggaaaactcaggctttctgctggcagcttgctcccaggacaaagaagggtggagttgagcagagcctatagagttattcttcccaaatttacccacaaaatcaaccactcccctctcacaggagtagagtgaggaaaggggtagagaggtctggagtttcactcactgtgctccctgcatataaaggagacatcagaagtgtggaagaagtgtcccccactaacagtttatgacctccaaat

SEQ ID NO: 178595 - DNA, 196 bp, Homo sapiens
gcgggggagattctgagcccctcttccttggacacaagtcacctcaaacaatgtgtgaagtgctctggcccaccacatacttcttctctggcctcaccatggccttcaggggcactgtgcaccaagtcccacatggctgctgctgaattcagaaccctcgtcccatctagcatcctctaccctgcgaacctcctca

SEQ ID NO: 178596 - DNA, 499 bp, Homo sapiens
acacgttgacacttcaggtcaaagaggtcacttcagaatgtaagtctatgcacggtgtcaaaaaatgacaaaaaatgtcgcctgaacttaacaacattttacaggatgtgattaaaattatcaaccacattaaagtacatgcccttagctcattctatttgcacagatctgtgaggaaatggacgcagagcatacatgtcttctcttacacacagaagtgagatgactttctaaaggtagatcactgtgccagagtttttgagatatgaaagcagctccagtgatttcttttagaaaaacagtcagtcactactggcagcacatttcagtgacgcagaatgggtcacaaactgcttacttgtgtgacatattcaacctgctcaatctgtcacttcaagggagaacaacaactgtgttcaaatcaccagataaagtggctgcattcgaagccaaactggaataatgagggcgatgagtcaacactgggatttagcagaga

SEQ ID NO: 178597 - DNA, 471 bp, Homo sapiens
atgtgacacttcagcatttaaacttcatgctgtcgaaataccaacgtgagaggtcagaggaaaagaagataaagagtgcaggcactcaggcagttgacatgggtaaaactaaatatttgggcctcactagaatctttctattggtttactatctcttcagagaatagtgtaaatgaggaagatatgcctgagtcctggggtctattttaacctaccacttatagcttgctttattgacatttcagatcacccaagccagtgaacacattcatgatgatcctgaagctgatcgtgggggaaaatgttttataaaactaggggcatcctttgggtggatgaaaccgatgaaatcaggatgaaacaagcagattaataagggttgagcataggccataagaaatattaaaaaacatataaaactgtcatcaatgataaaatattctccgctactaacaagttactgaaatatat

SEQ ID NO: 178598 - DNA, 232 bp, Homo sapiens
aaaagaatcaatgatatgaatggctattatataaagagtgctttcaatataccaggcaccattctaaataatttctgtaagttaatccatccacccttctcaatgagacagtgtttttttattatcactattttgcagatgagaaaaccaaagcccaaagaagtcaaaaaaatttaccaaaagccatgccacaagtcagtagcagagccaggatgtgaactcagacagtttg

SEQ ID NO: 178599 - DNA, 178 bp, Homo sapiens
agaagccagaggccaaatctattctgtgatatccctcagtgggccctcaaatatctcaaaaatagtaagccctccgtgtttggtgaatggaattccagaaaaattttaggtagaaatcgcaaacttgtggttctactccttttccaaggtaggtgcccactactgcacctttgtaaag

SEQ ID NO: 178600 - DNA, 192 bp, Homo sapiens
tgtttgtttttagatatagcatcttgctttgttgctcaagctgggcttgaaactcttggcctcaagtgatcctcctgctgtggcctcccaaagtgctaggattacaggcatgagtcacagcacccagcctcattttgctgtttcttaagtgtatagtatgtttctctaaaacctatggtttttctttctttt

SEQ ID NO: 178601 - DNA, 294 bp, Homo sapiens
ctacatcatcgagtgaaatattcccaccagagtgtttatatttaaaagtcattgcactgaatggaattgacatctgtttacattacattgccattactcatttccatgtacaatgtttgccttcatgctgcagtatcattttaggacatgttacaaggaaggattagaggagcagtacaatttgcaaggggattttctttttctttgtgcttgttcttattttttaatttttacttttattaaagtaatacatgcacataatttcaaaatcaaagagtagtaaaaggcttataa

SEQ ID NO: 178602 - DNA, 387 bp, Homo sapiens
agaatcgcttgaacccaggaggcggaagttgcagtgagctgaggtcacgccactgcactccagcctgggtgacagggtgagactctgtctcaaaacaaaacaaaactctagagagatcccttgccctttgtctcttgaggacacagcaagaagtctgtgagctagaaagcagccctcaccagatactgaatatgccttgctcttggacttcccatcctacagaatggtaagcaatcaatttctgtcatttataagctatctcatttatggtattttgttatagcaacccgaatggactaagacattccctttcattcactcagagaaaagctggtcctgtgaggctctacatgatctgcccaatccactccactttctccttacctt

SEQ ID NO: 178603 - DNA, 698 bp, Homo sapiens
tatattaagtataggtattaatgataagttcgtctagtttggaaaacttttaaatgggcagagatgaacataatcagatggcaaggatgtggtagtagctgtttgaataacaataatgatgaggatagctaacattgataagcattatttcatgtcaccctctccgtgacagacagagcctgagaggagtcgccattgcccccacacagccagcctttcagcagccttcttggcagcagctatgtcagaccaacagtaccttcctaattttagcctcacaaaattcatttatgtttcatatataccttattcacatagcatgaaggtaatttcatacgatgttttttgttttgttttgtgacagggtttctttccatcacccgggctggagtgcagtatttcatacttcctgtatttgtggcaggaagctttatgctttatcatcagagtgatctttgaagggaaggacttactcagcatttaaataacacaagctagattacagagcaaccctttaaaccatttaagaaaaaaatgatttcctttttaaaaaatggtaattgctgtatgattgtcaaatttttcctcttgaaagtattttttaagtaaaaatgagcctgcatactacacccatgtatgaccatcatataacaagacagggtaaatgcaggtcacgcatccctaatctgaaatccaaa

SEQ ID NO: 178604 - DNA, 281 bp, Homo sapiens
tccatgccatggggctcacactgccctagggatactgtcagggatgttgaactccatgagactgtctgttcacctgactcccaggcagacagtaaggcgatcaggcttttccttaagttgagctgaaagctgaaatctgcctccttgaaacctacctccagctgttttaattttgccagcagagtatgtccagctcttcaccagtaacagcaagcacaaatgactaatttaagaaaagcagtacagcagctggacgtgttccatcttctttgatgctcacc

SEQ ID NO: 178605 - DNA, 552 bp, Homo sapiens
aaaaagtggaaagaatccagctgaccattgagtgggaatggatccacaagatgtggtccctccatgcaagatgatgagaatcagaacaaggctcaacagggctctgctaaacgccaccctggggatggacctcaaagctgtcatgcttcagcctcagggtccaccaagactggatcaaggaaacgtggtgcatatgtgcaacggaatactactcagccataaaaaaggagagcatgtcttttgcagcaacagggatggaactggagaccattatcttacatgaaaggacttggaaactgaaactcaaatcctgaatgttctcacttataagtggaagctaaataatgtgtgtgcaggaatgcagagcgtggaatgatggacacaggagactcagaagggtggtggggggtgagaaattacttaatagatacaaagtacatcattcaggtgacggtcacacgaaaagcccacactttacctctatgcaacattcccatgtaataaaactgcatttgtacccactgaatttatacccaaaaaagctgattatgc

SEQ ID NO: 178606 - DNA, 370 bp, Homo sapiens
cacccaaggatgccattaaagaggatgaacgagtgcagaatgagaaaagatatttgcagcacctatgacctggtgttaccaagaacccccacgaatcggcgagaaagaagataactctgtagaaaagagggaaaacacttgaacagtcactccacaaaagatgaaatccaatggtaagtgaacatatgagactggctcagcctcattcatagaaaagaaaaggagaccatggtgacctcccaccatgtagctgctccatttgcagaagcgtcggccggggtgtggccctgggcagcatccacacacagcacatcccacggctcagaaatcccactcctgggtgtggacttgacacaaatgtggacttgtg

SEQ ID NO: 178607 - DNA, 1351 bp, Homo sapiens
atccaaatgcattagtcttagatgaacacacctggaatctcacttttatgagaatttcatagactatactcttgaattccagttgtacatttttgcttgcaaacacaggcatttcagagtataatgagaggaggctggtgctcataaagaagactgactttacagtaaaccacctcccaggagaactgaagatggggcttgagctgaggtggggtctcttctccactatcccgagcagcacctgggccccaggtcttcacctagacagtcaaggacctcagcctaaacagcatccagctcttagaagtcctgtgaaattgggccaggcactgtgggtcacgcctgtaatcccagcatttagaaggaggctgcggcaggtggatcacttgaggccaggagttcgagaccagcctggccaacatggcgaaaccccgtctctactaaaaatacaaaaattagctgggtgtgatggtgcatgcccgtaatcccagctattgaggagactgaggcaggagaattgcttgaacccgggaggtggaggtagcagtgagccaagatggcgccactgcactccagcctgggcgacagagcgagaccccatctcaaaaaaagaaaagaaaaaagaaaagaaaaaaaaagatttcttgtaaaattgaaaacaaaattcagactttggctacttgaatcttgtttaatgtaataggaaagctgataatttaaaggtaacaagttgtggaatgtcttctttaagattagcatgcagtctcattgtacctgttacctgttctttttttttttatattgaatgtgttcaaagctcatcccacctgtatgcagagtgtgttagaaactgtgctggatgtggttgttctctttctagaaggtagggctcccatgacagccatataggttctcttggttgcataagtaaacataaataaaccagtaaacaaaatgcctgctttctgtgtgaatacgttgtcatttgatgtcatggtgttaagtatgaaggtgctataaagaaaaggggaggccaggtgcggtggctcacccctgtaatcccagcactttgggaggccaaggtgggtggatcacgaggtcaggagatcgagaccatcctggctaatacggtgaaaccccttctctactaaaaatagaaagaaaaaaaatttagccaggcgcagtggtgggcgcctgtagtcccagctactcgggaggctgaggcaggagaatggcgtgaacccgggaggcggagcttgcagtgagccgcgatagcgccactgcagtccggcctgggccaaagagtgagactctgtctcaaaaaaaaaaaaaaaaaaaagaaaaggggaga

SEQ ID NO: 178608 - DNA, 1129 bp, Homo sapiens
catcattgaggtaggagttgaggccatgggaacaggtgccatcaccaagggggacatcgtagaggaaaaaagagagaagataaagaatgggcaacaggtgaactcgtgagattataaattgtaagggcaagaactctatggttttttatttacactctatttctagtacccctagcacagggcctgattcatagaatgtgcttaataaatacctgtggaacaaatgaatcaacccagtaagaaactgcatgtgtagatgccttcttgctgcactcaaccaagtcctacaagcaagagatttattcagaactggttggaatgcaaacataaatagaaaaaagaaaataaaggtttgttaacagaagttctgtctcctttgcctgtgggtggccatctaaattgactgagagtcctataatttggaatattgcacggctgaaaaagctaagagcttttgtactccaaataacaacagcttcagtggtagcaagattggtgtctcctgggcttgtctggcaccttctgttaagagttctctctagcctacagagatgagtcaattggtgcaggtcacattatgagtcatgtctgaattgcctcaaggcagtggctgttaagctaagggatagggagaagggcagagcacacagacagcaggtaagagaccaaaatcttgagttgaaagactatatggagacaagatctgtggttaggttataaagacataaacttaaccagaagaaattaggcctcgtgcccactgaatttttaaaggaactgtattgctgaagaaaccacaagcctggttgcaacagcctgagcacattctagcctgtgagaaaatccatggctccctgataggcaatgaacctggaaatagccaagggccacaatatataaggaagattttcccagagtgcaaaataaaggttttacaacatggaatagggagtcctctctatacctgttcggcagcatgtagataagtggtgtgagccagtggctgttgtgtgttttgcttctcccctttcaacatgagagttttcattgcagttttcccgctcctttttatatcactatataatgagtatgttgggggcagtatcttgcctttaagctttaagagaga

SEQ ID NO: 178609 - DNA, 477 bp, Homo sapiens
tgcagccaggcagtcagtcctttcttgaagggggaccctcaggtccccacatctccacatctaccacatcaaccacctgaatctgccattccaacattagtaggctttaaattgtaaccgtgacaggctgtagaaagaaatcttttcctttttcacctggagtgatggcctttcaataaatgaaaaagtgattgttttcagaaacaatgaaaatgtaaaggaagctctaagagtggattctgtgcaatcatgagaatggctcacgaatttgaaactgcaaaatccacagaagtaagttaatactgcaaagctccacttatggaactcgagccactgtttttgaaagataaaacaaagccttacatgtgtagagcacttcagttttcaaagtgctttctcatgtcatttgagttccataataagcctgtgaacggggcagggcaggttttataagcatttcacagatgaggaagtcag

SEQ ID NO: 178610 - DNA, 512 bp, Homo sapiens
tgtgaacccgggaggcggagctgcagtgagcagagattgtgccactgcactctggcctgggtgacacaacgagactctgagatcgtgccagaacaccacacctaggtatatcattttgaaatgacagaaaaacaaatataaagaaaaaagtcctgaaagaagccaaaggggaataccttaccaattgatatggtttggatctgtgtccccacccaaatctcatgttcagttgtaatcaccagtgttggaggtagggcttggtgggaggtgattggatcatgggggtggatttttcatgaatggtttagtaccatcctcttgctactctcttcaccatagtgaattctcacaagatctagctgtttaaaagtatgtggcacttccctccttgctctcttgtgcctccctttatcacgtgaactgcctgctcctactttgccttccccatgagtaaaagctcccctgagacctccccagaagcagatgcagccctgcttcccttgcagcctgca

SEQ ID NO: 178611 - DNA, 645 bp, Homo sapiens
gttggtttactttggtttcttttaagattgtgtgaatcttttgccttgtactaaagattttgtggaggccgggtgctggggctcacatccagtaatcccaacactttgggccaccaaggcaagaggatcacttgaagccaggagtttgagactagcctgtgcaacgtaacaaaaccctgtctctaaaaaaatttctgtggagaagaacaactgagttgttaaccagttttgtgagctcttgtgtttacagggcttataatggaaaaaaaataatgaaaaatgaaataaataaaaattatagcaattggtctgtttcataccaccttaggaaggtgtttttaagaaacaggatatatagccaggtgctttggcacatgcctgtaatcccagctacttgggaagctgaggtgggaggatcacttgagcctgggagttcaaggctcaagatttcaccactgtacttcagcctgggcaacagtgcaagactctgtctccaaaaaaaaaaaatatatatatatgtatatgtatgtgtatgtataatatatatgtaaacattttggctgaaaatgcaatgaataacataaaatttaccatcttaaatcatttttaaatgtatagttagttaagtagattcacattgctgtg

SEQ ID NO: 178612 - DNA, 126 bp, Homo sapiens
ggatgggtgggtggatgaatggatggatgggtggaggggggtatgagtgggtggatgaatggacagatgaatggacaaatggatgggtgggttggtgggtggacaggtggatgagtggatggatgg

SEQ ID NO: 178613 - DNA, 394 bp, Homo sapiens
cccttttctataatctttctgttacaaccattgctatcgggtctttagtacctgacacttgaaacttttgcttaacatctgccttaacatggattgctgcctccattcttcctgatatcacactctgaggttaatcttcataaaatacaaataacaaagatcccaactggtttgatataatgactctggtaatttagcagccttactgaacctgctaccagaatactacttctcatggcttcacattggctaccaacacttgaccccgaggaatacaactttaagcatctgttgaagaaagtaagacaaatagggctgggacgacaagcttattatctaaacccgcatagggtggcattcaaagactttccaaacttacccttctagacttttc

SEQ ID NO: 178614 - DNA, 667 bp, Homo sapiens
cctaggacagtagctgtgtacctggcctaggttcctcagtccagatggtagcaagtctgaagacagggagagacttcttccagaagatgaaattcatagaaacctgaggcaaattggtatactcaaaggagctttgtcagactggagagtctggggtgaattgggataaatatatagtagataagtatgtagaaaactaaagaaatgagaaacaaattattaattgcaagggaaacaaaatgttatgcaggaaaagaaaagtaattattgtttactgcttggttcagctctgaataccctatgtagttataatgacataagcctcaaatattgatctaaccaaagttaggattgtgttgagacatcgggggtgggaagtgtggaggatgccaggaccaggaaacagctatatctcaaatttcctcaactggcagtcactgaataaagaaagcttttgggaaaaggaaatattggagagggagctgggactagtttttcataacaagccttgtagatctagttaatttaaaaaaatgtgcatgggtaacatttatttttacctttatcagatatttttctagatcaaaatttttacaattgttttagcttctcattgaaatgttgtcttactaggttaaagtttcacgtgtgtaattggatttgaaaa

SEQ ID NO: 178615 - DNA, 217 bp, Homo sapiens
caaatgaatacataccgtttctactacatgaaatttcttctcaggcaattcagcatttccagatcgcctcatccttgattttcctctgaacttcgagtctgtgaatgactgtcctcttcccatttgctccctgccagatctctgcagcacctagccatgcctgtggcacacttctgtccttcacgctgtcttctctggtctttcttgggtggtacag

SEQ ID NO: 178616 - DNA, 240 bp, Homo sapiens
gatcaggttttgctgctgtttctccaacactaacaagagtgcctggcacacggcagatgctcaataaatattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgc

SEQ ID NO: 178617 - DNA, 302 bp, Homo sapiens
  misc_feature (26)..(26): n is a, c, g, or t
  misc_feature (28)..(28): n is a, c, g, or t
atcccctgaaaattgatatatatttntnatatgaattgtctctatgccctctccattacaaaaatagaaaagcaaaaggcaactaataatgaaattcaggagaaaaaaactaagaatggaaatgatgtatagttgcaagtagggaaggacaaaataaaccttagtaatttattgttacattttgtaatataactttccttgtctataaatcagggcccttgtctcagtgaagttttgaagcttaaaacatgtaaatagttaagcaaaatgtgtgatacatataaagtgctcaataaatggga

SEQ ID NO: 178618 - DNA, 395 bp, Homo sapiens
tgtcagagcttgcttaagtaacaaagaattgctacaaaacaagtaaaacaggcacaaaaaaatttaagaatctgtaatgatcactcattaatttcaagatcccacacagttaatttcaatccaacacttgtctctatttaaggtatatgagaaataaaaatccaaagcattagcctgatgatcagccagttaaaaatacacatttgaatacgccgaagatatttataaagccaacagagatactattaatacgttgaaattcgctggccagtgctggattctaccctaaatcttctactactattcaagagaagccaagtagtcaaggcttctcgtatcacttgcttttaagaatttaagaagtcactcaaattggcatacacaacccaacctca

SEQ ID NO: 178619 - DNA, 306 bp, Homo sapiens
gtttaattctagatctggtgctttagatctgtccttgagtagaggtggtttgaagctgttttataaaaggtggagatggttgaaaacagagttactaggataattgctgtcaactggacatttgcttcccacgggtttcacgctgccgtgggtctctgcctgagttatctcattgactcaggcagccttgggaggtgtctgtcattgtcccacatatgacagatttgaacatctaggcaagtagagagaagtcacttaattgcccaagttcacaaagctagcgattgccagcactcacttggaaat

SEQ ID NO: 178620 - DNA, 371 bp, Homo sapiens
gccctcacagaggagaagaatctgcagtgtgcagattcttagagtggggactggcccctcataagtgcttagtagacttggggctcagttacctctcagaccttcactgtcttccatctctcctcaagaaagactcacagaaggagtgactccgtgactgtgtgcctcggagtgcctcactctgaaacccagagctggatgcagaaagtggtccccattctacagctggaacagctgaggctcagagcatgaagcaccctcatctgatgttccatagctagaaggaagccggctgggatgcggcccctgctaggatgcggccctggctgggatgcggccctggctggctgatctctggagtttgtgctctt

SEQ ID NO: 178621 - DNA, 125 bp, Homo sapiens
ggttatcaggtgctattaagaggcccattaccataatttattttttacatgagtgtgactttacccatgtggttttctcctaagtgctacacacctgctattttgtttcgttttctaaaagatta

SEQ ID NO: 178622 - DNA, 1711 bp, Homo sapiens
aatgtgaatggtagagatggaaagagcaggcaaagataagaacctggtggagaatgtagaagtagaattgagagagagctagaaggagcaatgttaggattgacattgtcactccggtttctctgagaccacgtttgacattgttgtattcacataataaccatctgtttacctaagctactttgagtgaattctattcctgtaaccaaaaaaagtcttcatgagaacaccccattttacaatataatcctgtgtgcataactatgacttgagatctatttctacactgaaatctgcaatatgagattgttctaaggaaagcctctaaataaccaaaaagactagacaaccttcagtattagggtttaataaaaatagttagcattctgatatgggaaatgtattccagatggaatgttattaaggcttatcagtctagagtaaacatggatgtgtacaccaaattcttcagtatcagaaccagatggcactcaaaaaggtttaatttcattcaaataagcaatgccactttaccaactagaaaggggataaatgaaactcattacctcagtgtatggcttaggactcagataaatgcatgtgagagagatccttaataggtgattgagataaattagggaaatttaagaaatcttcttatacctttaagggagactagtgagaaagattttgctgtctaacaaaacattttcttgatgttagtattcgattccacaataagcggtatcttttattctagtgttctctgtgggtagtaggtatgaatttgccctgtgactctcaggtgtcttgttacattcttcttatgaatcagattattttctcaagagtctggagatcttatgtcatcctgaaaatgtagggaacggtctctttagcttatcagagttagaattgaaatgcatattttccaaattcatatggaccatatcaagttgggagcctgtttagtgcccaatctgaccttggaacactttgccccactatgtgactttaaataagcttcttaacttctcagggtcttggtgctaaggtcagtctttctgaattcatcaaaggttttcaaagatcctctcgccttttgagattctgcatggtagtaaaacccacttcctcactatggaacccacccgtctttctgtgtcagacaattttcttctgcttatggttggggccactcctcacctttaactaatgaattccttttctgctttgtgatgagctagtcttttctgcccagattgcactgaaagatagaagctgctgcttcgttgtaaggagagctcaacctgttcacaaagatatctacctccctacaaattttttttagaacaaatattgcttgaatacatttaaggcaaaaataaaccaataaaaatcagccttagatttgatagctgggttggaattgaacctttaggttttcttaccaaacaggatttatctctgcttcattaatacatagcattaatttggcatttttattctccactttaaatagaacacgggaagacaaaataattttctttcagcaacaagaaagtaaagcagtagcaggaaatctagaaaaaaaaatccttctaaataggaattaatattttgcatcctttttttgtatttttttcctcaattagagtcctagccaataaacattcaagtcaaccaaaagtattatttctgaatggaaaag

SEQ ID NO: 178623 - DNA, 253 bp, Homo sapiens
cactactgccacaggtgcaggcagccaggaagggaaaatatgcaggtgcttggttaagagtgaggagtcctaagcatgttaatcaaggtttctcgaatgccatgaatattatggcacttcatggtttaaaaacaaaaaaacaaacaaacaaaaaaacgggaagcagacgaacctaataggggctttgtgctgttacattcccaagaactagccaggagtacctagagccaccctgtctgcgattaggcttggt

SEQ ID NO: 178624 - DNA, 338 bp, Homo sapiens
tgctaatagtgagtatccaaatgtcaaagtaagtagaaacaagtgtcataaataaatgttaaaataacagccaaagatatgtatcctgaacaatggacaacagatcgcagaaggagttctcaaattaatcaatgacagctgcccccaatgtggtagccataagaactactgacacaatgacaatttgtattctctttcctttccccctgtggctgcagataccagacactcctgggactgtctttctcatcttctcttctccagtaagggtgaggcaaaaatgaaaaatgcaaaaagagttattactatctcatttgaagaggtgattaatggaagtg

SEQ ID NO: 178625 - DNA, 583 bp, Homo sapiens
cgggaggatggcttgataccaggtcaagatgcaatgagtcacaccactgcactccagcctgggtgacagagcaagaccctgtctcaacagtgtaatctaaactctctgaaataaagtttattgcttaattgggcaaaaacaaggaaacagttattataaacagtgttaacttgaaaaccaaaaaatcagcaggttctgccatcagcctctaagaggctgaatgagccttatgatactttatttttgaattagacttatttagcaacatagtcatagactgtgcttgtcaaccacagcaggagtggataatgcctctataattttactgcatgggagaatagaaactacatcctatagggctgggttgagcatgtgtacttccttgttttttaatgcagaggcagagataaattgaagatgttccttttactttttcatcttggttgtgaagtagaaattgcttccatttatgaaaatatgaaatgttaggaataagtgtctcattttgggcaacgtccaatttccttatctttcatggtatggatcatttaacatactgtatttctttctaccaccagtgcca

SEQ ID NO: 178626 - DNA, 541 bp, Homo sapiens
cggttcttgatagatgggtgatgttttagtttatcctgcatttttttttcctttttaagttagaggaatctgaatctattcaaatgttttattttagcaggcatgtgccctgtttaggtttaatttgaatgtcctgtcctacttttgtaggccatgttttcgcaggcagtcttgctatcagagctgaggggatgctgttttgatcacttagtttatctgatgttgctgggcctccaactggtgctgactggtacttcctgagatggcgaaggtttttctgtactctgagatgccgtgtatctctatgtaaggggaggagactctggaccacaggaatgaagagaacatcttaggtcaggcagctcaatcatatgcgataacctgggtcaaccagccagtagcctcatgaagtatgggagggaattctccagtgtcagcattcaaagacatcatgagtttttacttctcattttcttttaagtgaaataatcgcatggaaattaaagaataaatatatgaaatatatgaaacttatatgaaa

SEQ ID NO: 178627 - DNA, 321 bp, Homo sapiens
ctccacccgacggggtggcttgaggtatccgcaggagtggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggctttgacaaggcctacgttgtccttggccagtttctggtgctaaagaaagatgaagacctctaccgggaatggctgaaagacacttgtggcgccagcgccaagcagtcccg

SEQ ID NO: 178628 - DNA, 308 bp, Homo sapiens
tcgaagatcttgaatgcctctctcagctaaggattcagtccaaactccttagcaaggtccttcacaaccaggttcctaacatggtcttcctagtctcatctctggccatgctttcacacacattctatgctccagccacattcagttattaatacattccctgaaaacgtgtctttacctgaaaggcccttctctccatttcactggcaaattcctgtatcttttaggacacatctcaaatgtcaccccttcgcaacaccttccctgattctttgagcagacacacccatctccgtgtccttatagcg

SEQ ID NO: 178629 - DNA, 274 bp, Homo sapiens
cataaatattcttacatttctgcatagcctgggctttcatacacacatgcatgtatatatatacatatgtatcttatttgtgtattttgcctgttattatatattgtcattctttcattctctttacattacacttttactactattagcattaccagtcccgatttcttctgccttgtatctgcttgccaattctttgcctatgtctttaactttgatcatgattgtatatgtgtttttggtaaagaacacggatttgaggtatgtcttatag

SEQ ID NO: 178630 - DNA, 271 bp, Homo sapiens
atgtcactgaatactcacgagtcactcactgtttccagtataaagccatggcattcaactcatggcctgaataataagcgaggaggaaaagagctaccccaatttttctttttgtttcaaatgttttctaatttacctaatatcccattctcatataatagggctgttgaaaggcttctctttggcttcactgttttcctctacttgaactttacaaaggagataaatgcttcagacatgaccttgattacaccgtgactcgtggaaatgt

SEQ ID NO: 178631 - DNA, 516 bp, Homo sapiens
aggtatggctattccactatgagcaggagcagtaattactggcttgcaccacaaaacaaaagcatccctagcccattttctaccacagaaaacacctattttacttattgccgtactactaattatagaaaccaccagcctcttcattcaaccaatagccttagctgtgtgactaacagccagtattacagctggccctctgcttgttcatttaattggaggcgccacacagtattaacatcaatcaacctacccacagcctcagtcagatttacatcttgattatattaaccatttttgaattcgtcatagctttaatccaagcatatgtttttacactactagtgagcctctatctacaagacaatacttaatgacccagcaaacccatgcgtaccatctagtaaatcctagcccttggccattaacaggggctctcttagcactaataacatccactacccagacttagtggttggatggcaagcatgtggtctttggcaaggtgaaagaagg

SEQ ID NO: 178632 - DNA, 403 bp, Homo sapiens
gctggggggggaggagcaagtgtggaggtgctgggggggaggagcaagtgtggaggtgctcgggggagcagtgtggagatgttggggagttccgagcaggtgtggaggtgcttgcggggaggagcatgcctgggggtgttgagtgggaatgtgtaggggccgtctgtggaactgagaggcattgattgaggtacagtgggtgagggtcccagaggaagaagaaacactcagctgcagaagtcaggaaatgctcttgctcttgaacagtggaacacagctgagtgggagtgatctgtgtctgaaagattctcctgttgtatggaaaatggagcaggcaggggagaaagattgagaaatggagagggacggtggcttggactgaggggacagagttgaggtggct

SEQ ID NO: 178633 - DNA, 546 bp, Homo sapiens
gtcgcccaggctgcagtgcagtggtgagagctctgctcactgcaacttccacctcccgggttcaagcgattctcctgcctccgcctctcaagtagctgggattacaggcacgtgccaccatgcctggctcatttttgtatttttagtagtgatggggtttcgccatgttggccaggctggtcttgaactcctgacctcacgtgatccgcccaccttggcctcccacagtgttaggattacaggcgtgagccatggcacccggctctactaccatctctgcttggacatcaaatgggcaactcaagcttggtatgtccaaaactaaatactcaaactcccaccacctgctcctcctgtggtcctctcaggccggaaacctggggttacaccggaatactctcacatccaacatccacaccatagacaattcctttggcctccactttcaagttataaccagtctgcaaccacattttaccacccaagtccaagccaccatcacctcttccgctttcacaatagcctcctaactggttttcccacttc

SEQ ID NO: 178634 - DNA, 439 bp, Homo sapiens
aaggacccagcacctcaatacaaacttaaatgaccacttacatttagttcccaggttgcaccaagtatgaaatgtcaccagctaaaaatctctaattaaagtcattttcccaaagtccctccttccttttgcctgccttcaaaatccaaagcttggcagaaatatttgattgttcagagcctgtgcctctaacggcagatttcatgaaaaaagcaattctctccaccctcggtattcaaaatcactaagagaccatttcctcagcagcattctgcctctactctgttaacacagctcagggaggagagggttctcattccccggtgactcagccccagcaaggcccaagtcacacaccacatggcttctgaacccactctgagcaggcaaacatcaaaacaaaaaaccaacaggtgtaacagcacaagtccattcagaa

SEQ ID NO: 178635 - DNA, 539 bp, Homo sapiens
taaatccccaggaaggtctcagtgctgcaaaagctccatgaccattctgcttctaaactgacggagcaaacatatatttccagtggtaatgctaggaaatactttgctaaggatgttactttggtccttcagccagtggtcagagaacagaatgaccatactgcaaccacccatggtgaactgactggcacacctacaaaaatcttatttttggggtccccatagtacccagtggattgccttgcacattgtaggtgctcagtatgtgtttgctaaagacatgaccctggataaatcacttcacctcaattagtctgtttcccaaatctgaaaataaaagcagtgaaatggacaaggtgacagttaaggccttgaatcagaagagcctctgacaatgtgacaaatagcttagccattcctccaagactgagataaaatgtcactcttggttcaggagctgtggcagtaggagaacatcaggcaactagtcctagacttatcatcatccccatggaaggagtgtgattgtaagtctctct

SEQ ID NO: 178636 - DNA, 746 bp, Homo sapiens
aaaagactgagaagctcaccataatcctgaaagagtatccagttcacaccataattttaacaagcctggggcacctggactaaagacacactccagtttacttacttccccccaaccatcccgcttctatattcccagacttgctctgagtagcaaaaggataaatggaagtgaaggcccggagcggtggatcacctgagatcaggagttcgagaccagcctggccaacgtggtgaaaccctgtctctaataaaaatacaaaaaaacagtcgggcatggtggcgcatgcctgtaatcccagcaactcaggaggctgaggcaggagaatcacctgaacctgggagacggaggttgcagtgagctgagaccacaccattccattccagcctgggcaacaagagccaaactccatctcaaaaaaaaagaaaaagaaaaagaaaaaatagaagtgaaaccaaatcaaggcaacttggttctctagcggaaactttttgaagatgaggttaaattccactcttgtgaatgtcttcatgagaaactcctcaggagggaagcactgtttttactgaccagatgtctgggtgaaaaggagacctgtccagtcagcattctgcatccctcttctgatcatcccctcacactggtgagcacctccaagggacaggtacttgctttcagacctgtccaggtctctttccaaacctctgctgtcctcattgaagaaccagactcaatgctagccccct

SEQ ID NO: 178637 - DNA, 721 bp, Homo sapiens
gatgtatgacctattcgtcgtataagtaagtccttgaagaagtggctgattctagatctagggcaagaaaagtacaaggtaagctcaaagacatcttgtgtcagaaaccgtgaaaagaaaatagggaccaccttggagtggtttccatcggcaaaatttggggtgatttaagctttaaaaatacattagggattataccactttgaatataacaattcgtgagtccatagtggtactcagagagagaaaggtgcagtggatgtgaaagctggaagaatgtcagctaacagatgtagaaaaattggtacaatcgaaaaacgtaataattcattcaagaagaatcatcatcaactaacacgtgaaatgttgaggatgaggattttcacaaggcctcatatcatcccaattaactggattctggattttaaaaaactataaaggagccgggcgcggtggcttacgcctgtaatcccagcactttcggaggcagaggcggacggatcacgaggtcaggagatcgagaccatcctggctaacacggtgaaaccccgtctctactaaaaatacaaaaaattagccaggcgtggtggtgggcgcctgtagtctcagctactcaggaggctgaggcaggagaatggcgtgaacccgggaggcggagcttgcagtgagccgagatcgccccactgcactctagcctgggtgacagagccagactctgtct

SEQ ID NO: 178638 - DNA, 375 bp, Homo sapiens
ctgcaggacccccaacgctgctcacaggagaagatcatagggaaggaatcagttgagaattcaaaattctgcccatagaaaacagaagagattattctctcagttaggaaatgcgtaagatgttaccagtcagcatgttggttataacagtggttggttataattggacttgtctgaaagactagctcatcaaatgaaggggatttagctgacctgatccattcagtcttgtctagtcgttgaccatttcaacatcagagattgtcagtcaaaaactattgtttggttttgttctatctgcaatcaattaatcttatacttgtcctttcaaactttgaaatttcatcccgatttggagtttgtgagatcatgttg

SEQ ID NO: 178639 - DNA, 620 bp, Homo sapiens
tcccgcctcccatttacacacacttctaaagcccaccaaacccctaagatatttagcccgaagcagatccaaaggcacacatcttactgaccagatgaaaccatgcctcagagatacatttatctctggctgccaccacctccaaccaccattccctatgtcttttccttcagcatagctgatactcaagcagatgactgacaaaggagcccaatctaaagggctgctgaaggaaggtttggagggccttttggctaagatcacatgtatgttatccccatataaatggccaagtacatctgttggtcaccgacaatgtgtcaggcataacacagcacaaagatactctctcccctctttaggcctcacacttttaaaagacaagagaaacagtccagatcattcttttcagtactatttgtttccagctgaagatgagagagatcttttaacacagcccttcatcctgatctctgggaaggagacaattggatggccctggccattctgctttctctggttcccatagcaaggccctgcagaacttctagaacacaattatgaggaaagaagctctcagcattccaaagcagaaggaacaactgtcttgaatatgtcga

SEQ ID NO: 178640 - DNA, 254 bp, Homo sapiens
ctgccactcttgtctgtagggaggtgggtacagatctgacttgagtttaggtcagagccaggatgtcctctgggttcatggtggtcctaaataaggaaaggcagagtgggggcagggaacctcctgcactcaggcccctccatgcacctgcctccccgtgacccaggaggatggtgaagtacctgccagttcttggaggacagttaattctaatggcctactgagaatctttgtttcctgtatttgtggcctga

SEQ ID NO: 178641 - DNA, 511 bp, Homo sapiens
aactcagaaattcagctgcttacaaaaattactgcaacggagcacttttttttgtatttatgaattcatttgtctgtctcacactagtttgtgacccttggaggatagagactgcatcttttttgtttgtttgtttttttgtttgagacagggtctctctctctgtagcccaggcttgagcccaggaatttgagatcagcctgggaaacatagtgagacttcctctccaaaaaaattatacttttagatggatctacaaactgagtcataaagaaaattgatgtaaggtaaaaatcctgacagcatatacagtattaatcttgatatcctcagatggtgggagtcactgaagaaggtaggttaatgcaactctccagctcttgggccaggagggagaaggaaatataggcttacattccaaggaaaagggcaaggctgtctggtggcatatatactaaaagatcattgagaggcaacacttgctaggtagcccagttgaaattataacatg

SEQ ID NO: 178642 - DNA, 192 bp, Homo sapiens
ttttaagactattttgattatttagggtctcttaagattctataagaattttaggacagatatctctatttctacaaaaaatgtcattgggattttgataaggattgcactttgaatgtataagattgctttggggtactactgacatcttaacaatatctaatctcccaatacatgaaaatgtgatgtctt

SEQ ID NO: 178643 - DNA, 180 bp, Homo sapiens
tcgtctgcctaggctggaaactgggaaggattcatcaagcttgtgaatttatcttctctacttagggttacacccaacagtgtgctggtaacaactggccctccagaaaaaaagaagggtgggggattttagcatctgccaatttctgtgatgtaaatactctgacttcagatttcactc

SEQ ID NO: 178644 - DNA, 164 bp, Homo sapiens
acattctcacagttaatataggcttaacttggaaatattaagcttttaggatttagtatgtagtagttctctgctggcactaagtctttccccttcgctcctttccaacaggtattgcccaagctctcataagccgttcttttctttctattatgattattatt

SEQ ID NO: 178645 - DNA, 258 bp, Homo sapiens
cggaggaattccctgggactcatcatcgccttggactataagagagaagcaaagggggagctgtactgggatgacggtgtatctaaagatgctgtgactgaaaagaagtatattctatatgatttctctgttacctctaaccatctacaagcaaagattataaataataattatatggacactgacaacctcatgttcacagatatcacaatcttgggaatggacaaacagccagctaattttatcgtcctactgaat

SEQ ID NO: 178646 - DNA, 286 bp, Homo sapiens
tgtatatgtctaaatttcatctcttcacttcacatcatgaaatcttcctgagctcaagcaatccacctgcctcagcctcccaaagtacgtggattacaggcatgagccactgcacctagccagcatcatctttaaatgatgaaattgtggaaacattcccattaaaatcaggaacaatgcagggatgtacactgtcaaaatagttattattaataactagagaaagacatcagaaagcaggaaacaaaattgctgttatttatagacgttatgatatatctttaaa

SEQ ID NO: 178647 - DNA, 773 bp, Homo sapiens
gactagacacatcagaggaaaactgctgaacaccagagctagagagaagctctttagtggccagagaaaaaaagtcaatttgccttcaaaggggcaacagttgaactgacggctaacctaaaaatggcaacagtggaagccagaagacagttgaatggggtgtcttcagtatgtggaggaaaaaaacttttcaacctagacttgtataccctgtaaaaattgcttttaagaacaagggtaaagatattttttagactagcaaaactcagaaagtgtgtcaccagtagaaccttaatgaaggaaattctggaaggtgatcccaggtggagatgtgtcaggaatgaatagcaaaaaaagtggtaaatgtttagtcttgttaaaagtaaaacttcagccaaagtaagggagtttaattgtacaatgaatgattcgtgaatcaggcagcccccagaatcacagcagagagtgctgaggcgggcagatcacaaggtcaaaaggtcaggaccatcctggccaacatgttgaaaccccatctctactaaaaatacaaaaatttgctgggcatggtggcgcacgcctgtagtcccagctacttgggaggctgagacaggagaattgcttgaaccagaggtggaggttgcagtgagccaagattgcaccactgcactccagcactgtctcaaaaaataataataataaagaaataaagaaaaggtggaacatgttttacagatgagctttgtgaaggtgacatgactagcagcttcaggact

SEQ ID NO: 178648 - DNA, 266 bp, Homo sapiens
agttgctgggaaggcactgaaggctgcactaaatggggagactgtctagaggcactcacttgtcaatcacaggggcctgaagttacaggagatattaatcaggctgcattctcctggaaaatcaattttcctcaaaagacagtatcttcaaaacgagaacaattgataataatttatataccctacattaatcatactggatgcttaattataaattttctcagaggagaactttgtctttttaccatttttatcctcagcatcta

SEQ ID NO: 178649 - DNA, 200 bp, Homo sapiens
gactgtgcccaccgtttggggaagggagaacactgtgactgtcgtgtgcgtacacgtctgtctcctccacctcagattccaagcatctcaaaggcagagatcgcctcttggtcacttctgtccccttcccttacacaccgtaggtaccttatacatgggatcgtgccattgcactccagcctgggcaacaagaaaaggag

SEQ ID NO: 178650 - DNA, 430 bp, Homo sapiens
aactcatggtcacagctgaattttactatatgtacaaagaagagctggtaccatttctataaaaactattccaaaaaaactggggaggaaggactcctccccagctcattctacgaagccaccatcattctgatacaaaaacttggcagagacacaacaaaaaagaaaacatcaggccaatatccttgatgaacatcaatgcaaaaatcctcagcaaaataatttcaaactgaatccagcagcacatcaaaaagctaatccaccatgatcaaatagacttcattcctggaatgcaaggttggttcaacaaacaagtcaactgatgtaatctaccaataaagtacaaaactgacataatcatccattacagatccagaaaaagcatttgaaaaaaaacttcagccttttatgattaaaaaaaaactcaaca

SEQ ID NO: 178651 - DNA, 356 bp, Homo sapiens
cttccagtgattacactgggacactcagcctctgccactccagaattccatcattccattaaaatgagagagtctattttgaaagtagcacctaatatcacatccaaggcaatcagaatacagccttcccagatttcttcaaggacactgatgttcccttcaccaatgcatttctcaatatttccatgaggaaagcatttgtgggtcacacatgataaacccactgcaacattcctatctccctaaggctttgggatattttcatgcaagactgaagtcactatggccattacagactcttcaagaagagggaatttaatctccttagagaaagaagaagaggttggttccacaat

SEQ ID NO: 178652 - DNA, 347 bp, Homo sapiens
gagtagtgagggttggctctgctaaggtgggggaacaggcaagggcaagagctgccaacatctgcccctgcagacctgcaatttccctgatacgtggcctccctgtggaagcaagggacatccatcctgaggacagatggctaaacaaggaggagtgggcttaggggcctggggtatggtgtggaagttcactctagaatcctcctcgttgattcagctgataccccagttaactgcaactccgaagagtggaatcccagaggtcacaggtctttggggacagaaggacttcagggggccttgagtccaggtgcagctgatgcctcagtcctctcatcctgggcgat

SEQ ID NO: 178653 - DNA, 292 bp, Homo sapiens
tctcaccaagtgttctagagaagtcttggggagacctcaaccttctcctcagaccttgtacagctaatcagccaacagatttctctactctatcaatatgctcgcactgctttctcctctctgggcccaggaccacaggcttataggtgagtccctaactaaaagtgacagccaacttaaaggaatccctgcctccatccattccaaaaccaccctgaaggtggtatagaaaaaaaaaaaggttggaggccaggcacggtggctcacgcctgtaatcccagcactttgggag

SEQ ID NO: 178654 - DNA, 682 bp, Homo sapiens
cagtatgcacagcaccagatttctaatcagaaaccatgaaggccagaaggaaatggcacaacattttttttaaaaactgtcaacccagaatcctatatccatcaaaaactatatttcaggaatgaaggggtagtcaagacattatcagatgaagcaaagctaagaggatttttagccaacagctctgctataaaacaatggctaagaaaattctctaaacagaaaggaaatgatagaaggattcttagaacatcaggaaggaaagaagaatatgaggctgtttcctattctgttgccaaaacaaaagcagaggatgagaattttgaaaaaggaaaacagtctgagtctcaagaagcctatgagaaggaagagaggaatgacttggtcatgcccatgacagaaaagtggcttagggatgtaatgagagaatacaatatgtagatgatacactagaattcttgtcctttgaattagtattgggttggcgcaaacatgattgtatttttgccattgaaagtaaggcaaaaactgcgattgcttttgcactaacctaatagaataaaatcatttgagctagaacagaaatgctaggccacccagcttcctcccttttttatatcaagctacatttgcacagcttctcttagatagttttatttactttatgccatgtagtttcctg

SEQ ID NO: 178655 - DNA, 255 bp, Homo sapiens
cagagctgtaactaaaaatcataaaataacatggcagcagcagttgtcagtaaacagaactcaccagctcgaaagaatgtgagattcgaggaatttttttttctttaatttggctatgtggtgtataagagacacatccaaaacataatggtgtcgaaaggttgaaagttaggagttggaaacaagacactaggtaaacattaaccataagaaagctgctctagctatagtcctagtgctacagcgacagtgatg

SEQ ID NO: 178656 - DNA, 115 bp, Homo sapiens
ataacgggtggtgtcctggaccttagaccgtggacgaggcaggagggaaggacattccaagagagaatgtctgcctttcttgaaggatattgaagatgctgcctcagccccgggg

SEQ ID NO: 178657 - DNA, 511 bp, Homo sapiens
tggagccccaaagtcagtgcacaccctgctcctgagcctcctgctcctttcctatatatggcttcatttgtagcacggttgttgcaccgaggcttgtgcatgccaggcaaggccaagctggctcaaagagcaaccagtcacctctgcaagggtgtgccaggaacaggtgggccaatcaccaacctcacatgctgccagtcacagtacatcagttcttctgccctagagttagggccccagtgccatctgcttttcctcaggactctgctccatcagccatcaggtggcagctactcatgctgttggaacctggccatctgggcttccttgagtgggtgaggttgctggcttgtccacctgcttaaaggtactatggggatagaacacaaataataataatgcatttttcaaacaaattaattccttgattttcaaacaaattgaagacaaaggaaactcatgattcaaatgaatacatatggctcattttattcaatatttatgcttacag

SEQ ID NO: 178658 - DNA, 482 bp, Homo sapiens
tatggaagaggtagattcaaacatgcctataataaacattcaaaatgaataatttggggcttttttgctacctccataagcattttgcaagaaatatgatttccaacagtcattggaatttttctgcgtgaaactgtaatactgtatttgggatcattctttgattcttaaattatattcataaattcataaattgagattttaaactctaaaaaaggagttttcttccaaacttttcaaattagggcactctatcaacgagggagagaaggcccagtgaagaggtattggtagctatttgacaaacctgacatatccccttagagcataatttcagcaaagatttgggaaaaaaaagcaaacttaaacattaacaagttcaggcagggcgtggtggctcatgcctgtaatcccagcactttgggaggccgaggcaagtggatcacttgaggtcaggagttcatgaccaggctggtcaacat

SEQ ID NO: 178659 - DNA, 718 bp, Homo sapiens
tgtggacccccaggccttttcccctcaaataatttgaagcaagacaggcatatatctaatgtggaatgaacatccaaagtttttgagggtattaggctttcctaatacctaataccaagagccaaaaagtttcagggaaatttcttatttagaaatattatttataggtcggttgtggtagctcacactggtaatcctagcattaacagtgaatttgtaaaataaaatttttaaataatttgggaggctgaggcaggagaatcgcttgaacccgggaggcagaagttgctgtgagccgagatggcaccactgcactccagcctgggtgacagtgtcagactccatctcagaaaaagaaaaattgaaagattggcagtaacctaaatgaccactaatatagggccaactggttaaataaattatggtacatacttgcaatacaatattaggtaaccattattaaaaagaacgaggcagttcttttcaactggagaaagtccatgtaaatcacggaattatagaatgctcagacctgaagtgatcttaaagattagctagttcaaccttctacaggaaacaaggaaaatgatttacctaagatcatacagtcagggatgaggccataatccaagtattctggtatctattccaatgctgcttctacaaggggatgccttctctcccatattattctttgagatactgaggactgcaaggc

SEQ ID NO: 178660 - DNA, 459 bp, Homo sapiens
tgcttcttccccagaccctccagactctccatctcacctgaggacaagccagggtcctcacggtggccacaggccctccaagcttggccctgagccctcctgccctcgtgccatgtccactcccacgctgtggaccagccacactcctgatttgggcccactgcccaccctccctgcctgatgtccagtctgcttcgtcctcagacaccgttaccacttcctggttgattgctgtccttagcgctttctcttactcagttcatctgtcccgacccccatgaggacccagcatttcttttgttgttgaagcatccagggcccagcatggtgctggtaggcagcagccctctcaggttttatgttgagtcggaagaatgaaggaatgaacgagtggcctgtgtgacccctggccgtggaggaggggactcgggcctagcagagctctgtgccaggcggccg

SEQ ID NO: 178661 - DNA, 1046 bp, Homo sapiens
aatttttgtattgttagtagagaccggggtttcaccatcttggacaggctggtcttgaactcctgaccttgtgatccaccagcctcggcctcccaaagtgctgggattacagccgtgagccactgtgcccggcctcctttttatttttatacccatctgtagcagttgatgtggccacatttgcatttgttttatccagtctgtttacagctttgcaggcagtgaagtgggatgttggtcaccattgagcccctacagtaactttgttatacttcctagccgtggctgttaagctctgacaggtttggccttagtcctaggtgctaaaggttgacttggttacaggattgaagctagatttggagtttgcagattgaactctgtgctgagggaatgcctgttgggaccagtgggtgtgtgtgtctctagaagagatctataaggttaccaccttaagtatcttggccaagccgtataaaattggcagtagtcatccatttttacctacagacatgatagttctctatggttcagcctaatatctacaaaggagttggtttaagggcaattcaaagtttgtcctgaagctgggagaatctccttgtgtgtctctaggttgcaggttagatgggagagcgagcacagcagaggagctgtgcaggaagagacatgcaatggaggctcctctctctcacagaaatacattttctgtgatagtagagcgaaaccctttcactctgatccattcagaaacttttcatacctggactttattaaagggactgtcacttccccattatccctctttgggagaatgcaaggtatgctcctttgcagtagttgttactgttagcagagttgacattgtggacacatccagtgcagacatggattgggaatgtgggagcccctgcttagaaggtgctctcaacctagctggggtgataagccctcctcctgtgggcaggggagtgtggttctaggagcaggtttccctgtgatgacagtgtggcctgtgcaggccgtggagagccatgacaggagtg

SEQ ID NO: 178662 - DNA, 787 bp, Homo sapiens
agaggatctccccgaacatgccgtggctgttaagctctgacaggtttggccttagtcctaggtgctaaaggttgacttggttacaggattgaagctagatttggagtttgcagattgaactctgtgctgagggaatgcctgttgggaccagtgggtgtgtgtgtctctagaagagatctataaggttaccaccttaagtatcttggccaagccgtataaaattggcagtagtcatccatttttacctacagacatgatagttctctatggttcagcctaatatctacaaaggagttggtttaagggcaattcaaagtttgtcctgaagctgggagaatctccttgtgtgtctctaggttgcaggttagatgggagagcgagcacagcagaggagctgtgcaggaagagacatgcaatggaggctcctctctctcacagaaatacattttctgtgatagtagagcgaaaccctttcactctgatccattcagaaacttttcatacctggactttattaaagggactgtcacttccccattatccctctttgggagaatgcaaggtatgctcctttgcagtagttgttactgttagcagagttgacattgtggacacatccagtgcagacatggattgggaatgtgggagcccctgcttagaaggtgctctcaacctagctggggtgataagccctcctcctgtgggcaggggagtgtggttctaggagcaggtttccctgtgatgacagtgtggcctgtgcaggccgtggagagccatgacaggagtg

SEQ ID NO: 178663 - DNA, 405 bp, Homo sapiens
ctcatcttaaactacatatgacaatgacacatacttatcagttagcaatcattttctaaaatgagggaaaacaaggtgttttgtataagaaatattattgcacttgtaaatcaggccagaaactagttcacttgaaaatgcaggaaaccttatttcctcatttcacaattccaggtgtgcactatttacaatgcccaggccaatcactatttcaggaaaacatggcctacagccattaaactctctagtaagcatctagaagtttggcccttgatttacttgcacaaagaagatctgtccatataataggtgttaatctgttgaacaccttgtagcttcctcaataattgagaattcttctcaattaggagagttaaacatcaattcaaactcgaaaaggagagc

SEQ ID NO: 178664 - DNA, 890 bp, Homo sapiens
aagaattatggagaaaaggccaggtgcagtggctcatgcctgtaatcccagcactttgggaggccgaggtgggtggatcacctgaggtcaggagtttgagaacagcctggccaacatggtgaaaccctgtgtctgctaaaaataaaaaaattagctgggcatggtgatgagtgcctgtagtccaagctactcaagaggctgaggtgggagaatcgcttgaacccgggaggcagaggtggctgtgagccgaggcattccagcctgggcaacagagtgaggctgtgtctccaaaaaaaaattgtggctgcaggtgttaggtgttagttggtctgggggtgacagatgagcagatgagcagagactgaaaggagtgaagggaggtgctgaatgccaggcactggcatgctgggtcatggggacagcacgtgcaaaggacctgtggcaggagcccaggagctgtcaggagacagagcaaggaacagggacttggtgagagacacttccccacgtccagggtgaatccaggaccctcgggcagctcatctgtcagatggagactctgtggaaggacaggggatggccttcgggcttattaagatcctaatggggccgggcacggtggctcacacctgtaatcccagcacttcgggaggccaaggcgggtgggtcacatgaggttgggaattcgagatcagcgggaccaacatggtgaaaccccgtctctactaaaaatacaaaattaactgggcgtggtggcacatacctgtaatgccagctacttgggaaggctgaggcaggagaattgcttgaacccgggaggtggaggttgcggtgagctgagatcgtgccattgcgctccagcctgggcaacaagagcaagactctgtctc

SEQ ID NO: 178665 - DNA, 506 bp, Homo sapiens
ataaccagaaactggaagtctgatggttgttttcagtcttgaacaacattgattctgcggtgaccagtttagagttcatgcaatagaccttcctcccccttgtaaaatcatcactatttcagctaatacttagagtgacctcctggtgactcatcctcagccccctttgccggttcttcttttccccgacattttcattctggagggcttgggattcagtcctttggcctttttcctagctgtgtctgccccctcggggatctcatccaatacccttcccacagcctacccagaccccagtgctgaactccagactcacggattcagcggagcgcagaatgtcagatgtgtgagggccgcctccgatgcagcgcgttccagatggagctgcggcctcccccagacccgcccacccccacccccagattctgttgagggcaaatcatgcttcctcgcagctcacaccctgttggttctccctcccacgttcatctggaatgcggccg

SEQ ID NO: 178666 - DNA, 242 bp, Homo sapiens
tcagtgctcaggtgtgctgcttcccttgggcaaaaatgaaccaaaactttcttccatgaggaagaaagcggagtctcgagaggaaagtccaggcagatctcggctccaccactgaccctctgtctgactcagcttccatagttgtaaaacaaaagggttttatgacatccacctaaggggagcaatgggaagcaggggttgtcccaggttcaggtctgagcttctgttccatgcactggcta

SEQ ID NO: 178667 - DNA, 221 bp, Homo sapiens
gggaaatacttaaggatttaaaattccgatgaaggggatccaagtgaatggaagattctgctgagaatattgagatattgatatgtattttgtgttcactctacttttctgtttccttttctgagaagagagccaggtcttggcaatttcttcaaaggatggttgactgtgcctttcagaatcttgtttttcatgaagtctgagttccttgagaggataat

SEQ ID NO: 178668 - DNA, 473 bp, Homo sapiens
catataagcggtcaaatcagatattgaagaagagtgtatatctaaaagcaaaaggtcctggaccctaaactgtacttctctccaaatccatgaagcccctcgtcgttccatttcagaacaggacagttagttcccctcgcacagtctgccacacgcaacacggcctggcacactgagagggtgtccatgtacacctgttaaataaacagacgccaatgtgccagaatgctcaggattaaatactgctgtttaaagttcaatgaaaccatttttacttactcgagatgcttggccccacccctttcctgaatgaaagtaataaaaaatgctacctttcagtatgttgtgtgtttaacagaagattccagagggcagtctggactaccagctattaaggatataggcataccttgtcaaattgcgcttagcagatattgtgattattttagactgaaggttcacggcaatcctgc

SEQ ID NO: 178669 - DNA, 292 bp, Homo sapiens
caccaaatgggaagagagattcccaacccagtctgtagacttgacttgtagcttggctttcaggctttaaactctttggattgaagatggggtttcacaggggaccccacctccatctgcctagacattggcctgcctcctgccgctatcaattcttcgccaagtgttgggattgtagcagtgaaccactgctcccagtactaaatatcaacttttagtgaagatgacttcttcccatagaactctcaaaaagaatctttttgaatctcttattatcagatttcagccagga

SEQ ID NO: 178670 - DNA, 141 bp, Homo sapiens
ttctgaggggtcatttttttcactagtaagcaaaatttttaatatttcaagggagttccaacatatgcaaaaagtatataacacaaagctggttgagaaatagacactggttctcaacagtgggcaagtgactctctggca

SEQ ID NO: 178671 - DNA, 414 bp, Homo sapiens
ctcttcctaaactctgtgctttacttcactcagagaacacaaaagcattgtagccatttgcctaagcagcctagaaaaggctgcctgcttctagcatgctctgcaattcacattgtacgactttttaatctatccttacagcaaccctctgaggcagggactgctgctctccccatttacaggtagggaaatgtaacctctttggttcaataacttccccaagcccgtattggagccacattcagatcatgctgactacaaggcctacgctcttcattcctaagctctgctgcccgcttgcatatataatgtgctataatgtcaaacagaaatagtgtttttagttaattgatgtttggagtcacttgtgtttcattagtggagaaaacagagtttgtacttttgttaacattc

SEQ ID NO: 178672 - DNA, 491 bp, Homo sapiens
tcttctgtctcaagctgctacactcaccagtaagattaaaacgtgactggcccctaagaaaggcagatggcaaagtacgaagctttccaggagagaacacaagtatagctgggtcattcaatgcaaaagatgaccctatggccaggggcggtggctcacgcctgtaaatcccagcactctgggaggcagaggcgggcagacgacgaggtcaggagatcgagaccatcctggctaacacggtgaaaccccgtctccactaaaaatacaaaaagttagctgggtgtggtggtgagctcctgtagtcccacttactcgggaggctgaggcaggagaatggcttgaacccagtaggtggaggttgcagtgagccaagatcacgccactgcacactccggcctgggagacagcgtgagactccgtctcaaaaaaaaaaaattaccctaataactgccttgccttgaagaagtgatgaatttaatgaaatctctttg

SEQ ID NO: 178673 - DNA, 396 bp, Homo sapiens
acccaggtagattatcatcatatacaatggaactcagacggaaatggcacaacatttttcaaatgttgaaagaaaagaactgtccacctaaaattccatgtccagtgaaaatatccttcaggaatggaggggaaatcaagatattttcaaaggaagaaaaactggcataatttgtcaccagtagatataacctaatagaatggataaaggaagttccctaaacaggaagaaaatataaaaacaataaatcttagaacatcaaaaagaaagaagaagggaaagtataaaaatatgggtaaatacaccagattttcctcttaagtcttctaaattacgtttgacggttgaaacaaaaagcctatctctgtgggaagtggttctcaatgtatgtagaag

SEQ ID NO: 178674 - DNA, 601 bp, Homo sapiens
acattctggtggtctgaaaaagtgctgatactcaaatgacacagtgagaaggtcagagattccagccctacacatgacaaagttaaccgtacttcctcatataaaacagaagcctaacagtctcccaaatagcctcataacaaaaagcaggagggagagaattattaccatatatgatcatttgaaaaaaaaataaggaactatataaaataggaatgatgcacattaactcctaatttaatactatcaccaatagctgttgaccactttaaaatcatttaaccaactcaaaaatacaaatgtttctttatttcttttgttttagaggcaaggtcttgctctgtcacccaggctggagagcagtggttccaagtagctgggaccacaggtgccaccacgcccagctaactttcttattttttaatgttttatagagatggggtctccttgttttgctaaagtttgtctcagactcttggcattaagcaaccttaccagctcagcctcccaaattgctgggactacaggcatgagccacggtgcccagctacaaatgtgtttccagtgactaaatagtcatagagtaaaatactcaatatcc

SEQ ID NO: 178675 - DNA, 334 bp, Homo sapiens
ttgcacctttataagaaggtattcttttcaccttcccaagtgtataaatattgtgttgattttttttttaagtgaacactgctaaatgctaagcatttggtggaaaaccaccacattccagaatcaggcagccaagcccatccccattcccccctccccatccctctccccccttcactgccaccgtccacttggcagctgtggttttcccatgaggagcccaggtatccatgtgtctctcaacatgtgtctttctagtaggagcctgtacagcaatagtgaaatggctcacactctcacacatgcacacacagccagaataaattgtataatc

SEQ ID NO: 178676 - DNA, 511 bp, Homo sapiens
aggagataaggcccagagatccaggaggattgttcagggttaccccacagagcaacacccagacttccaggcaattcataacctcctgacctctggactgagtagatgacagcctaaagtatttaggccaaaacactccatcaggatgaccctcaggtcaggttataaggcacttctttggtgaagggtccccaaagcccaacgcaaaggaattctagagaggttaatcccgtagcctggagtagtggtttccaagacgatcattgggttcagtgatttgctagaatgatgcatagaactcagcaaagttattatcctcacagtttattacagtgaaagaacatagagcataaaacagcaacagcaaaaggtgcacagagcagagaccaggagagaccagatacaaacttccagctgtcctctcccagtggagtcgtgcagacagtgcccaatcttccaagcaatgatgtatgacaaaaaaaaatgaagtactgccaaccaagaaagctca

SEQ ID NO: 178677 - DNA, 336 bp, Homo sapiens
tggagccctctctctgtatcattaagccactcaaagagtactctgaaaacaagcaagcaagcaagcaagcaagcaagcagaattcctagaatgtaaggtgtatgaacctatctccctgccttctgcactgatgattatctcaaccagtttaggtagctgagagaatcatcaatcagccattaaagatggagcatataattgaccagcgtttgccagattgactttcaaggagtgggagccttatttattttcaggtctctgtgatcaaagaggttgggaaatgttacagagtcaaatgcacattagtgtattaaagactcaagatggtctatcgca

SEQ ID NO: 178678 - DNA, 388 bp, Homo sapiens
gaagaaaagattagtgtatttgaagacagcaacagaaggaatttaaaataaaacatagagaaaaaaatatatatgtatatatagttcaatgaaaagagcatcaggctaggtgaagtggctcacacctgtaatcccagtactttgggaggctgaggcagaaggatcacttaaacccaggactttgagactaccctgggcagcatagcaagtccctgtctctacaacaaaattaaaacgatagccaggagtggtgatacacacctgtgcttccagctactctggaggctgaggtgagaggatagcttaagcctgggaggttgaggctgcagtgagcagtgattgcgccactgcactccagccaagctgacagggcgagactccagctcaa

SEQ ID NO: 178679 - DNA, 288 bp, Homo sapiens
tgacctgtccctggagaaagtagatgaggactgcctctggcaacagcagaagaaaaaagataccaggcagtgaatgggtggaaagaatttttttgaaggactggaatttcctctggtgtggcctacaactagaatagggtgtggcaccagggcaagtgaagaggattctcatgtgaaaaaaaagaggaacattccatttctatttaattctcacaattgaatctggaaggcagcttaagacaccataattttaagcaaaacttccccgaggtaggtaaaatgtgaagt

SEQ ID NO: 178680 - DNA, 321 bp, Homo sapiens
tgctcactaaaccatgatggttattatcactatgcagactttcatcccaactctgtgactgctgatagctggctcagtggtggccctattagcctagaaccctgggatcacattattgcagtgtggttcatctgtactgtaatttacgtgaaatagaccatatgtggatactaacagtatcacattactgacattttactactatggttaatggttaagtaccattttttcccctcttaagagtaaacctttaagaatataagccatttccacagcaggaggcaaaatagtttggataagagtccttaagtaggataacag

SEQ ID NO: 178681 - DNA, 974 bp, Homo sapiens
ggcacccttgttgaaaatcaaagtgacaaaaaataagatttatttatttatttatggactctcaattctattccattgatctatctgtccatcctcatgacagtatcacaatgttttgattactgtcgctctgtaatcagttttgaaatgaggaatagagctctccaactctgttctttttccagattgtttcaccattctaggttgctcaaatttccataggaattttgggataagcctagaatttagtcggaatttttacaagaggtgtgttgaatctgtaaatccatttggggagtactgccaccttaacaagtcttccaatccatgaagatgggatatcttttatttagtcttttaaaatttctttctagagtattttgcagttttcagagaattttctactttggtaaatttatccctaaatattttattccttttaatgatattgtaaatggaattattttcttattaatgcaattatattatttcttactagtatatggaaatacaattgattctgtacattgatcttatattctgccaccttgctgaactgttatcaatatttttaaactcttgaagtgattcccatttgcaaccaagtctaagcaccactagttcagtaccacccatgccctccattctaatcagggaagatacttttatgcccctcatcactcttttctacccaacctctccatagagaatacaagcattcagctagttccaaaagaaacagcaaaggaagcttaagggggaaattatatatgcaaaatttaaaactctgattgagagcctttaaatactttagcccaaaatagtgccgttacattttctggaaaagattactaagatccaccttgtaagtttgaggacagtcattcaatatgggagattaaatctggactccaatcaaaagtacctccagttcccaccaaccaagagtgatcaaacacgtctatctttatctc

SEQ ID NO: 178682 - DNA, 801 bp, Homo sapiens
aattatccagcccaaaatgtcaataatgccaggctgagaaacactgggctagatatttcaacatttttgagctttggtatctttttcatcaatggaattagtatatacttcagagaggcatttaagaaggctaaagttttgaaaacatcagcacaaactgggcacagtggtgagtgcctgtagttccagccacttgggaggctaaggcagaagggtcacttgagcccagtagtttaagagtttaaggccagcctgggcaacctagtgagaccgtgtatttaaaaaaaaaccaaaaacacgtaactttaaagaactaacaaaatctcagacttttcttaaatagcaagtttagcgagatacaatttccatatcataaaattcaccctcttaaagtatataattcaggtgtttttagcctattcccagagttgtgcagtcatccccactatctaattttagaaagttttcatcaccccaagagaaacctcttacccattagcagtcaatccccattcctccctccccctagccaccactaatcttgttgtttctatggatttgcctattgtggatatttcatacaaatggaatcatccaaaacatggcccttttgccatgtggcttctttcactgagtttaatgtttgcaagatttttccatgttgtagattgtatcaatacttcattgctttttatggctgagtaatatttcattgtattgatgtgctgcattttgtttatccgttcattagtttttggagacatttgggttgtttacaccttttggctgttataaataatg

SEQ ID NO: 178683 - DNA, 557 bp, Homo sapiens
ggagtctaatggtagctttatgattcccttgtatattatttagaatttgcctatggataaaggagagttcatctttggaataatgcccaagttataagaaatagtagagggaagtttttatactcatttctatgtcatttgagtgccatttatccttgaactggttttatttaacagtggacttaaggtgtttatcggcctcagaattttttcatactcgataattttaagtcacttgttgactgccatgcaatcctgcagattttttttttccctgataagcaagtggttttattggagagcataagcttgtcagtcttacaaactccactgccagatagggtttctgcagtactgagaagggaaggtaattcagtgggagatttcacttatattaatgctcccaaactatataaggctttatttactcctggcatattttaactttgaaatcaggtgaagttattataggtttctgttgcatattctggcctcatttcttctttttgtcaacccacagaatcttcactatacaattaccgaaagtaataattttc

SEQ ID NO: 178684 - DNA, 368 bp, Homo sapiens
gctctgacccaccagcagaagcacaaaagagaaccagggactggctttggttcgattgcgagtgtcccagttagttctgtccatgaagtctgtcaatgactgggcctaacaatgtgtgcctctgcccggtgtcagccttgggggcctggaggagactttatcttaaggaaaaagtgcttgcttcagcacatggccagtggggcctggctgtgacagcaggcagctctgctgtggcagctcagctgtctgagagcacttccccttgggttccccgcagagcaggagagaaggtgtctaggcctatgggcttggtgaccaaactgcatggtttctggtagtgtgcctggaactcctgctgtgcaagattt

SEQ ID NO: 178685 - DNA, 704 bp, Homo sapiens
tcaaatgtagactttgtgaaacttagtaaaatctagaggtcataatttaactgtaaggtacaccatccatgcatatgaacatgagtgcctggtaattacaggccaacaagttatactgggtaccacttacgtgcctaataccccacagataaagatttgttgtatttgagcctactgacaaattcagaaaccaaggccacaatcgtgtacacaactagagatctacaatctaagaactgaagcatatctttccccaaggtaaagaaaatataatctactgcttgttcatgcagaaatacagacatacgtatcataggctcattgcccaattctacattctagctaaattgctctaaaaacatatgccaatctaagagttactcaaaggcacatttcgccaacttgaaatgcaattctgacccatgctccttgtaattttattttgccactggacgccaaggatgcatctccgagtaaaaaaattacttaattcacattgtgggatgaaaattcaaatgtcaaactgaaacgccagccagccacctgggtaaaagtgtatacatttcatattgactacccaaattttcagacccgtcaagaggcaaatcagaagcacacagaaaaacagcttcaacctaataaacgtgcttgattggttaagaggaggcctgccaggcattttcccttgcaataaatcttacttc

SEQ ID NO: 178686 - DNA, 180 bp, Homo sapiens
caggtcagtttctcctctgcccaagccttcttccttcattcctccacagatgctgatcctgagattcctttccagtaaacttcctccatgcaatcttcatctcaggagtctgtttcctggggaaactaacctgcaactgatacaaatgcctattctgtgagataaaacactaaaagtaca

SEQ ID NO: 178687 - DNA, 295 bp, Homo sapiens
aagatctatcacaccacagtgatcatagttaataatacatcgcatctttcaaaatgactaaaagtagattttacatattctgaccacaaaaaaaagtaggtgaggtgatataggttagagttaaggttatgtgaatatgttaattagcttgttaatatgttaattagcttgattgttaatgtgtttattagcttgattattaatatgttaattgacttgattgttaatatagtatctagcttgatttaatcaccgcacaatgtgtacttggattaaaacatcacgtacctcatat

SEQ ID NO: 178688 - DNA, 105 bp, Homo sapiens
gtcctcagccccagagccttgtcctcaacctcatcttcacttccattctcagcgccgagtcccggatctggctatgtgagtgcttggcaggtgcgtgtccagcgt

SEQ ID NO: 178689 - DNA, 1046 bp, Homo sapiens
agctgaaatgctaccatatcataggcagctaaaatctgtttatccatttgggaaggtggcttttcaggtagttatttggctgctcacctggaagaactcacagttcatttttagagattggtttttaaactttggtgttaggacccttttatattttaaaatttgttgagaacccgaaaatgctttgtttatgtagttataattaccagtatttactgtattataaatgaaaaattagaaattaaaaaaattacatattaaaaaatgataaactcattacatgttaacatacataaaagctttaagaaaataaactatttttcaatgcaaaaaagaaattggtgaggagagtggcattgttttacctttccacacatctttttaatgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataaatgctatcagattcctattttgtcaagatgctgtagtcacactttaaattatgaggctcattatcataatcattctgatccaaacaagttttctcccttacccttagactctcacacctacctaccctctcctaaatacatactatttatattttgaaaatttttactgctcttttaactgcgatgtttagagagtccttacattctggcctgatctctaaatctgctgtaatgctatttctgtgtctatgctggaaaaaaaaaatcattgatagtagtatttctgtgtttattgtggaaaaaaaagtgaatgattacctagttcaagatattctctaactgaatgttgtgggtgttactagtgaattttgctttcttgtctgataaatgttcaaagaaacccttttgaagattcatgattagacagctgctatggcatagcactttaaaccatgcctcctgtaccctaccgcttctctagtgtttcattgtggttataccag

SEQ ID NO: 178690 - DNA, 206 bp, Homo sapiens
ctcccgatctcaggtgatccacctgtcttggcctcccaaagtgctgggattacaggcgtgagccactgcacccggtgacaagagttgtatatttacccacatatcaaccattgctgatactcttcattctttagtgtagacccaaattttcaaataatactctttctttctgattttatttcttgcattgcagttctgttggcagt

SEQ ID NO: 178691 - DNA, 270 bp, Homo sapiens
gatgtggcaaggcagatccctgcttcagagctgcctgggaggactgagctgccagaaccagttcagccccaccacagcccaactcaaattgaaatccactttattattagaattttggtggaaggagaaagcaaatctgagagcaagccaagatgttaaagtggattagctggagacagtccaaggcaaacaaggctcaagtgagtacacttgcagttctgccaggggaaggggtacaagaagggagatggcatggttggagggagggga

SEQ ID NO: 178692 - DNA, 569 bp, Homo sapiens
ctttgggtgatggtcccttcttttgaaattgaggaggcagccttggtgatccctgaatggccttgtcttaaagaagattacacatacgcaactgaatagctctgtggtccttgaaatctgaaagccttccctcattgggttcaaactggcagttttcctgttggggtgactgattgagttcttagtttacacctatgctaatctctttatcaaatggtcacttggccacatcctaattattcacatcctattattgcagtctgtgcaatttagatagactgagaattttccaaatcttttagtactgctttcttcttgcttaataattctgtctttaagtcatttctcttttcccacattttactacgagcagtcaggaggaaccaagctgcaacttcaacattttacttagatattgttttagctaaatatgcaatttcattgcttgcaagttctactttccacaaaacactagaacatgaacacaattcagcctagttgtctgccactttataacaaggattgctttttctctactgtccaacaacaagttcctcatttctgccaga

SEQ ID NO: 178693 - DNA, 432 bp, Homo sapiens
aaatacatagaagtcctctaactggaaaccataaaatattgctgaaagaaattaaataatatctaaataaataaatagtctgggcacagtggctcacgcctgtaatcccaacaccttaggaggctgaggtgggcagatctcttgagcccaggagttcaagaccagcctgggcaacatggtgaaaccggcgctactaaaatccaaaacgattagccaggcatctggcgatgggatgccggtaatcccagcaacctggggaggctgaggcagcgagaaatggctagacacctgggaggcaaaggatggcagcatgagcggagactcgacaccacggcacatccaggccggggactgacagcgtgagcacacatgtactcaaaacaacaaacaccaaaaggccacgacaccgcaaaaaaaacaccaacgaaggcc

SEQ ID NO: 178694 - DNA, 337 bp, Homo sapiens
acctactcaatgttattttctttgtgaaacctttctgaagctcctggtgtttccccctatttccataataatatctttctgtacttaatatgcttaattatgcatatttatgtcaggttaccataccaacctataaaatttggttagaaaggcaatgcattctactcacctttataagcatacacacagaaataaaacatacaaggctcttagcacatgctgttgaatgagaaataagcctaaactaatgttatggtagacaactaacacattagaaagtacataggctttggagtccaacagacttagattcaaattctagacatgccagttttca

SEQ ID NO: 178695 - DNA, 478 bp, Homo sapiens
tgcagaatgagtctttacctggttttaatatttgcttcctcttttgcaaggcagccttatgcttttcagagctcatttctactacataatttatgatagcatttagttgtgctttaccttgttggcttaatcttatacatgtaatttgcatgcaactttaaaggtgattgtaatgtaaaaagaatttggagagaaatataccctgggctagacaatgcaaacaacaggcatttttaagtggcagctggcactctaaatgttaaaataaaagccaggaaggaaagaatggaaaaaaaagaaaaagtgaggaaagagaaagaaggaagaaaagagagagagaggaagacacaaaggagaagagggagaggaaaacacggaaagagatactctaacggatggaagaagatgagaagactgagaagttgactgactatgagaaagggaaggaaaatgtctctggtcagaaacacaaatgaca

SEQ ID NO: 178696 - DNA, 307 bp, Homo sapiens
agaaggtttcaggaaactgtctggactctggaagtttacagtatgattaaaaatggcttcagcacggcaatggaaactctcccttctcttcccttggagtgtagttgtgctctgttattccggagagctgtcgaaaggtgacctggttgtgtggaaatttccactgaaatcactgtgctttatttggagcatctttggtggatgttgctccgagaacaaagcctccggttgccctgtcccaaaaatggatccgggccatgaatgaataaggcctcagttaggatagcagattgagttaccctccctt

SEQ ID NO: 178697 - DNA, 631 bp, Homo sapiens
agttgttttgaaatatattttcttataggtttgcatataaccacctgtacagaagggagaagaaagaaacaggaaaaacaatgtaaatttccactttatttggaagaatgggctgacaaaaaagtttcatggactatatttttgaattcaggagtcatttgggattgacttttgtctttaaatgaaatctttaagctttaaaaatattttaaaggtaacattgtgttctgagattcataagaaatatgtgatggaaaggaattcttgtttgtggaacaaggaatagcagtgattgtacaaccgggtgcatgctggcttcttaaagaccttgcactgagaaagtaaaataagggttttcctgagaatcgtgagttgtgttgagtgtgtatgttcttttaaaataaaatcgttctttagccacagatttggccactggacgcttttgtcattacatacttttattttcctcttgtaacatttttggacttttgaattctctaatatgcaaaatagaggtctttgagacaaccgtttagaagtaggttgatcattaggatgatgcaatacattttgaagttagaagaatctacaagaaggaagttgtggctgtgtccactcaggtgcatttttg

SEQ ID NO: 178698 - DNA, 277 bp, Homo sapiens
gggccctggtgggaggcggcggggttgagagcgtctgcgggtccccacccctgccacgcagacgccccagagcgcaggtgcgccctggtgggacctgagtctgcactaggaaggtacaaagctgaaaaagcgatcacctgtgggaggttaattgcaggtcactttttgttttgtttttactttgtacttttctgtgcattccacgtattcctccttgatctgggtgactttcgaaatgatggagaataaacatttttgagatataagctacacaccg

SEQ ID NO: 178699 - DNA, 659 bp, Homo sapiens
cagacagaacacttcatcaaagaaataagtgtttcttttccaagttaaattgatatatattataaccctcactcgtactcaggcttctactccttggcccagctccaaaagaaagaagagtgtttacttataaataattctctagtccaacctatggaccgcttaggccaattctttaaaacagaattctcctaatagccaaaacaggtaaatatccaagtgttttttttcttttagaaactactttaagattgtgttaacagcagttatcaatttgtgaaaggaaaaattatcatcttttttatataaatgttttatgtatgtacttggttggatggggaatatccctgagggtatagtcaacacagaaaagcacaataaataatgatatttcgctagaaaataaaagccatatttagtgtttattcaggtcacacatatattttgagttccactgtgagcctgtctctgctaggcttgaaatatggtaataaacaacagatagtctttgtctaaaggcaacctggaatctgcctccaagatcataacatttttgttgcttttcatgcttttgaattgttgagtaaaaatggaagctttaagccagtagggcatcacgactatatatattttttatttcaaattataatacttcttta

SEQ ID NO: 178700 - DNA, 794 bp, Homo sapiens
tattttagcaacatcattaaggttcaatactgaactggggttctgcttgatctaaattcttgtcttccagcttaagttttgggcagttagagttagaagatgctatttgtagtgtagtaactaacagcaagaatttgagatttttgagatataggtttaaagtaaagtatgtatggaagactgcctctgatagtctctaaggcttgttaagacctgtggagaaaattcacatacatatatgtgggtactatggttatggaatactaagtgttctagttaaaaagttaaagtaccctagttaaaaaggtgtttttaaagtttgaaatattatgcaactggggcagtaatgcagggtggtaaagtgatagtaaaataaaatatttatatagatgattgttgatttgtagtagaggaactttaaattagtagatgaggaccttatatgtttgaggttaaataaacaatgatttggggcataagggaaataaatattatgtataaaagggaaaagatacttttagaactatcagatgctaaaagagaatctatcaaatttagagcattgccaaagataagttttggtagaaaagtttgggaatcattaatttagttttttaaaaaattattattatactttaagttctggggtacctgtgcagaacatgcaggtttgttacataggtatacacgtgccatggtggtttgctgtacccatcaacctgtcatctacattaggtatttctcctaatgctatccctcccgcagccccccacaccccgacaggccccagtgta

SEQ ID NO: 178701 - DNA, 188 bp, Homo sapiens
tcgactctacacgatccctttatttatcgatcgttatgaacggagtgataaacccaatcaaaagcagacacagacccaactatatcaattgtaacattagatgtgaatggagtgaacaacccaatcaaaagcagacacagacccaactatatcaatcgtaacattagatgtgaatggagtgaacaacc

SEQ ID NO: 178702 - DNA, 226 bp, Homo sapiens
agtcctactcaaccccttcatatgatgatatctaatccttctagcctgccctcgccctcaaggcaagtaatgttatcccagttagacaaatgaggaatcagatgctcagcaaagtcaagtcactgtccatgccctccttccatcagggagtcgctgagctgggatgtaagcccaggtctgtctgtccctaaagcctgtcactcctccatcagcccctggaagatca

SEQ ID NO: 178703 - DNA, 275 bp, Homo sapiens
caaaaccttagcactattctaaaaactgacagtctgaagaataaagtttgaattttgaaaaaggggggaatcccttagtagtgcatatgcctgacagagtccatttactacattcattgattgactatggaacagcatttagtttggctacaactgagtttactcactggggagaatatttagcctggttttgagaaaacagtttagtttctgataccatgccaagccctttgtccctctcactgcacagtgatggtggggagagtggataggtc

SEQ ID NO: 178704 - DNA, 283 bp, Homo sapiens
acttttctggtgtcccttagcatttcataaacaaaacagtggcccatcttcaggactgttatgaggcaaaattaaatagtaatctagattgagtttcttggagaaataattacatgactagaaaactgttatgttacttaagtggcaattttaagtaataaattccatggcaattgcagttttgttctccttgcctgctgcaacagctttaaagttatcttctagaagctcctctcagtttctgagacaacacaattctttttttcctatctaggcttttttt

SEQ ID NO: 178705 - DNA, 487 bp, Homo sapiens
acacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcat

SEQ ID NO: 178706 - DNA, 523 bp, Homo sapiens
ggctgtggggagttgattcggaagtgaagggccctgggcgacccggcgagtagaggcaacaccaacactcctccttagcgaggggtctccccgccgcggtggctgcccggccccaaggacaggagggatttgtgcactgactcctgaccccgtcctccagcgctgctctgaagggagagtctgtgcagtggcacctgcgcgaagctggccaaagcctgcccagacggctcacctgtgcgggatggaacaaaagaatttcgctcttgttgcccactgttgtccaggctggaatgcaatggcacgatctcggctcaccacaacctccgcctcctgggttcaagtgattctcctgcctcagcctcctgagtagctgggattacaggtcggcttgaggtttgcgagtcccagctcccactgcccctgccacctgcctttcccttctcaggacatacacaggactgggagaaaatagactaagtatttgatattacaacaacacaaaacaaaaaaacaaaggcggcgc

SEQ ID NO: 178707 - DNA, 515 bp, Homo sapiens
ggctgtggggagttgattcggaagtgaagggccctgggcgacccggcgagtagaggcaacaccaacactcctccttagcgaggggtctccccgccgcggtggctgcccggccccaaggacaggagggatttgtgcactgactcctgaccccgtcctccagcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaact

SEQ ID NO: 178708 - DNA, 249 bp, Homo sapiens
gcagtgggaaaatcgcaaggaagccggcgctgctctgaagggagagtctgtgcagtggcacctgcgcgaagctggccaaagcctgcccagacggctcacctgtgcgggatggaacaaaaggtgagccagggggcctgataaaatgacctcagtagccgcctgtgggaggggaccctgaggaaagcaccatagtgactaccaagcctggatggttttactgcttactttgttattttattttattttatt

SEQ ID NO: 178709 - DNA, 361 bp, Homo sapiens
tggatttttagtacaagatgggggtttcaccatattggccaggctggtctcgaactcctggcctcaagtgatctgcctgcctcaggctcccaaagtgctgggattacaggcatgagccaccgtacccggccaatgatttctttattgagaaggagattggcatctagagaagttaagtgacttaatctcctctcagggtaagtcagcattggagccaggttctcatggtttctcagtgtgtacttcatatcctagattagtggttctcagagcatgctttggggatccccaaaggttcctgagaccttttcaggggtctgtgaggtcaaaactaattttatagtaatacttaagacattat

SEQ ID NO: 178710 - DNA, 261 bp, Homo sapiens
gcttaatgtcttttattttagttcagagtccagttctaaagactggattacaaatcatttcattccttaatctcttgcaccaagtcttagatgaaagataaaaaaaatatatataccagtgggatggccagtgatcgaatttaactacttaagatatacacaggaatagtttctcaaagaatagtcattattctagtttagaatttccttgagcagttgttgccttcaaaatggcatatcttgaaagatctctatgaggag

SEQ ID NO: 178711 - DNA, 346 bp, Homo sapiens
ccaggctggtctcaaactcttaggctcgagtgaactgcccgcctcagcctcccgaagtgctgggattacaggcgtgagccactgcattccctaggcatctagacacagcagtatccacgtgggggctgaggtttctctgaccatggctccctgtttgctgagttccaagtctgttgcccactgtgggagccgctgtgggaccaggggcaggtgacgtgaggatcatcggaacggatgaatgatgcgtgtggaacaaccagcactttgatccttcgcaggggggctcctgagggaccgccctccatattgtagggaaaaaggctcattcttcagtcatgctctagtg

SEQ ID NO: 178712 - DNA, 606 bp, Homo sapiens
tcaattacagttgacccttaaataacatggaggttagggtcattgacccctgtacagttggaaatccatgtataacttttttttttttgagacagagtctcactctatcaccaaggctggagtgcagtggcgcaatctcagctcactgcaacctccacatgctggattcaagctattcttgtgcctcagccacccaagtagctgggattacaggcatgtgccaccacgcccggctaatttttgtatttttagtagagatggggtttcatcatgttggctaggctggtctcgaacccctggactcaagtgatctgcccgcctcagcttcccaaagtgctggggttacaggtgtgagccactgcgcctggccccatgtataacttttgactcccccaaaacttaattactaatagcctactattgactagaagacttaacaataatataaacaattaacacatattttgtatgctatatgtattacatactatattattacaagaaagcaatctagagaaaagataatgttattaggaaaatcataaggaaaagaaaatagtattttctactcattaaatggaagcgggtcctcataaaggccttcac

SEQ ID NO: 178713 - DNA, 333 bp, Homo sapiens
tttccgtccttgactcctctcactgctaacagagacagaactcatttacttactcttctgactgtacctttgctttcacgagggctctttcctggaatgatatgtccatacaactattgttgttgttcttacttttagctcttttcttagcccacttgtacccaggtttgatcacaccccctactctcctgccctggaagtaactactattctggttatagtctcttaatatctatatctatatatatgcatccacagataatgtgtagtattgtcttgaaaaaaatatacataaatggtatactttgtctccctctgcgattattttcactg

SEQ ID NO: 178714 - DNA, 639 bp, Homo sapiens
aatgttggactcctaggttaagtggagacagtaactatcacattacagattaaggtttagaaacctgatcacttctgtggctgatcatttcctttaaactttcagttccgcaaatgccagcgagcaaatggtgctttgagtcacagctgcaaaaaccatgcatctaggcctttccagggctgcatagtggaaagtgaagttaacatgtgaactgggtttttaagatccttctgaaaaacgtgaattaacgttaaagtgtcaaagattaactcatttctgataactgtatgtatgaaagtggaaaaaccattcggagcaagattcagaggaaaccatttgacctatataaaatgtaaattctgtgttgttatattttaattatctgccattctttaatgcaactttagttctctgtattctcttttaaaggagattttttttcattcaggatcagagaaagctgtattttctcaaatgttgatgtgtttagaaattcctggcctctgtgcccagttgcaagccatccaaaatgacattgttcattttatttacgtttttgcaaataattgccctgtgtcatgaaccttcccatgtctgctcatcagagataaggagaagatcctcttgagccctcccata

SEQ ID NO: 178715 - DNA, 296 bp, Homo sapiens
tctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctc

SEQ ID NO: 178716 - DNA, 412 bp, Homo sapiens
tggctagggtatcagtctcagttgcagaaaacaaacatttctaactagtttaagcagaaagaaatttgacatcagattgcaagtggcttacaaaaaaatatttgggaggagtagaagagcaaatcccaagccaaattctcaggacattttcctgagtcatgaaatcacacattgtgataagtgacatgggaattatagaacaggacctaaagagaaacaggagacaagaaaagacccaagagctccacatcatatgtgttagtttctcatggttgctgtaatgaagtacaacagactgggcagtttaaaaaaacagaaatttggccaggtgcggtggcttacgcctgtaatcccaccactttgggaggcagaggcaaacaaatcatgaggtcaggagatcgacgccatcctg

SEQ ID NO: 178717 - DNA, 266 bp, Homo sapiens
tgatgatagctgggagcaggaagataaggagttatttacgcaggagggctgtgtgttctggaccatggagaaaggcagagttacatagtttgtcggccttcttcttctttttttttttttttttttttttggggggggggcattaaggtttatttgttttgcccagcttacctttttgttcttagcttaaggggatcttcccacttaaccttcccaaggggttaggtttccggccttgacccattgaggccggtgtgccttacaat

SEQ ID NO: 178718 - DNA, 449 bp, Homo sapiens
gctcctagggaagctgaggtgagaggatcgcttgagcccaggagacggaggctgcagtgagccgtgatcatgccactgcactccaacctgggcaacagagtgagaacaaaaaatccagggcaacagagaacaaaataaaaatgtggtacgtatacaccatggaatatgcggctataaaaaataacaaaatcatgtcctttgcagcaacatggatgcagttggatgccattatactagaagagaatttaattccggaacagaattaacatctaaacctatatgaagttcttacttgtaagtgggagctaaacattggtacacagggacataaaggtgggaacaatagatactgatagacagtagagagaaagaagagggaaaaggctgaaaaactacctgttggatactatggtcactacctgggtgacggaatcatttgtacgccacat

SEQ ID NO: 178719 - DNA, 377 bp, Homo sapiens
cactaaatggcaagactaaaacagctgtaacacaaacagtactgaaacacacccacccgtttgccattttgtgggtgacgaaaaggagagaagtcctgcagcctatgtctgggaacccagacctcagggctctttaagccaggactgtgacatgctgtaacaacctctttgaggctctgcagtttctgggatctccaagatttcgggcgccactgcattccccttgtccagatgttggtgcccacagcagaagtcacctgcagtacatctggtacagctgcagccttgcatggagttggcacctgtgccagcacctggagctgcctgtccatcacagctggcatgcctggctgtgcacagtggccaggccccacgct

SEQ ID NO: 178720 - DNA, 108 bp, Homo sapiens
ctcccttctacctcttcatagacttcagttatacatatattaagccttttaaagtttcctcactcatagatcctttttattttcttcattttttactgttttgtttta

SEQ ID NO: 178721 - DNA, 263 bp, Homo sapiens
cctgctcccccacataagatgtctggctctccattcaccttatcatgattttaagtttcctgagacctccctagaagtcgagcatgcttcctgtatagcctgcagaactatgagccaattgagcctctttttttttttatgaattacctagtctcaggcatttcttttctttttttttttttttttttttttggaaacagagtctggctctatggcccaggttgaagtgcgggaaacaagacgggggactcctcaagagtcgc

SEQ ID NO: 178722 - DNA, 241 bp, Homo sapiens
ctctggccgttcctcaaaaaatacacaaattgaatcaccatgtgatccagcagttccacttctggatatatacccaaaagaagtgaccgccgggcctccaacagttacttcgcatgctaacatccataacagcattattcacaacagccacaaggatggatgccacccaagtctcctctggccgatacctggcgaaacacagtgtggtacatacataccaatgggaatcttatccacgtct

SEQ ID NO: 178723 - DNA, 436 bp, Homo sapiens
gtgtatgcacgtacaggcatgtaaacattagaacatgtggacagagatcacttcatttccacctgaattacatgcatatttttgtgggcacaggaagaagtctggaaagatatgcaaatatatctgacaatatgagttacctgggaaggcaggtaatccaattcatgccatgtcatatgttaccagttatatgagcaggtagtgctttatagtaaaatgtatttcttaaacatctgtcacatatgttgaaagtgaatggtgaccatgaaaattgcatcccaaggggcatggctcacataaccgtctttcccctaagagcttagatagtaatcacaccacaaagaaaagaaggggtgatgttggtgaaatagtggagcaatgacctccagaaattctctcctctgtaaaggcaatcagaaaactggttaaaaaaaaa

SEQ ID NO: 178724 - DNA, 815 bp, Homo sapiens
acagatgagatttctgctatgtgtccattcaaattttccatttttcctgcatgatttgttaattgtctattcctaggaatttgtactttcatctaaatcatcttttgtggcataaagttgtttatggtacctacctcaattcctgtaaaatcagcagtcatgtcccctctttcattaccacccccgcccgccccaaaaaaaaagtaagagggagagatggagtcttgctgtgttgcccaggctgcccttgaactcctgggcttgagagatcctcccaccttaacctcaagagtagctgggactgcaggcacgtgccactgcaccctacttgtgtatgttttggttcatttcgtttgggtttatattaccattgttattcaatgttatgtgtagtcagggtgataatagattagcaacaacagtgctattaacaggtattatgtcttgtttctctgctatgtttccaagaacaaatcttaactcattgagtctgttcaaaattcacagttctgtagagttcaccgaggagaaaacagagacctaaagaggcagtgtgacttgcccaagatcaggtagtcctgggttcaaacccaggttttgcagaaaactaattccatgccttttgccataggtaaatgagcaagggaaaaaacaatttgcaaaacaaatttgtaaacaaacatctttaaaatgtatctttctagtaatcaaagaaagaaataagccagattaaaaaagaaacattcagttgagaaaacttaaatatgatactgaggaggatgagaaaagaaatttctttaagtctcatgtatggg

SEQ ID NO: 178725 - DNA, 415 bp, Homo sapiens
taacaaaatttacctactaacaacattctggcactaaatgactctacagtgaagcccctgccatgaagagctgctctcctatgggcaacccatcaggatgcactgatctgaattggcacgtgagtaaaaggtacagcctgaaaccatcaaattagcacccgttctccaggctcctggacccaagacatattagggtaagtgcaacaaaatttagatggaggtgaagtgactcttaaaaagcgtgaaatacggacgcagtggctcacgcctgtaatcccagcactttgggagcccaagatgggtggatcacgaggtcaggagttcaagaccagcctggccaagatggtgaaaccccgtctctactagaaatacaaaaaaattagctgggcatggtggcgggcgcctgtaatcccag

SEQ ID NO: 178726 - DNA, 695 bp, Homo sapiens
gatatactttgttttaattcatttttgctattgggagtagatgaaataattcattaatttttaaaacatacgttagataaaggctgataattatactattgtagggattttacttgtgattaattataatgtgatgtaatatagtcaaagatctttgacaaaattgtcattatataaattaattggagtttttagtgttcaagaatatttcgtggaaaattttaagtcatttttatctcaaaatcatgaggctaatgttaaatggttaggttgcttttttttttttcattttcaggatcatgaaaactaagaaagttttatagtggatgggtttaaagtgtagaatattttgagcaaattgataggaatcaactagaaaacctgttacaggtgttttccaaaatgaagtttgcatcattagtactttaactgtagaatttttttgttggtgcatttaccttctttatactgggtgaacaatagaaacaaatattcagctgtttaatgacatttcactatatggtctcaagtatttaatcagttaatagaaatatgtatatagctttatgtaacttcagtagtattaaaaccaagttttgattgtgacctaatggccaaatttaaattagaattttaaaagagctcttagagacttcaggtaagcattagattgtctctgaatcataatactgatt

SEQ ID NO: 178727 - DNA, 458 bp, Homo sapiens
aagtgatactcacagttttactgcaaaggaatgaccactttgtaatcaactgcagactttctccttgatctcagtatttaatattgttggtaacttctcctctaaaatattttatcatgtagctgtcatgataatattacacttgactctggccactcttgttttccttgcttccttttattaactcatcattcctgactgctcttttctttccatatattctctcaaaagtttagcaaatttcttggctttccttattgcaaatatattatgagaaatactcaccccaagtttccaaaatccctcctatcctccttacgctatgaaaatcacttaagcaacatcttaatttatgagaccaaagacatttaattcaaaatcgttcaatttccttccacctaaaacttttttctgtttttatccacttttttcccataaagaaatgtcctatttcatta

SEQ ID NO: 178728 - DNA, 411 bp, Homo sapiens
gggaaaacaaatttctattaactgcctacctaaagggagaactagaataatatttcaattacaaaagcaatccttttatatgctgtattttaaatgttctaaagaaatcaatggttttggcttggcatctatcttgtctatacccagatgtctatcggtgtgcactatagcccacagttcatccacagtatcttcctctaaagaaaaccatagcaaaggaaaacctggaagaaatagaagtcaaatctaaaacctagctgggtagattgtggtttgcaaacaccacagtaaagggacacttttaacaccctttcgccacttcacaaagtttcagaaacatcacaggtaaaaaccctctgcgaacgtcttctcatcagaccccgccaggagaaggaaattcgcttctctttc

SEQ ID NO: 178729 - DNA, 354 bp, Homo sapiens
tctggaccacatgatctgctaagctccttcccacaccaactccatcatcctgagaaatcaagatctcaggccaccacgtcttagcagcactgatattcaaagtgagcaaaacactcttctcaagtaggcagtgttactgttcgcatccttggaggtgtccacgtgcttcacagagcattattcaaaatggaacagggtttcaaatcagaaaacacttttcctatctagcctttttattgacatatggtatgcatacagaaaaatatacaaatcataagctctagatgttaaattttaatgaagagggtgcatacatgttactgacgccctaatcaagaaacagaacattactag

SEQ ID NO: 178730 - DNA, 269 bp, Homo sapiens
atgatctatttctatgctttaaaaaccaaaacagaataaaaaaacaaaaacatagaaaactccttgatggatttcccagttggggaagtgagaatttcccacttcaattcaacttcaatgcaaattcttcaggcattcaaaactccatcattgtggcttctacctgcagcctcattttctattattcttattcttttttcaaatctctcatcttttgctcatactcttcagcaatcctcagaactcctttgacctcaaggttctggttc

SEQ ID NO: 178731 - DNA, 323 bp, Homo sapiens
actaagacagcccacagagtttagcagtgaccccaaggaaaggaaagaactgcaagttgcctgagattaatgttgctcaggatccatttattccctattcctggtgtttctttgtagagagtgctccattaaagtaacacttttgtcctgtctctgcttcttccttaggcagcgatttacctaattggtgagtttaggattaaaaaaaggaatacatcctagaacatttcttaaatatattcccttttctctgtttcatgcaaacatggcttatttatttttcaagtctttctcatttcttacctggatgctttcaacacagg

SEQ ID NO: 178732 - DNA, 510 bp, Homo sapiens
tatctcctaggaatttgatgggtcacttgacatcatgaattttacacttttgagtcctgggttttgttgtactatttcaaatagtgttaagttttgttaggcagactggatgatctttttgaggataacttacagctttttcttgggaggaaccagtctgcagcagcctttactatagggctaggatgatcccactactaaggcatgagcattcttaggtctctacagaatgccttgtgtgttcaataaggttgttttcacattgtcttgtgggaactcaagctgttagtgagttcagggtgtttttctgcctgtaacacattggtaattgtttttttacccagaaattgttctttctctagtatcatgaagtatgaccatatgcatgttcagattagttttagctaaaaactgaaaccttatacatatttatgcagtttgttctctgtttaactctcctttctgatgttctgccccacagttcctctatggccacccataacttccatc

SEQ ID NO: 178733 - DNA, 511 bp, Homo sapiens
tcaagtaagatttcagttgggttttctgaggatctctgaaaacctctataatctacatggaaaaataaaggtccacaaataactaaataaacgttgagaaagaggagaaaagtagaagtaggggagggagtgtcccaaccaaatccatggatgtactacaaagccactgtcatagaaacaatttcgagcaagaacatttaaatggacaagtagaacagaacagagggcaagcgtcagaaacagactcatctacttataagaatgtaatacataataaagttggtagcataaatcaagaaaagatgaacattggagtttaaaaactgacataatagactgacataattaagtatctactcaatatcattagactaaaaaatagactcaggatggaaaataaagctgttaagataatatagaagaattaatgtgtggcaaaattgttacacatttctgttcagattactaggagacaatgttttcaatatctaaaacttacagataactaaca

SEQ ID NO: 178734 - DNA, 105 bp, Homo sapiens
actgagaaggatttctgaggctgtatcttgtttttgaagaagaatgctgtgattgatgaatgataccaattaacagcatgggaacagggccatacaagtcacgtg

SEQ ID NO: 178735 - DNA, 426 bp, Homo sapiens
gcctcatggtaacctcaaactgaagaacatacaatggataaaaaaacatagaaagacattatgtcatatcaccagagaaaatcaccttcactagaggaatacaggaatgaaacaaggaagagtagaccacaaaacaatcagagaacaaataacaaaatggcaggaataagtccttacttatcaataataacattgaatgtaaataggctaaattctccaatcaaaagacatagagtagctgaatggatgaataaacaagacccattgatctgttgctacaagaaacacacttcatctataaaaacacacatggactgaaaataaaggaatggaaaaagatgttccatgctaatggaaaccaaaaaagagcaggatttgccatacttacatcagtcaaaatagatttcaagataagaaccagaagaa

SEQ ID NO: 178736 - DNA, 152 bp, Homo sapiens
tgggagggggactgcctgctccacacacccactgtccatttgtgccccttgaagggcccggctgtagcctagcagagtatacatgaataggcatgattggggagggacagccagagcttgcaaaatgagctcccatggcctgggcatggtgg

SEQ ID NO: 178737 - DNA, 312 bp, Homo sapiens
ccaattctttgtactttgtattagcactggtatgtgcttccacgcactggtcatagtatcttacagcagccctgcgagccctataccaggtgccgatctcgagattcgtaagtcaatggtcagtagtctattccctgtttttaaatttttttcccgaaactatacactcctcagtgatcaaggaccaggcctttgacttcttttgtttttgtatgttgcctatttgtgcgttcccttggcatgcagaatgggatgttcactgctggactcctccacagataaggcttcctacctgctattaaagcccaagaa

SEQ ID NO: 178738 - DNA, 343 bp, Homo sapiens
ataaataaaaataaaaacttataaattcatggtgtctgattggaaaacaatttggttctatgtactaagctataaaaccacttctactttacttttttgtgtttttttaaaattttttaaaaaccaatttcttaatactttacattttattattaatatttatacttctaagtatttttcctaaggaaaaagtacttcccacagaagaaaaaaattaagtagatgagtatgttcattgcactgtaatttattatgccaaaaatggaagatactgggagaaaaattatggagcatcaactgggtaaactataatacaaacaaacgttaagcgtgaagggataga

SEQ ID NO: 178739 - DNA, 295 bp, Homo sapiens
aaagccatactacacttagacttaaatcccagtcatctattttaaatgcacttcaaagtttataatcagaaaactctaatttcaaaggaagcatttgtgtttgtttctattatataagaaagatacgattttttaaaattaaaattaaatggttatatacattgccctgtggctttcatttataaagccatgacttgttacgtatttgttgtgaactacacttcaaataatttgttgccatcaatagttaaaatagtaaaatttgcaaatgttttacttttttgtttttgtttgg

SEQ ID NO: 178740 - DNA, 217 bp, Homo sapiens
atcccaggccaagccaccatggtttggctctaatcttcctctcttgaaaatggaatcatcaaaaaagataacacctgatctcccagttttctgggaggagccgggcctgacttgtcacctgatgccaaattgcaaaacctacctaatataataggtggtcttcactgagccacctacaagagtgagatctctttctgtttttcccatctcttttgca

SEQ ID NO: 178741 - DNA, 815 bp, Homo sapiens
gtctccggagccgaggtccgctcggattgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctatggcaaacagctctgcaaatcagttgtgctttcccaatggagcaagtagagaaactttcaacacaaagaataagcttactgcaaggtagagaagtcggcattaaacatcaagagataccattcattcaacatatctatcagaagggcacgtccaccatcagcacaatgagatctcatactcaagaggatccttttctatgcaatgacttaggagaagatttcactcaacatatagcatgactcaaaatgtgattacctacatgagaacgaaacacttttgttaagcaaaaagttgggggaaaatcttcagctgactggttatcctttaaatcaaccacaaggaaattcacaccaaatgtaaatcataatgggaagtcatctatttgattatgccttttatccaaaaaattctgccttagaacaccacaggtggactctacactagagagattacatgggaatgtcgtggggggtgggaaaacttttggaaaaattttattttaggcgaattgggaatggtttcacggggagaaacaaaggagtacaagtggggaaggttacaatggcggttggaaatgaggat

SEQ ID NO: 178742 - DNA, 350 bp, Homo sapiens
cctagtagctgggattacaggcgcccaccaccatgcccggctatattctaagagatatctgtagatggtttatagaaatgcatttgactttggtaaactgatgaattactggaataaaaagattgtccaacaaactcttattccagtaatccctctttaaattttttaaggacaaacatatcatctgaaaatcatgatattttgtttcttttcatgacgtagatatattttatcttgtcttaactgtgctggccggactctccattacaaagttgaagagcagtggtgatacagagggcatccctgacttgttctgatgttaaaaggaaagcttttattgagtgataggg

SEQ ID NO: 178743 - DNA, 534 bp, Homo sapiens
ggtgagacagctgtgatgttgggatggtttgtagcctccttgtaatgaagacagttgtccctggcctattttaaaaatagttcaatctcctactcttatgctgcatacttagtctctgcccttatctttctgttccttttcttttcttccttacttccgtattctttcttccttcgggttttctagagtctaccaggcaacttaggtgacaagaagtatgccgggtcatgctgaatccattcattgagtattcaggcaaatattttagtagcagccttttcctcaattggtttgtgatcttataataaactgagcccactttgagttaattaaaatgaaaataaaagcatactgataagctgggaaaaatccctgtagggagagggaggcatctaaaccagaggttataacaaaaaggagggggctgccctgtgcgtgtcaggatgttcggcatcactggtgtccacccactagatgccagtggaaccagggtatttacatattttaacacaataaaacaacttgttgatgttg

SEQ ID NO: 178744 - DNA, 207 bp, Homo sapiens
tctgtttggttctgttggtcaatatgtctatttttataccactaccatgcagttttaattattatagctttgtaatatagcaagaagtcaggtagtgcgatgccaccagctttattctttttgctcaagattgccttggctggtcagagtttttctgtggttccaaatacgttttagaaccacagaaaaactctgaccagccaagaa

SEQ ID NO: 178745 - DNA, 436 bp, Homo sapiens
agaaaggacatgcaggtaggaatcttcatcagctttgtctactgatgtgtctccagtgttggaacagttccaggcacacagatgcttgatacatatttgttgaatgaatgaaaaaaaaaatctatcaagaggtgacagtcactacagagtcattttatttacagaacatgttatgtaatgtgtgactccattaacattaatgaaaataaagtgagccccataatgtcacgagcaaagaagacaattttcagaaaagcagtgtaaaatgttgaaacttgcaggaaatgagcaaagaccgggaggtcagtgctctttctactgcagcaataagagtgtaaacaagtttgactgtcagcaccataggaaagctaaaataaaaaatgaaaagacgtttgacagatttgttgttgttgttgttgagaaagagcctcactct

SEQ ID NO: 178746 - DNA, 133 bp, Homo sapiens
ttcatttcacaagaattactgaaaacacaggtggcatcatttatgtaataattctgtagatttttctgtcttaagcttaataatggtcctgtggatattcagatttcaagagtagtttttttttgggggggtg

SEQ ID NO: 178747 - DNA, 492 bp, Homo sapiens
aagaggcagaaaaaaggcgataaggaatgcaaatttatttcagtaacatttgtcataaaatactaagttttttcttctttgaaggattagtatatttgtgcttttactctgctaacctcttaaaagcaggcaggttgttttttttgtttgtttgtttactaagaattactaggcatgacttcaccaatgatcagttagcctccgttattataattttttaacctaaatgatttgacagtgataaatagctgatgtggcaagtctgcaaaaagctttatattgttattgccttttatcacttgtgctctaaataattgttctcatctgtcgactcttagatgcagttttgtgaggattaggatgtatggaacagaaaatcccgcctagtgattttttaaaattctctatttcttttccttcttttcttcctagttttcttcctcttctctccagtgtgtttacttatgaaagttgtactcatgatttaagatc

SEQ ID NO: 178748 - DNA, 462 bp, Homo sapiens
aaagcaggaaggcaggcaggcagatgtaaacagtaacaacactatcatcaataataattttaaaaaacaatgtaaaattgtttcacaattctttttcttaggagatatctacgtactgtatcatttgaaatcattcctctctgtgagtatgccactaatttgagacttaggttcattcatgtcatttcgctttcaaatttcagagattgctttgtttcatgattattttttatagtcgtgttaaacatttatatgcttttgaattcaaaacaaaaacaaaatagattcagacatatctagctgtgaatcctgtcccccaccacctggtttccaccctcctccataaataatcgtttcctgcaattgcttttagcataagcaaatttgtattcagattcctagttaaatagtagcatggtggacacattttttttcaccatgactttttcttacttagcagta

SEQ ID NO: 178749 - DNA, 202 bp, Homo sapiens
aactgcaagtgttgggcccaaaagtgtttctggtttactcttgaaaagaccactgaatatgcttctatacatactgaaccaggcaaatttatgcagtgtgttcaacatcatctccttatcagtacagcacagattccgattctttctactgcacccccaaggaattcatggcattattggtgcaattaataaagagaaaatg

SEQ ID NO: 178750 - DNA, 1534 bp, Homo sapiens
  misc_feature (3)..(5): n is a, c, g, or t
  misc_feature (7)..(7): n is a, c, g, or t
ggnnngnagttaatggaattttatcagcctttcccatttgtgtagtctgggcaggttaggatttccggggtggcttgaaggtggggccggaggcttgggagggacctatggatatctgcagggagggcgtgaccaaggctgcctggatgacggcgggggatggtggaatatatctccccctgccctctccacctgcatgtcccaggtccagccctgcccaagttctatcatttccccacagcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaagtgagcccctctgctcgcctcccacgagctccctgcctagttggggagctggcaagcaaacaggcgattacagtgcaggggactcgcgcagcagcgctaggctccacacacagactgcaggcaggcaggccctcatcctgccagctgtccttgcatccaacagattttttttaacagacagggggcggtctcactctgttacctaggctggagtgcagtggcatggtcacggctcactgtagccttgacttcctgtgctcaagcaatccttcctcctcagcctcccaagtgtctgagaccacaggcatgtaccacagctgatttttaagttttttaatgtagacatggggtctcactatgttgcccaggttggtctcaaactcctgggctcaagcgatcatcccaccttggcttcccaaagtgctgggattacactatgcctggcccctccaacagatttgaccgagtgtgtaccttgtgccatgcactgttctgggcacttggggtatagcagtgaacaaaacaagatcccagctctcaagggcttacattctagcagggagaaacaggcaagcaagaacacaagtgaaattatctaacaggttaaaagattatttgggccaggcgcagtggctcatgcctgtaatccaagcactttgggaggccgaggtgggtggatcacctgaggtcaggagttcgagaccagcctgaccaatatagcgaaaccccgtctctactaaaaatataaaaattagccgggcgtgttggcgggcgccagtagtcccagctactcgggaggccgtgacaggagaattgcttgaacctgggaggtggaggttgcagtgaactgagatcgtgccattgcactccagcctgggtgacagatcaaggatctgtctc

SEQ ID NO: 178751 - DNA, 293 bp, Homo sapiens
cagccggacccaacgctgctcacaaagtttgtgggctctgtccagcttgtcaaattttgagttgtgaattctctgaaaaagataccactgaattgatttgttattgatacaggccataccctttaatttgtggctaaaatggttgaagatggtaataatgatatgtagcaagtacttctaaactatccatattattccatttaatctcagcaacctcagggtaggttcttgtgttcaaggttaaataatttgggcagagtgtcctgcaaggatgatgtgtgtgagagcgttgg

SEQ ID NO: 178752 - DNA, 754 bp, Homo sapiens
atctccttctattttggtaccctgttagtaactgcaagagaccctcattcccccctacctccccacaccttgtttttagtgtattctaagcattttgcataaactattaatttcccaccactggtttttttgtttgttttgttttttaaggaatttgaccctcagagaagctgaggtttggtgaaaatctcactgcctgtaaatggttgaggccaggattaaccctggtctgactaactacaaagtccatggacttaaccactaatatactgccattctccagagagaatggaaacaacagctcgaactaaaacgagcccttgctagaggcaggagtgtttcatcttggcacaggggcagtactcacttaaatttccaactccctccaactccccactacccttgttgggataatgtatgcaaaagatctattttccatagagcccatggggagctggatgtgctagaatggatattattttaatctttagaacgagaatctttccatatccatatgcccaccattgctgtcctaatttcttaaacttcctggaattgtgtcacacgttgtttatcagtaaaatttcttcttccagagaatttgttaggtatgtggtttggaatgataggatatcatcaacttgcagggacaggcttgtaggaggtagttcagatattcttgtctttccctctagactatgagcagcttgggtgtaggtactgtcttatctctgtatctttttagcacctgtct

SEQ ID NO: 178753 - DNA, 387 bp, Homo sapiens
atctccttctattttggtaccctgttagtaactgcaagagaccctcattcccccctacctccccacaccttgtttttagtgtattctaagcattttgcataaactattaatttcccaccactggtttttttgtttgttttgttttttaaggaatttgaccctcagagaagctgaggtttggtgaaaatctcactgcctgtaaatggttgaggccaggattaaccctggtctgactaactacaaagtccatggacttaaccactaatatactgccattctccagagagaatggaaacaacagctcgaactaaaacgagcccttgctagaggcaggagtgtttcatcttggcacaggggcagaagcaggaagccctgcttctgcccggt

SEQ ID NO: 178754 - DNA, 581 bp, Homo sapiens
agagaactcaagggctgtgaaaagagcaggacctcaccagctgcacggcggtggtgactggctccatcttgctgtccctcccaatcacacaacatctccccttgaaggctctgcacaggcccggactcccacctttcaagatgtctggatcagtgcaggaccttctccttggccacatcgctctccttggactggttcaagtgattctcccacctcagcctcccaagtaggattgcagtgttgactcacctgtggagtggtctgagcctgaatgcccggggctgtggccaccgagtgaacgggctgtgctaaggggaattgccaccttgggaaacctgtgtagttgcggcttttctgattaagtatcaataaaagtctgaccttgtgaaaaaagcaaacgtgagtggccctgcttatgtttcaccttgcgttgctcagtgatagttctgcaaagtcgcaggaaacctggaatcatctaattatcgtgagtgttggtgagtaacacccataggcactggctcccggggaaatacagagtcaggttcctccgagccgctggccacagcatttttgttaagcag

SEQ ID NO: 178755 - DNA, 455 bp, Homo sapiens
atacaattcacttactgaagcacaggccaaaattccaaaaaatccaactttctgtactagtttttgaactgccagtttggcccgggaggcaaagtcctgtaaaaaggcaaatttagaaacattaatgagaagtaggaaaagaaggaaagatggttctttctagagtttattaaagatctcccaatctgatgacactgattaataagatgaatgatgaaaaaaattacagtaggttgttcactgaaacacaagtaaaataatgatagactattacatccttaaagttaagctcttaccacattttaagaataaaccaaaacactgtaaatttaaatttagtattctctctggatattctagggattaacaaaatactgtaaactaaccatgaaccaatttattattttggaaacactggcctacaacatctaccttttcctttcttctataatttg

SEQ ID NO: 178756 - DNA, 3156 bp, Homo sapiens
  misc_feature (558)..(558): n is a, c, g, or t
  misc_feature (612)..(612): n is a, c, g, or t
  misc_feature (1078)..(1078): n is a, c, g, or t
  misc_feature (2208)..(2208): n is a, c, g, or t
cacagctcagctgataatattctatcgctgttcactccttctcccaaagcagtagaaactacttggttggcagacgctctgctactaaatttagcaagtgtgtggaaagggagaaaaatattgttttgcccttattaaagcatggtgcagttttctgcccaggtgctgtagtctacctagaaacaaacaaccaaactgtttacaatggaattactatacaacaaattttcagcagtttttcatattattcttgaaagaagtatgtggggcaattcattgcttcatgtctaaaatgagagttcctgcaggtagagcaataaacacttgcattttggtaaagggaggatgagaaaaagcaacttctcccatttttagtgattatggacttagatcccagttcagtactgtttgcttccggatgtgctaccttgcagctaaaagacttcggaccaaatgcatccttaaaaaaaagaaaaaaagaaagaaagaaaagtgaaaatactaaaccttgaggccagaatagacaagctaaactggtgtcagagaaattaggaaatnttgccagttaacattctgctgcctcatacagtgatgagattggagaccttatangaaaacataagtgaaggagtttgtaaaaaaaaaatgttttgagagataattgatatagtgctgggctagaggtggtgactgcatgttttgctctacttctaagagctacttcatttctctaatttcctttgctactttaagcaatcgtaatgactcccaggactattataaagtaccttttttttcctcaactgtccacttcaggcatttcacaacagctgctttttatgattatgagctggtagcaaaggacctttggtattctcttgcaccaccctctacctagataatgctttgcacaaactaggtgcttaataaatgttacattaaaaagaagaatagcttataaactcacagtggaatagattttgggtacagcttttaatttaaacggaaggcatttttatgcactcacaagaacctaaacattcaaagaagagtagaatgtacattcccctagttgtcngcattgtatttgcttctaaagggttctcttgcctctcattgtacttccaggcacttgtatacttcatgcttttgaccagtaggtgtattattatctctccagcttcactgtgatacttcccagtatcacagcagcttgggaataaaaaaggttttgtcttttgagtgattgtatagtaccacacatgctggaacagtgacagtctcttgactgttgtgcagatgttgacagtatagtttagtacagttttgttctccacccagctgcctttatgtgtgagggacgaggggagggaatggagtgagaagctctaaaatgatgaagatttctattgataacattttacttttattctgcttatagtacaataaattcaggaaggtggcagaatttttctgttttcaaataaataatgttgcctgataggcttacaaacagggattggggcatagctgacagtacataagttatagtacatttttgacaagtaatttcatcctgtaattaaagttagataatggtcactgccatgttaacattatcaagtgtctgtaagagcatgaaggctacactcacctttacttcatcaaggttcttccatgctggtgagttttcttatgacattgtctactaggcaaaacagatggatttttcctcattcaaatgtatgtgatatcaagaaaatagaaatcagaagttgtgtttgtgggatttttctgcctttctctaggtgtgatatagctctcacttcaaatatagaaagaaacccgagcctcagctaaaatgagatggacacttttcctgaaagagaagaaactgtgtctgggagcaagttgtttaattgtcaattaaccaaccagcaaacaaacataaattataactgaaagaaagcaattagatctttcataatgtgggcttttaggtcttaaggataccagatggttccatgacattctgttcttcctaaatggttatctattgcctcaagatagccaaatgacagtgttggaaaggcaactttgagaattaggataaataaggtatcagttgtcttaatggatgttaataacatccacatgacctgaaagggataagaaaatattttttcagatcattgtagtaaaaatgcnttattaactcatcatttagatctgcttggtattagattgagtgacattgtttttaaaagattgatggagaaaacaatacaatctgggaagtaggaccttatcatttttatttgagaaataatgggacttccaaattgcctgggcacacaaacacacacgtacatgagtgtacaaattagtggtcaattcaaaacaatgtatacagatgtgcattgctttctcactggaagattataggaaaatatttttacagtattcctccaattctaagaatgaaataaaaaagttcactgtaaactattataaatatttgatatagtgatgtcactctgaggctcaggaaaagaaccagggctttgaatgttcaactccaggcagttaactttcagaaaaaaataaaaaataaaaagatgctttgctcagaactcaagaggaagcaagaataaaaggaggcttgatttaaatgtgtgtgtgtgtgtgtgtgtgtgtgcgcgtgtgtattctccctttgtatgtgtatggtgattttcaggaagcccaagcataggactcagtttgacatgcttcctaaaatattatgtcaactctcaagttttacttgcatcagtattaagttggctcatgaggaaaaggaattatttgttttctgatttgaggcaggagtttgttttttgcccagacagtgagtgaacttgaagggcttagaaataaagggcctcccatagagaaaaggcaacctggacagaaatgcagggggttggcagtagagactagaggtcatttgatctctttaagccatgggagcatcctggagtctgatagttggctggattttgttttccatttaggatcacaaattagcttaaaattgtccacattggattcttgaatcctgagcttcttggcattgccttcaactggtgtggaaaattgagaaaggtttcctca

SEQ ID NO: 178757 - DNA, 1316 bp, Homo sapiens
tgtgtccccttaagcatgtctgttatgagcttccttgacttcacacctctcagatttgacaaacatgaggagaaacaaagcaaactctcttttctgtgggttaatttgtctctcattttgggtccttcgtatatcagagtgtgaatgatactttattgtcctcacttgtgcttcaattcgtggctgttttgcaggaggagctcctaaaaaaaatgcagtctttatgggaaaaagcttgtgaaaatctcagaaatctgaacatggaaaccacaagaaccagatgctggaaggattatgtgagtttaaggatagaagcaatcagagctgaatatcagaagatgcctgcatttctccatgaagaagagcaacatcacttggaaaggctgcgaaaggagggcgaggacatttttcagcaactcaatgaaagcaaagccagaatggaacattccagggagcttttaagaggaatgtatgaggatctgaagcaaatgtgccataaagcagatgtggagctactccaggcttttggagacatattacacaggtatgagtctctgctgctgcaagtgtctgagcctgtgaatccagagctcagtgcagggcccatcactggactgctggacagcctcagtggattcagagttgattttactctgcagcctgaaagagccaatagtcatatcttcctgtgtggagatttgagaagcatgaatgttggatgtgaccctcaagatgatcccgatatcactggaaaatctgaatgttttcttgtatggggggctcaggctttcacatctggcaaatattattgggaggttcatatgggggactcttggaattgggcttttggtgtctgtaacaattattggaaagagaagagacagaatgacaagatagatggagaggagggactctttcttcttggatgtgttaaggaggacactcactgcagtctctttaccacctccccacttgtggtgcaatatgttccaagacctaccagcacagtaggattattcctggattgtgaaggtagaaccgtgagctttgttgatgttgatcaaagttccctgatatacaccatccccaattgctccttctcacctcctctcaggcctatcttttgctgtagtcacttctgaccagagaaaagtcagaaatgtgcctgtatgctctgggaacctgtttatcccagaaagccctctttttcgcacctcatcaaacagaacaaataagttatatttaatgtctttagttgcattctaatgtcatcaaaactcatttatagtgtttctattaaatatggtgaaaacatt

SEQ ID NO: 178758 - DNA, 293 bp, Homo sapiens
ggaactttagaaagtaacttagttttatattaagaagtatacttttttcattaagtttgttttgaggtcaggtgctgtggctcagtcctgtagtcccccacccaacactttgggatgccgaggcaagagaatggcttgagccctgaggtttgagaccagcctgaacaatgtagagagaccccatctctataaaaaattaattaattaaataagccagacgtggtgattcacacctctggtcccagctacttgggaggctgcattctggcctaggtgacacagcaagaccctgt

SEQ ID NO: 178759 - DNA, 1054 bp, Homo sapiens
tcaccttgtggcagctggcatgtgatgccgtttctggggagacactagcaaagttgatctgacaagtaaagaggagagatgatggttgtaaggtgcttttgtttcaaacttctttcttgacctgtcaggttttgaaggcgcctcaatggctcttttttgtcatgtgaaaattgtagtcttaggtagttatgaagcagttatctcttctcaaattgtgaatgctgctgtttaattgattcacttagcatttgaaactgtcacgcattaataattgcgaaatcctgtagatactgcgtgagtgtgtcatgcttaaatgtgtagttatcagaaaattaatatccttaatgaaccggtgctttcaaactaacattgcatgaaatctcttttgccctttcatttgctgaagccacatccgccagtttgccgagaatcacctctcgacagtttgctttcttgatgcccgacaaatgccagctttgctgtgggtacatcgcgtgctcaatgacaataaatatagtaattatactggagttagtaattaacataattgtagtcaattacgacaaatacagtgcagagctaaataaatgagaggggagaaattagcaagctaattgatttatctttacttggctttctattacaactggcagggctgtttttcttggggtaggggaagtggaggggagaaaaattccccacaaggattgtttacaaataactgattttgttttgaagttgcttttgacttactacacttcatcccctaccctgcttctaaggggaaaaaaagaaaagagagactttaaatgccaagggaacattttgttaatttagctacatcaagctgaatgctgcagctaaggcgaggcaggatttagctttcgctacgtcttgaggagttataattttttcttctcagctattgctctggtaaaaaaaaaaaaacctttttttgggggggggtttttgggtgttttcaaggccccaatggggaagggggaagaaaagaaaggtccccggcctgaattccgaaataagggcaatggttttt

SEQ ID NO: 178760 - DNA, 593 bp, Homo sapiens
ggggtacaaagttgtgatccctttcctcacccatcataggggccatggctgacacctgtgtaacaaaagacaggttagcaagagaaaagcatagcaaatttatttaatcaaaattttatgtgacacaggaaccttgtgaactgaaggccccaaaacccagggaatatgatctgtttctattacaactggcagggctgtttttcttggggtaggggaagtggaggggagaaaaattccccacaaggattgtttacaaataactgattttgttttgaagttgcttttgacttactacacttcatcccctaccctgcttctaaggggaaaaaaagaaaagagagactttaaatgccaagggaacattttgttaatttagctacatcaagctgaatgctgcagctaaggcgaggcaggatttagctttcgctacgtcttgaggagttataattttttcttctcagctattgctctggtaaaaaaaaaaaaacctttttttgggggggggtttttgggtgttttcaaggccccaatggggaagggggaagaaaagaaaggtccccggcctgaattccgaaataagggcaatggttttt

SEQ ID NO: 178761 - DNA, 452 bp, Homo sapiens
ggtgatagtgaggagtcacatttctggttgtgaatggccagaaagtctaaagcaaactctactcgtgctagcggaggcatcagtgctagtttctaccattccagtaagaatttctttaattgcatttgttttttttcttgaagaattcaaggtaatattacccctttcagtatgtgttctggagaaacagagcagaaagcttaaaagaactagtgtgctggccttctggaagggtttaaatctcaaaatgaaacctgatcatgtcacatctctgcttaaagctcttccacgagtgtctaaagttcttagggttaaggcccacatgtttaatatgacctaaatgttctggtggtctagctttggcaaaattctccagtgtcacctcacaactaccccctgctctagcaaaatatcttaacatcattgttccctctttgtaaatactctccctg

SEQ ID NO: 178762 - DNA, 291 bp, Homo sapiens
aggaatgggatgacggttagaggctgattaaagggtgtgctctggaaggttcgggagtcaaattttttttattatcattattatactttaagttccagggtacatgtgcacaacgtgcaggtttgttacatatgtatacatgtgccatgttggtgtgttgcatccattaactcatcaagactggatggctcccgctggactatactggatatgtaggcacagagcctacactcagttacctgatcaatgggcaggtagttgtgtcattggcaccattaagccatccttttt

SEQ ID NO: 178763 - DNA, 427 bp, Homo sapiens
taaggatggggtctcaccgtattgcccaagctgttttcgatctcctgggctcaggcagtcacctgcctctgcttcccaaagtgccttttaccctctttgagctaaatatctaggtcttccttgttttctaatatatatatttaaggccaggcacggtggttcatgcctataatcccagcactttgggaggctgaggcaggcagatcacttgaggtcaggagttggagaccagcctggctaacatggtgaaaccccgtctctactaaaaatacaagaattagcctgacatggtggtccatgcctgtaatcccagctactcgggaggctgaagcaggagaatcacttgaacctgggaggcagaggttgcagtgagccgagataacgccattgcactccagccagggcaatggagtgagactcttgtctc

SEQ ID NO: 178764 - DNA, 607 bp, Homo sapiens
gatgatcccccgaacacgtcgtggcttgagtatcttcaggtcaggatgcatgagcaataaagggcaagtcaggaggagcacccagcaccctgcagcccagctgcacaaaggcagatgctccagttcacagacaactgcaggggaggcccagctcaggtggaggcgttgttttgtttttgctttattttccttctaatcagcatgcagtagctctgtgatgtaattagcaaagagagaggaaaaccatggagtggtgttgccagagctaacctggaaatagaatcatttataagaaaaatagctcaggagaaaaagtctcagagtgagagaagctggggaaacagatttcttgcacttcaggccagatcctggaagccttacattgcatacatattctctcctgtgagggctggtgctccaggaagggaggaagcaatggtagagcaactcttctagaacagtggcttttgctcaggaaggcaagcgatgggaaatcttgccatcttttcaggatgcagctgggaaaactctctagctgctcagtttaattagagcccccaccaagtctcataggagggggctctcgcttggctgccttgctagggta

SEQ ID NO: 178765 - DNA, 339 bp, Homo sapiens
ccaggctggtctcgaactcctgacctcaaatgatccacctacctcggcatcccaaagtgcaggaattacaatagtacctaacatactctattgaattgctggcttttctttctctttagcccatgtaatccagtgtcattcatctcctctgcttaacaaagagcttagttcatgaaagccgcccaataaatgttctttaaattaataaatgacttcatgtcttgctgttccaaaatatactccttaacctgcctgaatactttcacttccttggttaggtatattcctaagcagatcattttattctatttcattttattgtattttattttattttat

SEQ ID NO: 178766 - DNA, 762 bp, Homo sapiens
tacatatgcttgagtagttaacgggaggatactgttgtccacaatttactttgaaatgtattcaaaaacatagatggattaattgcatgaataaatacatgataaagcaagtttagtaaaatgttaatagttgagtctaaatggggagtatatggatggtcactataaaaattcttttgactgatgtatgtttgaaaaattccataataaagtattgggaagttgtacttacatgggaaaatttacatgaacactgatgactgtataaaacaataataatatgtggggcataaaaagaacagaaatttaaatatgcctgtgaagattttgaataagtgtttcatgaaataagaatggaaagaaaaaatatttcaacattaatacattttaaacaatgttatatggaatatgtatataactgaattactaaattaagtagacctgactgtcaagttagtcaaaagaaaaatgtctggattatggtttgagtacatttacatttgagaacaggtggaactgatatgcatcccatctattccctacaaaggctcagatattaacaaaatcatgttctggatttactaaaggattatttttgattggccaaactctctaggagagagaaataaacaatgacaagaattataaaaaagattcaattaatctaaggaagtaaatattgttatttaactacttaattacaaaaactaattatgtaactcatatttaccacaaatgtgacagaaaaataacgtgttgctg

SEQ ID NO: 178767 - DNA, 581 bp, Homo sapiens
tactaggggacagcaagtagctggcatcaaggggtcaattctggaaaagttaagtgcacattaggaaaacttattttattaatagtacaaaatctcatgaaatcacaatgtcaactgtgcctctaccattcaatgcattcatctgttttattgttaatctaaattatttcctgaacaggaaattctgtttaaaaatgaacaatggttactttttcaaaacatcaaatgagatcatctggatattaaaagatttcaaactcatccaaaaaatattagtctgacaatatgcagttaagaaaaacaaatataccctgacagtaaaatgattccacattcacttgaaccaattttccaataaacacaaacataaattcaaaatgtggaaaattccaaaggacaacctacaaagcagaatacaaataaataaatacaacattataattttaaaaagtaattattcaggtgatagagtcactatacacaagactccagtgcacataaagtgtctattttgttattattatattttttcttttttttttacgtttactttaatgtattttactaacatatataattcc

SEQ ID NO: 178768 - DNA, 562 bp, Homo sapiens
ggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatga

SEQ ID NO: 178769 - DNA, 575 bp, Homo sapiens
cctgtcgtggcttttgggaggaacaggaggtgagactaaagaggcaagttgggaccacttggagagattttcttcctttagcagagtgtttatttatttattttttcccaggcacctgtgtggcctgatctgccctctagtggccatttgcaatactaactgtagccaagaagggtctaaaaatgtacgggcttggtccaaagcagatctcaatctcagtcctgctattaataatattcgggtggctcacgcctgtaatcccagcactttgggaggccgaggcgggcggatcatgagatcagaagatcgagaccatcctggctaacacggtgaaaccccgtcactactaaaaatacaagaaattagctgggcgtggtgacgcagctaccccaggcggggcaatcacttgaggcaggagttcgagaccagcctgaccaagatggtgaaaccccgttactacaagaaacataaaaattagccgggcgtggtgacacacgcctgtagtcccagctactcgggaggctgaggcaggagaatggcgtgaacctgggacgcggagcttgcagtgagccaag

SEQ ID NO: 178770 - DNA, 349 bp, Homo sapiens
tgtgtcacagggctgccaggagggcatagggcccaaggattccccagggatgccagcccccctgtgggccctcaggactggtagccctgggccccctggcgctttgtagggaggtgctcagcagtgatggttgtgtgcctgtcacacccacccacctgtgcctccccccacctgccacgcccattgtcctacacccagcgcacactcctctccacgctgcgcacgtgaacccgcccgggtcacacacctgccctgccatggtgacaggactgtgtgggatctctgcctccctgcctgaagttcctgccattgggacctgtcacaggcacacaggacacagctggctcac

SEQ ID NO: 178771 - DNA, 784 bp, Homo sapiens
cacaaacaaaaacaacaaaacaaagagaactatacggctaggtacgaggctgggtgttgggctgtagagcgactatgggcgcacgccgggtatccgcgccgcagccaggctcggagcgcgcggctggaggggcgcgggcggcgcgcgctccagagatgccttcctgcgaggctccgtcagcgcggcccggggagatcgcccgcaggcagcggaggcgcggcgggccgggggacgaccagggagcccctaacaaagcagctttgggagggccggaggcctctgcctccctcggcgataggtccgcgaagctgcctgtcatctcgcataggtggaggtggccaatggcgtgcacagacggagctctagttggcgcgcgcgcgcggctcggcatcggtgggattggtcggaggttgtggagaacgcggaaacggagacgctggcggtacagcctcgagcgaaacctttccctacacgaggccggagcttcctcctctcctgaagagctctagacttccccatttacaacaaaggctgggatgtatgttccttacaccttgattccatacacacgtgttcgccccgggagctgggaaggtctgcgctcccggggtgatcttgttgaaaacaaaaagaattgcccacgctgtggaagataaacctaaaccggaaaattgaaagtcatccctgattcctccttcttcttaaccctctcccatccatttttgttaacctcccaaacccattcctcccatcctgtctcacctggacctcagtaaagggctcc

SEQ ID NO: 178772 - DNA, 1147 bp, Homo sapiens
cacaaacaaaaacaacaaaacaaagagaactatacggctaggtacgaggctgggtgttgggctgtagagcgactatgggcgcacgccgggtatccgcgccgcagccaggctcggagcgcgcggctggaggggcgcgggcggcgcgcgctccagagatgccttcctgcgaggctccgtcagcgcggcccggggagatcgcccgcaggcagcggaggcgcggcgggccgggggacgaccagggagcccctaacaaagcagctttgggagggccggaggcctctgcctccctcggcgataggtccgcgaagctgcctgtcatctcgcataggtggaggtggccaatggcgtgcacagacggagctctagttggcgcgcgcgcgcggctcggcatcggtgggattggtcggaggttgtggagaacgcggaaacggagacgctggcggtacagcctcgagcgaaacctttccctacacgaggccggagcttcctcctctcctgaagagctctagacttccccatttacaacaaaggctgggatgtatgttccttacaccttgattccatacacacgtgttcgccccgggagctgggaaggtctgcgctcccggggtgatcttgttgaaaacaaaaagaattgcccacgctgtggaagataaacctaaaccggaaaattgaaagtcacaaaccaaaaacaaaaaaaaaaacccggagcacatcaagtgcacgggtgcgcgaaacaagcgggacccagaaaaggcgcccagtgtgccaatacagatacgtgaccacagttcctggtccaaggtggacaacagacgggacacccaataggaagcgaataactacgaataaacccagggtacaccggcgttaggacgactgcgccgcaccaccaaaaaacaacagcaagcataacacagcaacaaataacatacagacagagcgaagacacgaaaccagagaagagacgaccgaggacggagagaaacaaacagacgacaaaagaaaagaggaagggaagcagagagccaacaagatgaaaacgcagacaatagggacagagaggagcgacgaaaaggaacgaaggagagcaacgaaagcgagcacaggaacagacaagtcgaacatacgaggggccctgagcgac

SEQ ID NO: 178773 - DNA, 611 bp, Homo sapiens
gtatctgagcatagcaactatcgcagtgttctggtacaggatctcttttaagagaccaaagaactgacaggttgctgcattctggatgttttattgtgattccattcccccctcaccacccgctgcactggtctgctgtatctatgaatcatgggatgtatagtgtatgtgccctaggaagagggagggggtggagggaacagataggtagcatggagtatattgctgctgaaagctattccaagatatttccaaggttgagcttctctgacccttgaggcatagcttaatactttgtcaggtcaaagtacaaatctcctggggagttggagtgccaagtgaatactgtggactcctcatagaattagggatagcttccttcttcctgctttggcttcttggcaaaactccaaaatctggtgccaagtacattgtatcctccaaggttaaagcccttagagaaaggtggtggggattactctcctgagccagaagttgctacagtattgtgtttaatgcttaggtgtggggtcatatcaaactcttgggctgaactttttctagtggcctctgatacctggctgggaagttgcacttgctagttgcttggc

SEQ ID NO: 178774 - DNA, 581 bp, Homo sapiens
aaatgttttcagtaaaggccagagaacaaatattttacattttgcagattgtacaagctttgtcacaactacgcagtgaactctgccattgtatcacaagagcagccatagataatatataaatgaatggatgtggctgtgttccaataaaactttatttataaaaacaggcagcaggccagtttggcaacctctgctttacaccaatatctgtagctctaacccattggtgttttgtttttagttatttagaatttttatcacaaacttttaaataataaaagtataggaagtataatatacctatagaaaagtgtataaatcataatcttacagcttgaattctcacaaaggaaattcacctgtgtaaccagttcccatgtcaaaaattatactcattttctcattttaattcagtcttttcttttcttttttttgagacagagtcttactctatcacccaggctgtagtgcatgaatgacctgatctctgttcactgcaaactccacctgcagggttcaagtgattctcgtgtctcaccctccagagcaggtgggattacaggcatgcaccaccatac

SEQ ID NO: 178775 - DNA, 335 bp, Homo sapiens
tcaaagacttcatggatccaacaagcatgacattaactaagggacagttttctttcagcggattggaatctaaaatggcttttttattgttattatttttcagagaattataatgtgtttcaacaaaggcagccatggctttgataatgtcctcatggatataaagaccatcttcagagatttcgggccagatttcaagaggaatcgcctggccgagccttttaacagcatccacatctacccattcgtgtgtaagtcatgagctcttatgaccagcagccaggtgagacacaaaagcagctgccagaaaactgtcagcagagtctgctctgtcc

SEQ ID NO: 178776 - DNA, 650 bp, Homo sapiens
gaaatccctcatagatccttcccaactcagacaccagttctatgcattcttttaagcaatttcaaaaggacaaaaaccttagaatttatatatcgtttttgtagaagatatacatgattttgtattttgtcctttttgatttactttcaaaaatatgctaaagtgaaaaccacgtcacaatttagattaaaattatttacatgtaaacaagacataaaacttattttttttgttttaattgcactgccaaagaagagaggatataaaacttctataagcgattatctttgtgaatattcaactattacgtaggtttacataatgatatgcattacttaaaacattgtttgggttttagcaaattaccatattatacttattgttatacttattgtctttaattatatatgaggaaaataattttttaaaaatcccaagtgccagtcagcagcaaaatagaagtcagagaaggaaacaaaaatcttctaaacaaggccgggcgcggtggctcatgcctgtaatcccagcactttgggaggctgaagcaggaggattgcttaaggccaagagttcaaatcagcctgagcaacctagtaagatcccctttctgcaaaaaatttaaaaatttagctgggcatggtagtgtgcac

SEQ ID NO: 178777 - DNA, 533 bp, Homo sapiens
taactactctcagtggatcatataagctttcagttgctactcatccttgggcactctgccctcatctctattagaactcctgttatagtactttacttcattgccacctctatagtctgggaactccagtatataaacagtgaagacaagagaccagtctgactcgctctattgtatctcctgtgctttgcaagacagatgtctggctcttattaagtcctccatagtggttaatgattgtacctattatagccctcccttcatctgcctctccatactataggaagcactcaaacacttgcagtcactcaatgaatgaagttccttaatggtaggaaatctttttgtatgccaagtttctatctaatgaaactgtcttaacccgcgaattgaaagtacttttaggtgatgatggatatgtctgtgcccatgatggtggtgatggtttcatgggtgtatacttatctccacactcatcattgtatacattaattatgtataactttttacatatcagttatacttcaataaaa

SEQ ID NO: 178778 - DNA, 240 bp, Homo sapiens
gccaggcccgccagccagccagccaggcagctaagccagccaagccagtcaagcccgacagccagccaagacaggcatgccagccaaaccagccaggcagccaagccagccaagccagccagccagccaagccaggcatgccagccaagccatccagccagctaagccagccggctagccaagccagccaagccacccggccggccaagccagccaagccggccaaaccagccaaccagc

SEQ ID NO: 178779 - DNA, 615 bp, Homo sapiens
ccagcagccccagcgtcgtgtccctcctccctgattctggtcccccgacgacctttcatctgacttctcagaggtctgctttctcatgatctgattcgtgtttctctaaagcgggactctcggaggtgctgcgcacatccctctcaggctccttccagccctgccgggacccagacctggggcaaggggcaaaacgccggctccatcttccctcccaagccggggtggctggtggggatgaggcggggtgggactcagcagccttcatcccgatcctgcaggtcagaccaccgtgggtctgattccccatctgggccctccccaggccctcgggaccacgacagaggccacagcagcaggttagtgaccccatcagcctccatcctgcacgtctaggaagggccgtgggattccgtcttctgtttgccgcagaggcttctacccatgtcagccgccaaagcagacagaatcgtgagtgtggaggctcggacctccagctccatcaccctgagctgggcagccccaagggcccagaccggcagacttccatctactgggtccaggggcatggccagcgggaacacaagcacgtcacactgctggctcgtggtggag

SEQ ID NO: 178780 - DNA, 547 bp, Homo sapiens
tcctttccccttttttggacagggacacactaaggttagctagaagcttgcatggtggggtgggggaaatgcctgcagctgcaaggaggtacccaggacaaggcatggaaactccccctattcttgttagcacatgcaaggtggaaggagaaaggcagtgtggagtcgcccaagctaagagcctgcctgcatgataaaagaatggggtaggggctgccagagattccactctatacagatgacacacctggtcctaaccaggttttcatgccctatgtagataagatacccgctccctactagctcgttgataaaaaccctccattttactgcagcacggcaacccgtctgggacctctctctgtgagagagagctgtccttttccttttgcctattacacttctctaacttcaccctttgtgtgtctgcattcttcatttctgtggccatgagacaaaaaacctcagctgatatcccagacaacaaggctgctttagagggaaaacggatagctaatattatcagttaattggctatgttaattga

SEQ ID NO: 178781 - DNA, 424 bp, Homo sapiens
tcttctcctaaccgctatcggaaacagaaaagtatgtatgagaaacagcccctgaaaaatcattaactaggaacagcatataaatcagttttttttcctgagaaaccactcatcttagaatttcagaactgcagagggaccttaagatactacctaaaatccaacccactcattttataaataaaggctcggaatggttaagtaattttaacacgcccaagatcatacagcaacttagtggcaacactcctgaatctcattccagtgtctagtcctaccataccaggcttcctaggaatggtttatttttctcttttttccacccttaataatcattaaattattttctgcataagcatttccaaatccctatattatctgtagttccatcagagaaaataatcagatgttctcaattatctag

SEQ ID NO: 178782 - DNA, 232 bp, Homo sapiens
aattgttctctgaagtagctgtatacttttttgtatttccatctgcagggcaggagagttctagttgctctgtatctctgtcagcttgctattgtctaggtttgttggtttgtttttgttttgcttttctaataggtaagtaatggtatctcgtgatttctacttgcatttcctactggataaataggtttatgtactcagttttttaaaagaaatattacatttaactcta

SEQ ID NO: 178783 - DNA, 588 bp, Homo sapiens
caatatggtgagaagcagaaagagactccttcaatagataccatttcaaagttatgctgcctctcagtccatagccctaggaacccaaacaaaaagacaaggggtcaacataaagggcattcaggggtccccagcgggcctccccagcatcctgggactctacttcctccaggggaaggtaaataaaatcagctgatcaaccaatcagctcactggaaagcaggaaacagaaggactctctaaaatcagcccagattgctacacaggaattgtccaaagtccaaaaagttgccactctttaaaggaggcagaggagaatacataaaaaccaagaaggaagaaacaataaaggtgaggtagagaaggactccaatgcaaccaaaaagaaggcttctagcctgagacctggctaccaggggcagaacccaggtcggaggcttctctggcattttctttcctgctgggtaggcaggagttctctccagaggaacacatagctttagcccctctttgaaaaatttgctccaagaaaaagaaaacacgtttaaccagagatacaggatagaaagggcggccagctcttaaaac

SEQ ID NO: 178784 - DNA, 573 bp, Homo sapiens
tattcagatttccttagtttttatctaatatacattttctggttcaggatctcatctaggattccacattacatttgattatcatgtctctttgggctcttcttggctgtgacaatttctcagactttccctctttttgatgaccttgacagctttgaagagtgctggtcaggtatgttgtagaatgtccctcagctgggattcatctgatgtagtgcattatttctcattctcatccttagccttcagtgtaagtataaattattcatcttttatagatgaaaacactgagatccagagaggttgaggaacttcctgaaagttacacagctagcaaatggcagaagctgtgattcaaactcagtgttgacatgacttcaagccacatacttactttgcctccctggtctcaatctgctaaatttctgacaatggaattgttctcatcaaggctatcagggtgatctctttatagttctttcatacactttaaagcaatttgatgacatgcttaattatattagaacaatttccacaatcagttgtttgctgaactggttatttgtataactt

SEQ ID NO: 178785 - DNA, 124 bp, Homo sapiens
ctatgaatgctttggtgttcttaattttcttaagatttattaatatttctgaagtaactactaaatgccaagcaatatattttctaatttaatctttcattgacttttactttcacttcaattg

SEQ ID NO: 178786 - DNA, 357 bp, Homo sapiens
aattagccgggcatgatggcgggtggctataatccagctagttgggaggttgaggcagaagaatcgcttgaacctgggaggcggaggtggtagtgagctgaaatcaggacactgcactccagcctgggagacacagcaagactttctcaaaacgaaaaacgcacacttcactccctttgccttcctgagctaaagaagagtagccaaaccgccccaaagagaaatctcatccaggttactctagccggaagatcaatggaggtaactaatgtaccaaccaagaaactaaggaaagataggtcaggcgcggtggctcatgcctgtaatcccagcacttcgggaggccgaggcgggcag

SEQ ID NO: 178787 - DNA, 351 bp, Homo sapiens
aagaacagacatgattattactcactggccagtctagacagaaaattacgtaaattcaaagaaagaagagtttcaactaactaacagttggcacaagtacacggttcgcatgttcaatgttccataaagtttatgaggtaaataatatactattagcttaaacccatcccagctgtcaagagcctgagtagaggttacgaagataagaaatgaaagtattctagactctaggggtacatttgtcaggcatgcatatatctaattgactaatgtgttccaaagtgaatcttcattcgagttctctatttctgctcatcctctgctcttgctcttctttgtcttcattcattc

SEQ ID NO: 178788 - DNA, 354 bp, Homo sapiens
tatgaacacagttttccaagagtgctttggcagtatgtttcctctctattttaatggtacactttcccaaattatcagagacgtgcatttaaaactactcatcaaaatcctgtatctgactataaaccatcttttgaagaggatgaaagcaacacaccattgtctgtggaggacaaaaagtcttacagcagccgcagtcaaagatgcaattgacaaggaaatccagttacctctgtggtacacagcaatttaacataacagttatgggtattattgttcacattcactaattcatgtcaaaattataggagtttcacataatttggaaacacatacagataacacatttataca

SEQ ID NO: 178789 - DNA, 431 bp, Homo sapiens
tgttcagccttattattagcagttattcatatacctcttggcaagtcttctttaagaaatgtctatctggtcctttgccttttgagacagcatctcactctgtcccccaggctagaatgtagcagcgtgatctcggctcactgcaaccttcccttcccaggctcaaaccatcctcccactcagcctcccaaagtgctgggattacaggcgtgagccacggtgcttggctagttctttcttttcttaaggctgcatttcattcagcaaagaggcactcactatgtagccggcactactctgggtttgtgggccataaagacagataagacacagtccctgtctttcgaggacttaggcttagcaggagacaggcacctgagccacagagacaatcaagagttgctcgctgtgctcagggagaactctgttcg

SEQ ID NO: 178790 - DNA, 1617 bp, Homo sapiens
  misc_feature (272)..(272): n is a, c, g, or t
  misc_feature (280)..(280): n is a, c, g, or t
  misc_feature (1012)..(1012): n is a, c, g, or t
  misc_feature (1373)..(1373): n is a, c, g, or t
  misc_feature (1386)..(1387): n is a, c, g, or t
  misc_feature (1390)..(1390): n is a, c, g, or t
ctgggtgtgaggttgttgaggattctgggttgcaggtaggcaccgtcttggtttctctgtctctgtctgacattccagacgctcccagggcctggctgggccagcttccctcatgggcttggttctcacagacccagtcacaaaaaccatgctgccagcacttagtacagcctcaggcctataccacctccgtccctcatcagtggggtgccctctgcctggtggttcctgccagcctcaggccaggggttcagagagcaagtctctctcanaggtgctntagccccagggacccagggcagagcacaactcagcctcccaggctgccagcaattcacttactatactgaacattctgtttcctcctccacgaccacagccatccctctccatgccctgtgtgctctgctgccacggtccccttgcccttgcctctggtctggttcaccaatggggacaccagctgaagactggaagggtggaaggagagagtggccagaactactcatccagcatctcctgggttgaggctggccatgtcctgactaagagccacagtccccactgtggtgggagggtggccctctcctgggctgcagcttgggagagctccagtaacagccctgctcccactccctagaggcaggaatggtggcttcctgctctctgtactgtcaccatcccttaagcagcatctgtaagtggccagctcattaagccctttcccctagtttgcagactacgtctcctgccaggatcggatcagtaaacctcaggactctcacagccctacagggcagctggagccatcccatttacagatgaagaaactgactcagaatcaaaaacaacaaatccggagccatcacattactcaacttcaaactatactataaggtcatagtcaccaaagcagcatggtactggtataaaaatagtcacatagaccaatggaacagaatagagaacccagaaataaagccaaatacttacagccaactgatctttgacnaaacaaacaaaaacataaagtggagaaaggaaaccctattcaataaatggtgctgggataattggcaagccacatgtagaatgaaactggatcctcatctctcaccttatacaaaaatcaactcaagatggctcaaatacttaaatctaagacctgaaaccataaagattccagaagataacatcggaaaaacccttctagacattggcttaggcaaagccttcatgaccaagaacccaaaagcaaatgcaacaaaaacaaagataaatagatgggacctaattaaactgaaaagcttctgcacagcaaaagaaataatcaggctgggcgcagtggctcacgcctgtaatcccaacatttngggaggctgaggnnggnggatcacgaggtcaggcgatcgagaccatcctggctaacatggtgaaaccctgtctctactgaaaaatacaacaaaaattagacaggcgtggtggtgtgcacctgtagtcccagctactcaggaggctggggcaggagaatggcatgaacccaggaggcagagcttgtagtgagcctagatcgcgccactgcactccagcctgggcgacagagcgagactccgtctc

SEQ ID NO: 178791 - DNA, 979 bp, Homo sapiens
ctgtccaaaaaaaagtgtgaagtcaaccttcattcttttcttaaacaacccatattcaatccttattggatccaccttgaaagtatactcaaaacgcaattatttttcaatgccttccccactacaaccctggtccaagtcatcatatctcatctgagttcttgcaatagctcccaagttggttttcttgcttccatacttcctcctataaactgctcttagcacagcagccaaagcagtgaaaataattaagctcatgccacttctctgtcgaagcctcctttggctatgcgttttgctcagggaaagctggatcccttacaatgttgtacaggccctacacaatctgatccctgttacttctgaggctttatctccaagtgcccttctcctcgctcactctactcagccacactgactttattcttccttgaacattctagggacacttttacttcagggctttttcattcgttgtttgcctggagacacgtcttccttagaaaatgtttggccacttccttacctccttcaaatctttgctcaaatatggcttatcagagggccttccttgaccatcctatttttaaatgcagtcttccccctggcccccaaacacaggtactctatatcccctttcctttctttttcctcatgacacttatagctgtatgacatactatatattttgctaatgtttattttccctatgtccccactaatttgtatattttgtgaggacagagattcttgtctctttgtttaatgctgcagcctcagttcttaaggctatgcctggtgtgtaataggctctcaataagtatttgttaaatgagtcaatacatttgtctttaaaacattccaaatatttctacatgattagtacttttacctaatgtgctatttactaaaaaggttattaggaatcattttcgtttgttttccaggttttcattgccattgtgatttggaacaaata

SEQ ID NO: 178792 - DNA, 492 bp, Homo sapiens
tggataacaagagtaaggacatgtgagcatgtgcatggctgtgttgttcaatactgctttatgttttatatacagtaaaatttttatatagaataagattccatggtaagatttcacttgaataagcaagtttctctgttaacatttttaaaaaatctttggctgtggactgtgggaagcactgaaaaaaacacaagtgaataagacagtgtctactttcaagttggtcattaattccactttgtttgtggtctataattgttataaatgttacctcagattcctacaataactttcccactatcactaaaccatgtcctttcatcctttaaaattacccttgagagcccccacatatacttctggtaacagtcacctgctccatattgtaatctgccttcaaggacttttatcctttctgccattcattcacaccataaactttttttaaaaaaatgtcttgccagaaatcatactggaagttttcatgca

SEQ ID NO: 178793 - DNA, 384 bp, Homo sapiens
gatacactacagtaagcatgttactctgttaccgttcgttcgaaatctacgtccgttgcttggaaaacccctggtgaaaaaaacacaagtgaataagacagtgtctactttcaagttggtcattaattccactttgtttgtggtctataattgttataaatgttacctcagattcctacaataactttcccactatcactaaaccatgtcctttcatcctttaaaattacccttgagagcccccacatatacttctggtaacagtcacctgctccatattgtaatctgccttcaaggacttttatcctttctgccattcattcacaccataaactttttttaaaaaaatgtcttgccagaaatcatactggaagttttcatgca

SEQ ID NO: 178794 - DNA, 198 bp, Homo sapiens
gggccctttgtaaatcagacactgccttacactgtcttctgaaacacctttatataaccaactatttcctgccacgcacagggaaatccattcggagccttcctccctctgcatgggggagctgctctcttcttttctacctattaaactttcctctccttaacccacccacgtgtatccgtgtccttaatcttcttg

SEQ ID NO: 178795 - DNA, 809 bp, Homo sapiens
tcagtgcgcaccattttcataatttatggtacttccaccccaagcatgcctcaaatttgtttaggaaaatattttcttctcataccttcatttgttctcatatcatcattgtaatatgggtggatgatcaaataagcaaggccggcaattggtctgagaaaagagctcatttggaaataacatcctgagctttgcaaccgcaagtgagaagtgtatctcagcacctggtagcaaatgcaggtgaggtccaccctggtagtacatacaggagagttcatagatggttggcaaagaggtacaaactaatggaaacacaacaacaagctctgtagctactttacatggagttgactcagcaaaggcccatctgacctaacaacaacaaccagattagaatagttaatctttattgaacagttgttaccaccagttctgggtgcttcacatatgctatttcatttaatcctcacgacaatcctatgaggtactaattatctttctgctattttgcagatgtggagactgaggcttacaaagattaaataagtgttcaaagtctcacaactattaggtggcagatgtagaactcatatccaggttcccaaaccccagagcccaagtttttgccccagaatcacaatgctatatggactgcaccataatgaaacagctgtgtcaactgtactctgtatgcccccctcatgtattcagttgccctgtaactctgtccccaaaggagaaagtttgcatgccctgactgtttcagcattggtcactcatactcacaaactgtcctgtaaaatggagct

SEQ ID NO: 178796 - DNA, 528 bp, Homo sapiens
gataagcacctagatcttgggtcttgttctctatagaagtgaagcacttgattcaagagcctttgagatcttcccctctttcctgaccaaagaaacaaccacagccatcaacattctggcattgggccaggcattctctcctctgctgggtgaagaagctgctctatttgctgactttcatttgactgtggtgtagagattccttgataataacaactgtacatcatatgactattttattctttctgtctctacctaactgcagatgggcacattaccactgtggattagatactttatggttggatgataaacgcttataagaacaacgtctgtgttaccagaatggccattatacatgatgctccaaacctcctctgtttggcttaacatagctttgtctcaattcctagccttaatgcaggctacttttcaaaagtagggttctaccacaaaacaactcttttttccccggcaatgattcttgtgcagttcactgaagtaggcttgatcctgtcttttcttccg

SEQ ID NO: 178797 - DNA, 398 bp, Homo sapiens
gtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttg

SEQ ID NO: 178798 - DNA, 236 bp, Homo sapiens
  misc_feature (194)..(194): n is a, c, g, or t
gtaactgaggtgagacactgtggaaaaatacatggggcttaaaaaaaagattcaaaaatcaagctggttagttttgaggcttgccacctcttgcttcttttgatcaactgctctggtgggagagacagcattcaccaaagcatcaggagaataaaatatgaatactgcagataatatgtaactttaaacattgncgattccttctctgaacacaggcagctttctagaagtttccc

SEQ ID NO: 178799 - DNA, 668 bp, Homo sapiens
gatgctgtgatgctctagagatcccccactacagggatcaactgtaaccaatttcaggatcacagatcagattttcccaaaacatgaatctgctaattaagttacctgaaagtcaaactaacacgcaatttggatgtgacatttatccacctgaaagtagacctgttaagtatttcaattcacagtaacagcagctattccttatggacagcactattacacacttggaaaactgcagctgaaatacacggacgcaggaagagactcatctatgattcaagcatttccaggaaataacaaaaggattctcctggcaaaccaacagaatggcccaccaagacctgcttcagcctgggaatcaactcgtattcatttgctaaattaaactgataatgaaacaagtttaagatactcacatacagagacacaccacagcacacacagcctggcaccagttacattagtcgcttttttctgaattctgacacaaggaacgaggtttgatttcatggttttgcctatttgctcattattaaatctgcccacttattttccgcaagaaaaaaaaaaaattgggccaggcgcagtggctcacacctgtaatttcagcactttgggaggccaaggtgggtggaccatgaggtcaggagtttgagaccagcctgacc

SEQ ID NO: 178800 - DNA, 163 bp, Homo sapiens
ttacagaatttaacatgacttggaatgccaaggagaataaaagcagtgaaagccacaatggccaggggagatatcctggagggggcagaacttgcatggaggaatgattgcagctgattatctcgagggaaaaaaagatgggatgatgagggtgatgactgaa

SEQ ID NO: 178801 - DNA, 287 bp, Homo sapiens
gagaggggtcccccttggcatcgtggcagggcgacaggaacccacgttgattttgcctgcaggactggctaagcagggcgcgagaggcccacggctccctggcctgccttgcaaggaggcatggggacaatgactatgcaaacttgaccactctgctcccctcctcccctcagcagctactcctcgctcctctgagaagccagggctgctctctgctgatttttcggggctcccccgggctgcctgcttcccccagcttctcagaggcctgcctcaagccccttttt

SEQ ID NO: 178802 - DNA, 420 bp, Homo sapiens
tgatacacactggtttcttttgattttctcaaaatggaaatatattatattgctttggtgattttaaataaaacttatggtcattaaaatttttttctaacagtcatataagtgtttaagtataaggaaaatcatctcacagtgattctcccccttcccttttaccaactataccagtctcccccacaaccgaatttctgttaagtttggtatatattcttgaagacttttctgtatctataggttatttaaaattatgtgtgaatggtaaatcacacatgctgtgcttcaactgcttctatggggcagagactgcactaagtactgaggcatctcatttaattctctcaacaaccctaatgcagtaggtataattattatccactttttatttttattgggcttttttttttttagaca

SEQ ID NO: 178803 - DNA, 508 bp, Homo sapiens
atgagataccacaccaggcaagaaagtttctctttacaaaatattccagaaatgaataaataaataaggaataataaaattacactatcaccatttgaaactactaatgaattaatgaatgtaggcaatggtcagtgggcaataacatcacaaaagacaagacaatcaggcattatatgcatgtaaggggaaaaaaaagttaggacttacttttgtcaaaaggtaatgatttttttttttttaaattaccaggtgcagtggctcaagcctgtaatcccagcactttggaaggccaacatgggcggattgcctgagctcaggaatttgaggccagccagcgtaacatggtaaaaccccatctctaccaaaatacaaaaaaattagcagggtgtggtgatgcgcacctgtaatcccagctactcgggcagctgaggcaggagaatcgcttgaacccggaaggcagaggttgcagtgagccaagatcacaccactgcactcccgcctgggc

SEQ ID NO: 178804 - DNA, 158 bp, Homo sapiens
aactagaactatgttggaaaatccattctcaactccttgtatttactcactagcaaatattacctatcttctgtgctagaattcaaacccttaaaggctagaattgggtttcatccacaattctgtagtcctagcataattcattgcatatgtttccc

SEQ ID NO: 178805 - DNA, 522 bp, Homo sapiens
ctctttctgaaccttcaaggggaggatccttccttgcctctttcagcttccagcagccccgggcattcctgggcttgtggcagcatctctcacacctgtgcctccatcttcacagggccgccttctccctctgcgtctctttcacacagagttctcttccccttttacaaaaacagcagtcatattgtatcagggctcaccttcatgacctcatcttaacttgatgaaatctgcaaagatcttatttccaaataaagtcacattcgcaggtgcaaggagataggactcccacataccctttcatggggaaggaagacacaattcaacccctagcagccaggaaagagaaaaacagggacagaaaaataactctttgatcttggtcaaccaaaaaggggatcctgatgttctcagaggatgttcacccagaaagagcctgggaccccgacaggaacatctggagatgaggcgaaagcctagcagcaaaggtgatcgctcaagagggcaggagaatccactgga

SEQ ID NO: 178806 - DNA, 693 bp, Homo sapiens
gtttatcagtcagggttctccagagggacagaactaataggatatatgcatatatgatggggagtcttttagggagaactggctcacaccatcacaagacaaagtcccacaataagctgtctgcaagctggggaagagtagtggctcagtccaagtccaaaagcctcaaaagcagggaagctgacagtacagccttcagtctgtggctgaagacccaagagcccctggcaaaccagtggtgtaactccaagagtccaaaggctgaagaacctggattctgatgtccaaaggcaggaggagcggaaggaagcattcagcacaggagaaagaagaaagccagaagactcagcaagccagcttaacccaccttcttctacctgctttgttctagttgttttgattggatggtgcctacccacactgagggggagtcttcctctccagtccactgactcaaatgtcagtctcctctggcaacaccgtcacagccacacccagaataatactttaccagctatctaggcactcttcaatccaatcaagttgacatctaatattaaccatcacagtggtgaattgaattatatgaagacttgatttcagactctgccatatgatggaattttggctattggtttattggaagggattttatattatatcatgatataatatgataatatgttcttactg

SEQ ID NO: 178807 - DNA, 320 bp, Homo sapiens
ctaccacactgccaataaccctcaaattcgtatttccagtcctatcctttctcctgatctccagacctgattatcttctcagtggccagctggacaatcccaacagggtatccccctcagtatacaaacaaaatgcaggtatcacaccagatcatattcagttgtctcaactgagtatcatgccctggtgtctcgattttgggatctccctattgcctgcttcaactgtaacctcagagccataattagagttctgtctttgcttcaccaccctcatttctaattagtttacagattttttcttgcgtggggtaggaggt

SEQ ID NO: 178808 - DNA, 351 bp, Homo sapiens
cgtgcaggattagttgctgtcctttttttcccaggttgattatttctaccaacattgttatcataaagtagagtaaacactagtttttattcatttcttagcacaaagagtatgaaggacaaaggtgaataccaagtgcatgatagggtctaaactgtggggttctgatatgctgtcttctaccaaatgccagacaaaatattagagtgtggagcaccaattcaagggttaggatgcaccatacctggaaagaaagctagcaaaaatgccaggcaacctatccttttgacaagagggcatttgactccaatgctcagacccgtccagtgcagctttccactgggagaggac

SEQ ID NO: 178809 - DNA, 525 bp, Homo sapiens
agctcggcacccatagctacaccgtacaaagaataaattatattgccacagaatactcatataatttgtaggatatgcaacagctttcaagataggaacataatgttttcacaactaaaataaaaataataaacttggtttattagtacattaaacttttatctataaaaacactgttctattataattcaggcataagacaggatctcactctgctgcccacgctggagtgcaggggttattcatacacacaaatatagtgcactacagccttgaactcttgggctcaagtgatccccagcctctaaagtagctgggaccacaggtgtgccacactgtgcccagctctcaaatatataattttttaacggtaagaattttttttctagaaatgaaaattgaagcatgccaatgttcaattgtttataaactttgctattattccagcttacccaaaaggcaaaagagccactctgttagtccaaacttaccttagagcaaaattgtgtggagatagaaagtcaa

SEQ ID NO: 178810 - DNA, 261 bp, Homo sapiens
gtccctcatgtccctaacataccacactcagctcttggttcatactgcccatctgccaagattattccttctgctttctttatgaggcaagcccatccttgaaagcccagcttgctgcctcctttctgaagcccttcttaaatcagcgtcactgcctctctctctctgcagccgcaatatgttgtgcacagctctatgataaccattttcacatagtgctagcctctcttacatttctctcccttgatgaattacaaatgc

SEQ ID NO: 178811 - DNA, 324 bp, Homo sapiens
atgcagtgttccctcttacaagcttcccctctgtagcctacaatcaaaacttactagtcctggagcccagtcctttgaaaaactaatttgtgctgacctatgagtaattggtaacttaattttttgctaaacataattaatctgtctcattagaactttttctttgagacagggcctcactctgtcacccaggctagagtacagtggtgcaatcatggctcactgcagcctcaacctctgaagctcaagcaatcttcccgcctcagcctccagagtagctggagctaagggtgcacaccaccacgcctggctaattttgttttt

SEQ ID NO: 178812 - DNA, 277 bp, Homo sapiens
caggcacccatctcatggtacaagatagtatctccagctccagcggtcacatcttcattctagccagaggaaagatgaaaaggaaagaaaagggcatgctccctctttgtaaagatgctttccagaagctacatgttcatttctgcctacctaagttctgagtggtcagaacttagtcacatggccctatctagctgcaaaggaggcaggaaaatattattattaatgctaggcagttgtgtacccaattaaaaatgggacaccctattactaagta

SEQ ID NO: 178813 - DNA, 542 bp, Homo sapiens
aaaagaaggcaagaaagcaggaacacagttacaaaaagcaaaatgcacatggtacaaatagagaagaaacagccgaagagcagacccaaacctagtcacaccaatgattacgccacatgtaaatgaactaccctcaatctgggtgggcacaatctaatcagctgccagcacggccagaataaaagcagacagaaggatgtagagagactggactggcttggtctcccccggcctacatctttcttccacgctggatgcttcctgcccttgaacattggactccaagttcttcagctttgggactattggacattcaaccactgactgaaggctgaactgtcagcttccccacttttgaggttttgggacttggactggcttccctgctcctcggctgcagatggcctattgtggggcttcaccttgtgattgtgtgagtcaatattccttaataaactcctgtttatatatacatctatcctattagttctgtccttttggagaatcctaatacaaaagccaaatattggttcttttaaaaa

SEQ ID NO: 178814 - DNA, 450 bp, Homo sapiens
tgttctttctctcctcttgctcttcctctctctcagtttcatgaaaattcatttatctgtgacatttaaagactctgtctgagaggtgtctggagctgtggccggctgtgtacatcaatagtttcttagaatctggcactctgtcaatatttgggggcctcgataaccgcacttaaatgcagagcctgccagccatcatgctcttagtgaatgaatggatattagcatgtcaaatcctttcacaactggcaacacttggtagacaatatataggcatcttgcatttgccttctacacctttctgtttgcctgcctcatttatatgatgtcatgtttcccattacgtataaaaataggaatcttcaaaaagcagtattataaaaattgaagtaaatgacatcattgtgcattctaagtttggtgggttttatagtatacatggtgatggca

SEQ ID NO: 178815 - DNA, 243 bp, Homo sapiens
ccaagagaggggcaagagtgagggctggatgatggcagggaatacccaaaggtggcggcgctaaggctgagagagttgcccccattccttcctccgccatcttttatcttcctcatatttccctcctctgtgctacagcacagaggaggagcacagaggaggctaaacagaaggtcccatgttaactgaaggcaaattcactcaacctctctagtaagggacccatgggcctacagagtgttc

SEQ ID NO: 178816 - DNA, 172 bp, Homo sapiens
atggagagacaggcagtggagactgagaatggcaacacaatagtccaaacaagtgacagtgtgggtgtgacctaaacaaaggggggcatgcagtgccctctgtggttacagagcccgcggggcatgaggggaacggtgaaatgaatgtcgaagggtacaaagtctctgttag

SEQ ID NO: 178817 - DNA, 488 bp, Homo sapiens
atccattagtattcattatttcacttctttttgatttttactctcttcacaacctccctatctataccgtagtccaggggaagaatgtcagtgttttttatgtcagtccttggatgaattctctttagataatgtttctctttagataatgtttctcttttcaagaaacagtgctgaaaaggctatgccttttctttctctttctttgaggttttatctgagttatatcgcttgtgtagatataggataagttatttttatttttatccccaggaagcctttcagcccagtgtgctttcccatagttattgaaatgcacaaatcaccggtgcaactaatctgaataattagtaactgagtacaggtatactagttgtaaaattatctctgcatctttatgtaagaatattaattacatgaacttatttttaattttttcccttctgaacatgttttcttttatgtaggaaattctttctaaatgccaa

SEQ ID NO: 178818 - DNA, 397 bp, Homo sapiens
gcttgaacctgcgacgtggaggttgcagtgagctgagatcccaccactgcacaccagcctgggcgatggagctagactctgtctcaaaaaaagaatttaagtttttaaaaaaccttccaatagaagtagttgaaaaatgatagttgctacttttacttggcagttcttctaatccatgaatatggaccatctatttatttaaatcatctttaatttctattaataatgcgtttataactttcagtgtatgagtattgcacttttattacatttattactaaattttttatgcttttaaatgtttttgtgcatggaattattttcttaattttgttttcagattattcattatatgtaatcataatttttttattttactcttgtatcctgcagtttt

SEQ ID NO: 178819 - DNA, 189 bp, Homo sapiens
tctgtcctcactggtcccccttccctctgtgtgagcctctgtgtgtctacttataaagacatcagccatactggatttaaggctcactctactccagcgtgacctcatcttaaataattatgtctgcaaagacctcgttgccaaataaattcacattctgaggtttcaggtagatgtgaagtttggggg

SEQ ID NO: 178820 - DNA, 322 bp, Homo sapiens
ctcccgagtagctgggattacaggcacacgccaccatgcctgctaaattttgtatttttagtagagatggggtttctccatgttgcccaggctggtttcgaactcctgagctcaggcaatctgcccacctcagcctcccaaaatgttaggattacaggcatgagccaccaagcctggccctgtgcatccttctttgtgccctttgctgagttcttcttccccccgagggcaacctatgtgcacttcacaccttcctctttcatcctggaaacacatcctattttatgacttcactatcacctctattccatgactctcgaat

SEQ ID NO: 178821 - DNA, 780 bp, Homo sapiens
gcttgagcagcttgttggaaccggagggaggtttcagggactgcttatgaaccagataccaggttgggtcttgacagtctgcatcccaaacaagctcccctgaaacaagcccgttgtacactaaaattggagaacaacccgattagaagaatagactccacagaagaccaagggcatcatcaatcggtaaaattttccaaaagaggaaaaccaatgtaagtctttttccctgaaaaacttagttgtgtttgtaaagagctaagttgacattccaaagtccttggactggaatctccagtgtgtgccatgttcccagtgggcgtgatgaggtgtcctgaggagtatcaggctatggctttgctaccttgtcagtgacagaatttgcatcggctgcattctttgtattctataatttgtgtatggtttaccagtttgctagaatgttagaatcttttgtttttcaccactcagagtggacctaattttgtggtcggctgaaaaaaatttgcatctaggtatctatgtaaagtgtagaagaattgattcttagctgtggattatcttacccttactttagttgaagtgattgatacctgtggctttgaagaacatttgtgagatgatctttttctcgtactgtgctagatagagctttcatcattataccatacaattgtacttttctgagattctttgttggagggggtttagttcctaagagtcaaggattgtaatggagatctatatctcatatctaaaatgatgaatttatgaaaaagt

SEQ ID NO: 178822 - DNA, 855 bp, Homo sapiens
  misc_feature (4)..(4): n is a, c, g, or t
ccanggtagactacatatataggcatagagcttatgccaaattacctgaccagtaggcaggtagttgtgttattggcactattaaaccatgtttcttcctactgcccataaaaacaggcgaaattctaggcttccctgtctatgcttcccatgaaaagagaagcatagctataggaaattgaaaaaatgataagtaaccccctgggttaggtctacctggccaggtagacctaaccagaagaccaagggcatcatcaatcggtaaaattttccaaaagaggaaaaccaatgtaagtctttttccctgaaaaacttagttgtgtttgtaaagagctaagttgacattccaaagtccttggactggaatctccagtgtgtgccatgttcccagtgggcgtgatgaggtgtcctgaggagtatcaggctatggctttgctaccttgtcagtgacagaatttgcatcggctgcattctttgtattctataatttgtgtatggtttaccagtttgctagaatgttagaatcttttgtttttcaccactcagagtggacctaattttgtggtcggctgaaaaaaatttgcatctaggtatctatgtaaagtgtagaagaattgattcttagctgtggattatcttacccttactttagttgaagtgattgatacctgtggctttgaagaacatttgtgagatgatctttttctcgtactgtgctagatagagctttcatcattataccatacaattgtacttttctgagattctttgttggagggggtttagttcctaagagtcaaggattgtaatggagatctatatctcatatctaaaatgatgaatttatgaaaaagt

SEQ ID NO: 178823 - DNA, 344 bp, Homo sapiens
actatgccatatatttctgatgttagcaataatttttgacttactaatgacagttcttggcttacctagacatccttgagttccagggagtcacaatgcttggttgagtcccatgcacaagattccattggttttaacatttgtgtgtgttgccagatctgtcagttttgcttggccctggctttactcatcttcctgggccgatcatcccaagagacagtaaaaaagctttgtgtcccaaactgagaggagaccttaaggtttgcctgatattaaggcttgatgggataactatgccttgcagatatgactggatggaaagaaaggttatgaaagtacttagt

SEQ ID NO: 178824 - DNA, 680 bp, Homo sapiens
gctctcactccatacctccccacaagctgagggagccggctccggcctcagccagcccagaaaggggctcccacagtgcagcgggctgaagggctcctcaatagcgaccagagtgggcaccaaggccgaggaggcaccaaaagcgagtgagggctgcgagggctgcgagggctgccagcacattgtcgcctctcagtagggtctttgagagacaaggtatttcactgtaacagacatcagactaaaaggatcttgctatgattcccaggctgatcacaaactcctgacctcaagcaaccctttcacctcagcatcccaaagtgctgggattacaggatgatccactatgtctggcccataaataggagggaacaagtaaaaacatggcaatatggcaaaacaatgaaacatttgttaatgaattgaaaacagcaaaactggaagtttcctagacatccgtgttcttaaaggaaaccacgaatttctgaaggaaatgttgaagacacagggaagggcagaataaaagcaaagaatccttgagactgtcaacagagctctggcgggccttaaggaatgcacatctagcagactctcaagtccctaatgatattttggaagactttctggctactttgcaacaacctgagtatttttggtactattaaggggtcttaaacctc

SEQ ID NO: 178825 - DNA, 674 bp, Homo sapiens
gtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataat

SEQ ID NO: 178826 - DNA, 640 bp, Homo sapiens
gaaatcactggctagtcagtcaaggggatcccagtgccaaaagtcacaacttgactggtggacctggttcaagcacttaagagctgttagattaaccagacatgaaaaaataagactgtcgtgagaggataaactggacacaaaacacagcagtgccaccaccttcaggaagtatctgcacaagaaggcacaccaaaagcattgcacaacccaacactgtggcatttccctcttaggcttttacctcagatttgagagatccaatattcaacataaaaatgagatccttaatttctaaagaactaagtactccaccttctggataaacctgtcttttatatgagtaagtgttaggtcccagaagctacaaaatactggcaaaaatggcaaaatcacaacaaagataatttagaattacaatggccattacatggagcatttcagataaacagcactgcactttaagaagtccatttaaaaataaggagtcctaattcaggccaacccaggggcatctattggtatgtagaagcttctaaaaagatttcaggccagcacagtggctcatacctgtaatctaaacactttgggaggccaaggcaggaggactgcttgaggccaggaattcgaggctgcagtg

SEQ ID NO: 178827 - DNA, 166 bp, Homo sapiens
atggaataaagtacagagcccagaaatagatccacacttacatggtcaaatgatttccaacaagggtgccaagatcattcaatggggaaaggacagtcttttcaacaaatggtgctggggaaactgcacatctacatgtaaaagaatgaagttggaccttagctaa

SEQ ID NO: 178828 - DNA, 469 bp, Homo sapiens
aagtaaccttcagataacctctgaattagacaaaattattctttttctcaataaaaacacatcttcttggcacattttatatacagaattacatattaactagaattcttgtccttagtaatgttaaattttagtgaaaacctaggaagcaagaaatcctgagttgcctatgagatactagcattttatagatgagaaacattctgcaatttttagaaacatgtttccccatatcataaccttttcttaattggaaattaccagacaaccaatgagcatccaaaatgactttaagattttaaattacacaaaaactttatctatagcacttatccatttatattttatttatttttagtagtttataagattctttatgcatcatttccttgttaaccattttataacctgtgaatatcaaatgttcacctaagtaagaactttaaattaactgcatgggtattttcac

SEQ ID NO: 178829 - DNA, 263 bp, Homo sapiens
cctacattcctaactaatcagccccccagtgggactttctccagccacacccagcaggctggattaggagtagacagagtttaagatcttagaggaacagagaacactgtgaggggcaagaagagaatagaagtgtaaagtttatagctgtggtcagagtagatcttgaaaagcattctggaagagaagcagttccttccgagtgatgacacagtcatgaaagcaggatgctacaacgccgtggaggtgaaagggatgtatgg

SEQ ID NO: 178830 - DNA, 438 bp, Homo sapiens
cgtctactctggaggttgaggcagaagaatcactcaaacccaggaggcggaggttgcagtgagctgagattgcgccactgcactccagcttgggcatcagaataagactcaaaacaaaacaaagagagtttgacagttccttaaaaagttacagatatggccaggcgtggtggctcacgcctgtaatcccaactctttgggaggccgaggcgggtggatcacaaggtcaggagttcaaaaccagcctggccagtatggtgaaaccctgtctctactaaaaatacaaaaattagccgggcatggtggcacacacctgtagtcccagctactcaggaggctgaggcaggagtatcgcttaaacctgggaggtagaggttgtggtgagctgagatcacgccactgcgctccagcctggggaacagagcaagactctgtctc

SEQ ID NO: 178831 - DNA, 524 bp, Homo sapiens
  misc_feature (37)..(37): n is a, c, g, or t
  misc_feature (78)..(78): n is a, c, g, or t
atctagaggatctgcccaggtagattgccaggtaccnagacccaattctgtcggagacaacgcaattaacaacttctngtgcatcttatcagacagctggcgcgcacacccgcagatacgcccaccctcaggcgtccttctacgcaaagatggatagcacccatcaacgctgttttttctttttttagacggagtctcgctctgtcgcccggcctcccggcataatttttaaaatgctcatcctatgccctcattccccagcttgcagctgggggcctcctggtgcttttctgggacttcgagtaagtcatttcccctctctaagcctcagtttccccacctgtaaagctgaagccacctcctccaaggctcccgcgaggctatctgcctatctgttgtgtgttcctttaatgtatgggagtgagattgcggtttttgaatctgggtcctgtgccaggaggaataagtggtgagatacctactgtttgtctcactcaggtcttccaccaacccctccagcctgt

SEQ ID NO: 178832 - DNA, 561 bp, Homo sapiens
gtcatcttctgaatccccaagctagttaaatgtttatctgccattacatttacaaaattaaaacactggccaggcgcagtggctcacgcctataatcccagcactttgggaggccgagacaggcggatcatgaggtcaggagatcgagaccagcctgactaacatggtgaaaccccgtctctactaaaaatacaaaaattagccaggtgtggtggcacgcgcctgtagtcccagctactcgggaggctgaggcaggagaatcacttgaacccgggagacggaggttgcagtgagccaagatcgcgctgctgcactccagcctggtgacagagtgagaccccgtctcaaaaaaaaaaaaaaaagatacagtgtagtaataaggagttagtggtctgatttcaccttaccagatcaggctcttatccactactccaattatactctccctcttttcaccctattctgaatgtgctgtgcatgtgcattaaattaacaaatatttattgagcacctgcaatatgccagataccttgcaaggtgttagagataggaaggcacagt

SEQ ID NO: 178833 - DNA, 1108 bp, Homo sapiens
aggcaagtcattgatatgagactgaggggtagaaagcaaaacaacagcagtgttcaaacaatcctaggcataaccagggccattgtccaaaggacagatgctttgggaacactaagagatgacaagtgacctcaagcagaagttaatgaaacaggaaccatttgcttcacttccccaagctcagcctataacagaaatcaactacgtttatcagtaaaggctaaatggccttgtgggccatgtggggtctctgttgtaactcctgcactctactattttaacatgaaagcagccacagttaacaaacaaaaggttggtcagatatgactcgtgaaccatagtttgccagcccttgatctagaagaatcgtcacactttagagcctaaagaatctagataaatcctatcattctcagatgggaaatctgggacccagtgagggccatgactcacccagggtcaaagaccaagtggatgtctccctacccttaacttctggtagcttcctcaatgttctttgatagatttaagaaatagatggttaagcaagtagaccccagaggctgtatctaagacctctttccccaatctttcatgtttggaggggccactctgaaggcgggatccaatgggacacagctgtcctgggatcaggaaagagaggttttctaagccatttctgcttcgccaggtgttccctcagagtcaggccatcttcctgtgttctggccctaccatgaacaaactgtggggcatggggcaagtcatttctctcttggcttcaacttagtgatctgcaataaggcgagactgaactaaaaagccccccaaatctcttctggctgtaacatcctgtgacttaatcaattcctggccatgaaacaagttaatgagtctgtccttcgttgctgaagagaaagcacctcagagttgtttgtctggtgtctccagaaggagacacattcttccttaagatttcccaagtcatctttgcaaggtggctgaggcttttcttaaagaagccattaattttatttagaagactggttcatactttgtcagaggggtgacgcttatttttgtttataagatactgaactatgcctcc

SEQ ID NO: 178834 - DNA, 238 bp, Homo sapiens
caaactcctctccttgcaccgttaagaccttaccccaatctggttcttgccggaatttcccaatatgtttctaacaaccaccgcccttgaccaccagctgtgctcccttcagacatactagccttatcccaagctcatttagactagaatattctttattcaggttcttacaccagccaccgatctaaaaacatcacccaccccaaccctaccttggaactctatcctatgactccat

SEQ ID NO: 178835 - DNA, 496 bp, Homo sapiens
ttaccaggagtaaacagagatggatctatttatggtttgctttgtctgttccccaccctaccgaaccaagcctttctccctgaatgtatgtgtgttcacaaagcagtgtggtacaaggttcgtcagaaacatgcagtgttgttctcgtagtttaactcccacttataagtgagaacatgcagtgtttggtttactgttcctgtgttagtttgctgagaatgatggtttccagcttcatccatgtctcagcaaagggcatgaactcatctttatttatggctgcataagtattccgtggtgtaatacatgccacattttctttatccattctatcattgatgggcatttgggtaggttccaagtcttagctattgtaaatcgtgcagcagtacacatacatgtgcatgtgtctttatagtagaatgatttataactcctttgggtatatacccagtaataggattgctgggtcaaatggaacttctgattctagatc

SEQ ID NO: 178836 - DNA, 183 bp, Homo sapiens
cggcacgaggggaaagaccaggccacagacaagggaggatctgggccgctcctgcctgtgtgtccacacgtgggcaagtggacatctcatgatgtctgtatttggagtccagtagtacactgaaaataatcccgtaaaagctttattttaaaacatcaatattttcaatagtgaaaaaaaaaa

SEQ ID NO: 178837 - DNA, 659 bp, Homo sapiens
tgatggctgtaacatgcagccacggtggggagccctgcttcaagccactgcatattatggatatacaaattgacaagtcagatagggtaggagctgattatttctgtaactcactgcttcttaaaagcttgccaggattttcttaaatatacaagcacctacgaatgcatttaagaattttcctttataaacagttacaagccaatgactgaagaatgttctagggctgagacaatttaaaccaaattgttaggacacactccctagtaaggacgaatgagaattagagaagtagcaagtcattccagaaatataaatgattaactgtggcctcatttattaaaagttgggtatatacacaaattcctctatgaaatagagggactcctctatgaaaattaacttacatccgttctgtgacaggtgttctactttgaaaatctttcaaagtagaaagagtagaagtagaagaggtgagagaagaatctagatatattattagatttctaggtttgggatcacctctaaattattgcccaaaggaaaagccctccacttcttaaggattctcaccaaatgtgttggaccatatgaagtgaccatttttgtaggtcaaaaatggctgaatagtgatggttacatatagctctatcttaaag

SEQ ID NO: 178838 - DNA, 194 bp, Homo sapiens
cacagctggctaattcttacaggggtctcactatattgctcaagctggtttcaaactcctgggttcaggaaatcctcccacgttggcctcccagagcactggggttacggtgtgagccactccgcctggcctggctgtgggtctctagacatgcttgttaccaagctgacgacgttctgctcatgactggctga

SEQ ID NO: 178839 - DNA, 260 bp, Homo sapiens
ttcagccttaatttgcttttgcttaagctgggtcactaatctgtgctgaggacccattatccattctttgttaggttctacagtttacctctagggtacatttcatagtccttaatgtctcttctgtataactgattatttatggaatttcatgatgcgttaaatactttggctgagtagcaaacacatttcatctaatctttcaattccacaacagtactactgggcaacatttttattcttggtggatacaatttctt

SEQ ID NO: 178840 - DNA, 646 bp, Homo sapiens
tgggcaacagagcaagactcttatctcaaaaaaaaaaaatatatatatatatattcttgaggaagtgtgcctagcaggtaaattttttgaagctttattctaactttatacttgaaattacttggctgggtatagaattctagattggaaatcctgtagctttagaatttcgaggacattactgtattgggttcttagttccaaagatgatgtttgaaattcaagaatgttctaaatcctgtgcatggtatgtgaagagttttttcttctggaagtttgcaggactctgtgtgtccctgatttcttaaatttcacattgctgtaggtacttttaaactcatgtttttcagcattgggaaattttcttgaattatttcaagatattttctcctctatgtttttcctcatgttttttggggagcacccattatctggatatagaacagtctgaattaattcttctaattaacatatctttttctcttttttttcctttatttgtttttgagacagaatcttgctttgtggcttaggctggagtgcaggggtgcgatcaaggctcactgcagcctcagcctcctgggctcaagcgatattcttatctcagccccgaccatgcacagtgctgtgattacaggtatgagcc

SEQ ID NO: 178841 - DNA, 1563 bp, Homo sapiens
tgggcaacagagcaagactcttatctcaaaaaaaaaaaatatatatatatatattcttgaggaagtgtgcctagcaggtaaattttttgaagctttattctaactttatacttgaaattacttggctgggtatagaattctagattggaaatcctgtagctttagaatttcgaggacattactgtattgggttcttagttccaaagatgatgtttgaaattcaagaatgttctaaatcctgtgcatggtatgtgaagagttttttcttctggaagtttgcaggactctgtgtgtccctgatttcttaaatttcacattgctgtaggtacttttaaactcatgtttttcagcattgggaaattttcttgaattatttcaagatattttctcctctatgtttttcctcatgttttttggggagcacccattatctggatatagaacagtctgaattaattctgtctctacaaaaaaatctaataagttagccaagtgtggtggtctacctgtaatcttagctacttgggaggctgaggttggaggattgcttgagcacagaagtttgaggctgcagtgagctatgattgtgccattgtactccaatctgggtgacagagtgagaccctgactcttaaaaaaaaaaaattctgtggtttataagccacccagtttatgactttgggtatagcagcttgaatgaactaagtaggtatgttttctaagttgcttttaatatttgtatgtaaaattagcagaaaacgtctctttcacaaacatacagatagtgctttttcccctttttcttttttaaaaaataaggcgaatatccatatccccagttcaagaaacagaacttttcagccatccaggagccatccatgtgttccatttcagtgtactcacctcccaaaaagaaaataccatacttcactctctctcagtcatttccttttcttttatagttttatcaccgtgtacattcttagacattatattttatttagtgttatgatgtcttttaaaccacagtttatgcctctatcccttttttttccttagtttttatgttgaagaacccagggagagttaaccaaagtttgaattttactgattgtacactcatgttgcatctttcttcattccttgtatattttgcaaattggttactgaactcagagacttggtcagactctggttcggtctctttagcaatactgtaggcagtgttgtgttctttcatggggaggcagaagtctggttttctcttttttttaaatcatgtccgcagttgttgggctcagtgcccagatccattaatttatcaatggtttaaaaatagtgacattctaattgtgtgggtttttttaaaattttttgttggaatacttttattaagagatgcttctgcttacctgctgttcagttatccagtggcacagttatataggaaaggtaggatatatacttgattctttgcctttatttattcttttttcaaaatagtgacttagttccctattattctctaagagaaaccgtcgattcgaggggtcctctaagtcg

SEQ ID NO: 178842 - DNA, 1162 bp, Homo sapiens
tgggaagattgcttgagatcaggagtttaagaccagcctgggcaacatagcaagattctgtctctacaaaaaaatctaataagttagccaagtgtggtggtctacctgtaatcttagctacttgggaggctgaggttggaggattgcttgagcacagaagtttgaggctgcagtgagctatgattgtgccattgtactccaatctgggtgacagagtgagaccctgactcttaaaaaaaaaaaattctgtggtttataagccacccagtttatgactttgggtatagcagcttgaatgaactaagtaggtatgttttctaagttgcttttaatatttgtatgtaaaattagcagaaaacgtctctttcacaaacatacagatagtgctttttcccctttttcttttttaaaaaataaggcgaatatccatatccccagttcaagaaacagaacttttcagccatccaggagccatccatgtgttccatttcagtgtactcacctcccaaaaagaaaataccatacttcactctctctcagtcatttccttttcttttatagttttatcaccgtgtacattcttagacattatattttatttagtgttatgatgtcttttaaaccacagtttatgcctctatcccttttttttccttagtttttatgttgaagaacccagggagagttaaccaaagtttgaattttactgattgtacactcatgttgcatctttcttcattccttgtatattttgcaaattggttactgaactcagagacttggtcagactctggttcggtctctttagcaatactgtaggcagtgttgtgttctttcatggggaggcagaagtctggttttctcttttttttaaatcatgtccgcagttgttgggctcagtgcccagatccattaatttatcaatggtttaaaaatagtgacattctaattgtgtgggtttttttaaaattttttgttggaatacttttattaagagatgcttctgcttacctgctgttcagttatccagtggcacagttatataggaaaggtaggatatatacttgattctttgcctttatttattcttttttcaaaatagtgacttagttccctattattctctaagagaaaccgtcgattcgaggggtcctctaagtcg

SEQ ID NO: 178843 - DNA, 147 bp, Homo sapiens
ctaagttacacaaacaaacaaatgaaaacaaacacctaaaaaaggacaaattaaagttcacgatacactacaatctagtaacattctcatgcaaagcaggagtgttctcaagtcagagtaataaatacttaataaataaaaatcctg

SEQ ID NO: 178844 - DNA, 273 bp, Homo sapiens
aaaacccacacagacatggggaagtgtgcaaactcagacagtggccatggccaggaattgatttttttccctcatcaacattatacaaaacaacattgaatgaaacaacattatttgagtaccagctgtaaatgcatggtcatagaaacatgaaacagcatggaatatttggggaattgctttgttgataggtgtggctagactgtaaagttaaagatgtgtggcagatgagcccctagaatggagctagatctttgtcttgcgtgccttgca

SEQ ID NO: 178845 - DNA, 171 bp, Homo sapiens
ctgtcttccatttgtgttcttaatacgtggtcattcttagagaaaactcttctcagataaccaggcaacgaatggagggactgttcagggcctatctagggaagcaggatgtaggattatgatgggcctcagaggcaggcgtgtgatgttatcttcaaatgagcttataca

SEQ ID NO: 178846 - DNA, 794 bp, Homo sapiens
aactccatctcgaaaaaaagaaaaaagaaaaagaaacttgaaataagtctgtttacaggggtgtccaaactattggtttccctgggccatgtgggataattgtcttgggccacacataaaatacactaacgttaacaatagctgatgagaaaaaaaaatcgcaaacaaaaatctcataatgttttaagaaagtttatgaatttgtgtaaaattcaaagctatcctgggctacatgcggcccgtgggccacaggttggataagcttggtttaagatgtgtagaaaaataagaaaataaaaagcaaaagcctttaaaaaaagactatgaagattaaaacaaaacaaaacaaaacaaaattgtaggaataaaagatgtagaagttgaaacacagtatctaagaaatgggttacacagtagaataaatacagccaaggaaagaactagtgaattggaagacaggttaaggaaagcagctagtacacagtgcagagaaaatatgaaggaaaagttaagagacatggagggtagaatgcatggaggacaagtgtccaacataccttaacagaaggagacaataagaaggaggcaatattgtaaacaccatgactaggaattttccagcatagaaggcaaacacgagtcctcggactgaaaaaacagactgagtctgtagtaagacaaataaactcttactgagacacatcagagcaagagagccagccatcacagagaaagaaatcctcaaatctcctggaaagaaaagacacaggactttcaaaggaacaacaatgaac

SEQ ID NO: 178847 - DNA, 399 bp, Homo sapiens
cagctcacttgtgggaaggtggcacctggttcaagtgaacctatatgagatcatcacccttccaggggccctcagggaagggctgagaactgctgtcccaggtgtgtggaggagctgcaggcgagatagggctgtgggccagggagaggagcagacaggttgtcccatcgccatgggagcctgcatgagctttagatgggggagtcctgcacctctgacctggatgctcctgtgtaaagagttggcttgctcagtgagatccatgccagggggtaaagtgggaactgatgagcaatgaggggccagagtcctgggtagtgctcaaggactgaattatgcgtctgtattaatcttggttgctctgacagcccctctctgtgccccaccagggataaagat

SEQ ID NO: 178848 - DNA, 336 bp, Homo sapiens
ttcaatttctacacagaggttttgactcactaaagtttgggaaccactcctgtggagcagggtttcccaacctctgcactgttgacttttttggctggatgtagaggatgggttaaaaacaaggaaggaattattcctgggttatgatttgggcagctgcatggagagtggtgctttatactgagatatgaaatattagataatgagatgggaagtaaagcctatttgagaggccatcttggaggctaaaagtttgagatgtctaatgaggcattcatgtagagatacactgaattagattttgctaaaattaaatattgtgagtgtgggacagca

SEQ ID NO: 178849 - DNA, 182 bp, Homo sapiens
cctccgagggcaaggtcctgggaaggagcccatgccccagtgggaatgcatgtggcagaggcacacgcatgctcctcacagcagcaacaaatgccccctgcacagttttggatgttggagtggctgctgcacctgtgcgctttcctatctacacccagcttcccccactggtgttgctgctc

SEQ ID NO: 178850 - DNA, 691 bp, Homo sapiens
ggatgaagcaatgtaataaatagatacagccaaacagatgagtgacccagagacagagagagcatccgttggggtcaattgaccctttgatgaaaaaacaggaggaaacacatactgagacacatcaaactgaagatagtgagaatagtctgttttagttgatattttctaatacttaggaatttctaagtcttaatatttctaacttaaatatagggcttaaaatatttgtaacaaggtataatgtgtatggtgttcacattacagttgtttttgtgaaacggaaagaaaagtgcatgcgtgactgtcttttgggctttagggagttaatgaggaaagggcagtaggctgagcagtattgtctacctggtatatgacttgtgggcatctttgcaggtcatggcttgagcatgggaaggcattaaagaattttgacttgatacagactcctattcctggccttcctggtatgggttgatttggagatgggatcactttacctcattcaggcaggctacaatttaccaaggagcctccttggaaccaccgatgtttagagggataatttttggtgctgatgcagaggcagtatcaaccaagaatcttggttctataggaattttatgccttctttagggagtattaaactgcctttctttattttaaaagtccccttaaattgagaagttgg

SEQ ID NO: 178851 - DNA, 1394 bp, Homo sapiens
gttcttgattatagatgataaagcttaggtggaaaatactaatattcattgtaaacgtatacgaactttggattcattttgtggaatcaatattagctacagagaaagctctgattatgcttgtataactggtatttgaaagggcaggcaagaggccagtgttgcacaaacaggaaggggtgtaaagagacagttggttctgttatgtctgtaagtcattcttgccatttacagctcttcttaacaatctgttttcttatattacctaagtgctttaatatcacttttatatctctaaatacaaatgcaattttattttctcaaagctgcactcttgatttgataatgtaaacaaaactttgattagctcacttgtttcaaaagaatcgctgtatattttctctcctagatcattaagtactttaaatgttgattgatgttgtaatactgtactttatttttaacacaaaacttggccagacagcaaaaatatttgccaggagaaacaattttgaaaaagacagattgccttttgttggaagaaagtacatggagacttgaatcgtaaaggcaaagtattggttacttctaagcatctgtagactaatgattaattgatacacagtttcagcatttaaacaatattaggaagctcacttttaaaagtattttattccaaatggttgattatatcattgctaccagagatgagatgattcagtctggtcaaacatatgaaaaagagagctgttgcaaataatgccaatattgaaacagtagactgttgataatttcagtcatttcttaagagtatgtatgtgcatctgtgcttatgaattaagagtatttttgggccttgtgtgaaaagtatgaagacagatgcttatcaggcactaaatatttaatgagaaccaactacttggcttcccattaggtgctatatgagatactagatagtatcccttttccaaggagtttagctaaggaaatgacacatcgtgtagataccccgtaggttagtaattgaagacagtgatgcacaacagtgatcataagacagggcatatttagttcctccagaatcccattaagggtcaggcagcattccatggagaaaaggaacttgagtagagacataaaccagcagtagggaactgtttaaatatttctccctgtctccctccccctctatccctcttcccgggaaagtaacgaagaaaataaatcctacgatcctaagtactatagtttaatagacagtgttggctgttaaaagaattactgctatccttccttttaaaaaattattctttcagcattttacctgaaagtgttcttcaatacagttccaaagacttcacatgccatcccatatccaaactcagtagagtggc

SEQ ID NO: 178852 - DNA, 237 bp, Homo sapiens
tgacaaccatgccatcacaacaatgcaaacgtaagacaaaggcacagactctttgcctatgtcgctgaggtacataaacaaagacacagacttggtatccaggaaaacaagctcctttgtcaatgactctcatgaaaacagaagtctgtccctgtaactcaggagtggggaaaagtcccagaggctgttgatcacccacctccattccagtgctcagaaaggccactactcatcctc

SEQ ID NO: 178853 - DNA, 313 bp, Homo sapiens
ttgcttctgtgtttggagatgagtaagcagggagtgggtgcatatgcaaacagggtggtcagaaatgctttggccggatgtgtgactgaaggctatgtgcagctgaggaaggctgggccaccacagtagcagagaggctgaccaatttggcatgcagcaagcaggaagtagaagggatcttaagcaagcaaagtgtttgggtagacaagattatgaggaatgagcaccaatgacatttccaacaagcactgaaagcttccaaatgcttctaacagttactgcctgtacaaacacaggacagtcttgactatgt

SEQ ID NO: 178854 - DNA, 331 bp, Homo sapiens
tggtataatattagtcatctccatctcagctatggctaataggcctttggctctgacccagaggtgacctacagctaggaccctgaaaggattccgtagcttcgaaggtagttactatcctgaagctcagctgtttcttttcaaatgctagatactatctaactgccctaataggaaacatctaatttgtcttctcctggattttgaggactatacagagttcaaacagaaaacacagtttttatccatctcttctgtcagaggctaagtttgtctaatccttcctatccctcttaatatatcaacatattttcatgatctaaccttgcta

SEQ ID NO: 178855 - DNA, 463 bp, Homo sapiens
tcacacagaataatttctctcactcagcgatacgcacttaaggctcatgcaggcctctccacggcttgagaacatcttttcaggactaaataatgttccaccatctggatgcacggagttgatccattcatctactgaaggacgtcttggccgcacttttccttgaatttccattgatatttttctcttttcgtaatatatattattcggatactgcaacacccacactcagcctctgtttatttttttcatatcatttaccagctgtcattttgctgtgagattttccctttattttctaaaccttcctttgattttatttttgctttttaaaaattattattggccgggcacggtggctcacgcctctaatcccagcactttgggaggccgaggcgggcggatcacctgagctcaggagttcgagaccagcctggacaacatggagaaaccccgtatctac

SEQ ID NO: 178856 - DNA, 310 bp, Homo sapiens
tctgggaccacgaggacaaagtgcatagtgcactgcatagtgccacctgaggcacagcagccctggggaaggatgcagagcagtcttgagtacctatctgaagtctttgaaactagcttcttttctggctccaaagagatactgagatactgggatgggtatatacccttaggatgaggggactgagtttttccaaaattgttactgacatggctgagaacatgcttgatagggaataaggtgagtgacagcttgaagaaaacaccctggcacccagtggtattcttatggcccttgcattccttctcag

SEQ ID NO: 178857 - DNA, 369 bp, Homo sapiens
gcacacacacacacacacacacacgcacgccttcattccatatcccaagagccatagactccataattcaccaggagactccaaagctcctgcagcccccaccactgtcccgactcagctttgggacagcttttcctccccggctgcctggcccctttctctgcccctctacactgcagggctagtggtgctccaggacttaccacaaatcaagggcagataaaccacaaccaacctgcaagtctgccttaaaaagaaacttccttcccacctgccttcaaatcaacaccactcctcgctctgcaccaggcatcctccttctggcctatgacagacaagcaagcaactcccagatcatccctcatcccc

SEQ ID NO: 178858 - DNA, 449 bp, Homo sapiens
cctggttatagtgaggagtcaaaaccagcctgcgccaacatgacttcttaagttaccccatctctactaaaaatacaaaaattagccaagcatggtggcacacacctgtaatcccagctactagggagtgctgaggcaagagaatcacttgaacccagaaggtagaggttgcagtgagctgagatcatgacattgcactccagcctgggtgacaagaggaaaactgtctcaaaggaataaaaaaaaaaaaggtttttccatgaaccaagtccttgaaatgaaaatgatctatcctctcacatcatgatacttgtgaacttcagtatctgtatcttcagtatttttgtccaaacatacagtttccattcttgtcagaggaccaataccagatttgtcaaccaagaaaggtaaacatcaacctcacacataaaatcaactcctcactataa

SEQ ID NO: 178859 - DNA, 504 bp, Homo sapiens
tagaaaggaacaagaaatgggagagacctaagaaggaagggagaggcagaggctaggttgggagacagtggagaaagaggagaccctggagagaagaaacacgtgggttcaagaaaactactcaggtcttatctgccctccagtccagctctaggctgggtgttattacttccctttaaaatgggaacaagcagctcctgacttggcactgaggcaccgacagaagcagatgggccaaactgtttagaactgcagcgcaagaagtgtccagaagagcgcagctctaaaacactggattcagttagagatgtcctgcctgagaaaggaaaatgaaggcattctgacatctacagtctccacagctctgtcatacatacaacaagactggccccctttgagaaatcagcgcattgctcttaaactccaggaggaaagcaggacttctttcaggcacattcctgtgtcataggcagtaacgatgcttccagctccctggttgtacaa

SEQ ID NO: 178860 - DNA, 155 bp, Homo sapiens
tcccaagacaaagtcagagctctaacacaatttccaactctccaactttaaatcttccacttctgcttcttgccttcctcacttcaatccctggttctaaccctactgaactactttcagttcctactgcaatatacgtgcggtctctcaccaac

SEQ ID NO: 178861 - DNA, 409 bp, Homo sapiens
tgctgggattacaggcatgagccacagcacccagccaagggttatttttattcatcatcaagattaaaagattgagtattgaaagtggaacaaccctaccccaatcctggcttttcattttagccattatataccagaattgcacctagtaatctagatacatacatgtggttttgtagctaaggtgtgttaggttttcttttctatctccagtatagacttttttttgtctttttgtctattacagcacatgagacttctatgtttaggacacaactgatactaagtctgattcctaaattatcctatttcttcccaataccacttaaataatattttttatgccagttctttaggaaacttctggctgggttttgtgtgtatcactcaattttaataaaaacttcga

SEQ ID NO: 178862 - DNA, 309 bp, Homo sapiens
cagagctgatctagagatccctccggttgcacgatagttacgcgtcaaagtattgggattacagggctctgctgccctgcatagccttgggacactgctctccacatcctagttgctccagatccagctatggctcatagaggcccaggttacactcaggccactgcttcagagggtgcaagctgtaagccttggtggcttccatgtggtgttaagcctgtaagtgcacagagtgcaagagctggggcttgggagcctccaactagatttcagaggatgtatggaaaaacttggatgtccaggcagaag

SEQ ID NO: 178863 - DNA, 1299 bp, Homo sapiens
ggcacgaggcactgatccaaattaactaggatggctccaagtggtagatagtactaacagcaagctgcagataaggagggtaggccctacttccatgtgaggtaattagatacagtttttgctgaaatctcaggtaaaggatatattagagacctaagcatagaattggaaggagcaaattgctgtctggttcaggcttctcagactataagttgctatgatctccacctcaggatcttgttaaaatgcagattctggtggtggtggtggccaggggctgtggggagggaaaatgaggagttacggtttaatgggcatagaatttcagttttggaagatgaaaagagttctagagatctgttgcatgacaaacgttacctgacagttaaggagaggagctgctaaatgggtcgtgtgtttctgaatgggttcctgatagtcctgtgaccatgcggaagccagcactcctcatccccaccaacataattcatcatgaggagagacagaaagaaacctttgtggtgtcaagcagcaaaacaaaacaaaaagattcaaattaagttggtttgggtggggcctgagattctgcatttttcccaagtccctaggtgctgccagtgctgctggtgcacagaccatctttgaatagcaaggctctagataactgggctacagatgaactctggaagcagctgaagaacggttggctgttccatcctaagcagttactctgatctagtccattatgctatatactgttttcgctcatctcttttcagattggaagcctgccttttacacattgctttttaccacacgtttccagaaagttaaaatgcggggtagagggaataaactacagggagacaaataaattaaagagatgagttgaggtggataaggatagcttaataacatgcaagctaatttacaaaatttccatataggttattattttgggcacagtggctcatgcctataatcccagcactttgggaggccaaggtgggaggatcacctgaggtcaggagttcaaggccagcctggccaacgtgatgaaactccatctctacaaaaaatacaaaaagccaggcgtggtggcaaatgcctataatcccagctactcgggaggctgaggcatgagaattacttgaacccaggaggcagagatcgcagtgagttgagattgtaccactgcactccagtctgggcaacagacggagactgtgtctcaaaaaaaaagtgttcttgtataccatgtttgaaaagcatagttgataaaggaagaacatgtaaggc

SEQ ID NO: 178864 - DNA, 429 bp, Homo sapiens
acacggaaactcgagttttggcaagaacacataataaacttcatccttcatgttagttttctttcttgtacttctagctatttgctctgaatttagcaccttgcatttgctaaagttggctgtactttttgtttctacatgtatcttttaatagctttctcactgctcaaattcagtaaggaaatcagttaggagcaataaaggtaagagacagagaaaagagggagggagaaggaaaagctggagctacaaagtaataagctcccccaactaatggtgttatttgctagaaaagataaagacctaagagaatatagaattaagaaaaccaaaatataaaagataaggattctcaaatatgtgaatacactaatcatcccacgcagcatatgtggaactgattccagaactacttgtaaaactttatgt

SEQ ID NO: 178865 - DNA, 225 bp, Homo sapiens
agttggcaaatcctggatacctagggctgtgtttgtgactgggtggtctgttgaccacttggatcagaataaggaccgaggacacaagcaaggcaaagctcttgctctgtctctactttgacttctaacagcgacaatggccagcattcaaagaagaagagactcttttctttctaatgggaacactagcttgaactttgacttgttttggatcaaatccattag

SEQ ID NO: 178866 - DNA, 480 bp, Homo sapiens
tggggttttctttgcagactgtacgtgatggactgtacctaaagtgaattcgtagttttgaaatctttaaagcatttgagtgaaatgtggaaatgcatcatcgtgagtgtgttgtgttgggaatatggtgactgtcttcttgctcactcagtagagttggagaattggtagggagcagcttgaggctctgacacagggatacccacagggtctcggtgtctctggcgcccttccctctgcccggtgctggcttgtggacgggctcagtctgctctgccatagaaaaccatttctgtctgctgggtccggtggctcacgcctgtaatcccacctcccagtttcagattctttatcttgctagatgcttttgtgaagcgccttcgtcagtgggaggtgagtttgacaaggccctagcgggtgtttgtgagacagaggtatgactggagcttggaggtggtgtttgggaaaggtgggagtgag

SEQ ID NO: 178867 - DNA, 459 bp, Homo sapiens
tcccaaagtgctgggattacaggcgtgagccaccgtgcccagccttgagaaatgtttgtttttgtttgtttttgagatggagtctcgctctgtcacccaggctggagtgcaggagcacatctcagctcactgcaacctccaccttctgggttcaagcaactctccctgcctcggcctcctgagtagctgggattacaagcgcctgccaccacgcccggctaatttttgtgtttttaatagagacagggttttgccatgttggccaggctggtcttgaactgctgagctcaggtgacctgcctgcctcagcctcccagtttcagattctttatcttgctagatgcttttgtgaagcgccttcgtcagtgggaggtgagtttgacaaggccctagcgggtgtttgtgagacagaggtatgactggagcttggaggtggtgtttgggaaaggtgggagtgag

SEQ ID NO: 178868 - DNA, 519 bp, Homo sapiens
gtaactcatcatcacaggggctaccatcataaatacagtttgtaaaaggagacaggatccttggaaatgtttccagcaggtggagcacatcatggctccaatccatgtgcggctcccctttattgcttactaaggatgcatatttcatatcctttaaaaaaataataaaatcacacacatgacagcaagatttaataagagagtctcaagccaaagagtaacacctagtgccaatctggatattttctggggcataggattgagaaatttcaggagacctctgaaaaaatacacatacaaatccccaaaataaaagctccagaacacctggtgctcctccctgggcctctgcgcctggccatgcctaggacacaggagaaggtgtgggagaagtgcaacgctcaaagtccactcgtaatccctgcaagacgcccacgcatattccaggaagatgagaaggtattcattttaatgcagcattcatagtttaactaaatacatgacagaacccacgaatca

SEQ ID NO: 178869 - DNA, 134 bp, Homo sapiens
tacaacaaattgtttgataagcctccaaataaatctttgagttgcctcccctgcctttcaactcattagagtgaacatctaatccctctattcagaatgctgcatgccttatgttgccactagttctcttatca

SEQ ID NO: 178870 - DNA, 780 bp, Homo sapiens
acacatttagcttgatgcctaatattatgggttggcaaactatggcctgtgggactgtaaagtttttgtaagtaaagtttcattgaaagacagagacgtccatttgcttccatattttctgactgctttcatgctacagtggcagggttgacaggccatttggttcacagagcctaaacattaattctctggccctttggagagacagtttgctggcccctgccctacaccatgagttctcaaggtcatctcagtgtagtattgagcatctttcaatagtatcttacacatcctcctttttattgatactctgaagttttgtttgatggtatttcacttgattggctcagtgttttgtacaaaatttgaattgaggtagccttaaacagagggcaatcaccatttccatccttaaacagtagcctcacctaattgtacatctgtacaattgcagacattagagcttaggagcattcccttagtcatctgaaatgctgatgcactgaggaatgcaggtgtaagtaggcatagtgccctatttgtatcatctgtcaaaattccttctggcaaagggagtatatgaggcccttaagtaacccaagtaatcctgagctggaaagttgcagtaggagtagagagtactacctaatttttcttcacgtatgacgttctttgtgaaacttgaggtaaagagctgtgcccagggtacttgagaatcaggatttagattgttaacatcgaaccagtgtgcaattaactctaaatgagacagaagcacta

SEQ ID NO: 178871 - DNA, 405 bp, Homo sapiens
tcattactcaatagagaaatgtaaattaaaaccaaaatgagatgtaactatatacctttttataagagctaaaaaatttaaaagactgacagtatcaagtactgacaggatgtggaggaactggaactcatactgctggtagaaatgtaaaattatacaaccagtttggaaagttctttggtagtaccttaaaaagttaaatataaggctgggcatagaggctcatgcctataatcccagcactttgggaagccaaggcgggaggatcacttgaggcctggagttcaagatcagcctgtgaaacataggaagactccatcttctataaaaaatataaataaaaactggccaggtgtgatggctcacgcctgtaatcccaacactttggggggccgaggcagatca

SEQ ID NO: 178872 - DNA, 532 bp, Homo sapiens
atgcattccttagttttactgcacttcttatcaccagaacaggaaaggaatggtgtcctacagctccttgaccaagtacctctccaccaatactatgagcactaaagatgcagcaacgaagcactagactctgggatgtgaagatctcaaattctattctctgtgcacttcagagttggagaaggatccatcaagtttcagtagaatgtaccaaggaagggaggcaatgtggtagaatggaaagaataaggattgtagttgagacacctgcaacctggacctgctagtccacctactgctgtgtaatcttggacattatgtccacctctatgggtttcggatcccttatctgtaaagtgaagagattgtccagatgctttccagcactagcaatctgtgctttaaagttttacctaacataccataccttttatcaatgtccacctagagataataacccagcttattttatttgagttttgagacagggtcttgctctgtcttgcactccagctggagtgcagtggcacga

SEQ ID NO: 178873 - DNA, 204 bp, Homo sapiens
ggtaaccagagtatatggactcagatgctggagcaggagaaagaagtaggggaagttctcttgtggaaatattcttctaattgtgttggctttcactgaaacagtaagcaaggccatcatctgaaagcggggatggggaggcaatgtagagatttcaggggagaagagaaaggattagtctgtaaaacaatacatgcaaaagaa

SEQ ID NO: 178874 - DNA, 207 bp, Homo sapiens
ttgaaatgaagatgaatcgtttcagtttgttcctctctgccactgatctggctttgcatggggtcgggaagaaaaaggaaaaacatgaagtctttctgcccttgtcaaattcactctttttaaagggtgaaaatcatgcagatctttcctgaattttgtatattggcatataggacagcaaaaacatcatttaaaaaatacatggat

SEQ ID NO: 178875 - DNA, 297 bp, Homo sapiens
ctccccaacaatagtacctactttttaaggattaatgagatgatggtaaacctaagggacagagcccagtttctggcacatggagatactcagtccatgcccactgttgtggtcaaggccacagtaggctttccctgcatgtgaagttgtctcagggaacttaactagatgtgtgggttagccaaagccttgtagcaaagtaacatattttaaagcagccatcatttgataggagtaggcccagctgtactctaggaagtaggctgaagggagccacttggggaaagggatggatcg

SEQ ID NO: 178876 - DNA, 303 bp, Homo sapiens
ttttctttcaagaggattttttggggaagtgggcagataaagtaccagcagattactttgatgctatcaaatattagttttaggctttgttaggactagcccatttaaggtttgatctttctccaagaacatagtctttaaaccataagatatgcttcttcatatgtcagggattttcttatgtgtcaactgaaatcatggagtgtttattagaatgtttctttttgttggggcataaactccattgcttttctcagaacaatataaccactgaaatgactgctcaactgtttagctctttgg

SEQ ID NO: 178877 - DNA, 533 bp, Homo sapiens
cattgtgtaaagggcatcttaaactccatatgcctaatattgtatacctattttcccctctcctcaatctaagcccttcttcctcagcttaagaaatggcaactccatccttccaattacccagccaaaaaccttgaggggccatccttgacgcctgtaattctcaggtgccccatatcttatccatcagcaacatctgctctttctgccttcaaaatatatctcagatcacatcctttccatacctttgctgacctcacttgggtccaagtcactattatctcacacctggattatttcaacagcctctgaattgcttccacctgtcctggcttctcagctcctgtctctgctcacagatctctcaggtgagattatcccttaccataatttacaagaccaacaaagtcaggccttctgctgtgacctctctgaccctatcacttgccactcttctccctgttcattcctctctagctatcctgacccacttgacaccccttaaatgcacttaccatgctcctgcctcagtc

SEQ ID NO: 178878 - DNA, 483 bp, Homo sapiens
attcccacacttgaatctgaataaacttatagacataggatagagaaatgccttgataggagcatttcttttatttactgtattcttaaaatacaatttatattttaactgaatacattaaaagtgcagatatattaggtcaatacttacaatacacaaattcttactgtgtgtcttacaatatgtaaaacattgtaataggttctgtggggacctcaaagattaaacagacactgaaattactgtaaagggacttagatacaaatcgcataatgaaaagggaagatgatcaatgatttaaggggtctgtgaagcatctcctgcaggaattggacatctcttctgatctcccaaagctttgggattcctgtacccatcacaggcaatagcggcaaagcagttcatttcttccctctccaatcacagaaacgtctgttgttaagtaagctgtcattctcctcaaaaaaaaacaacaacaacaac

SEQ ID NO: 178879 - DNA, 557 bp, Homo sapiens
ctccagctccacagtgatagctgtgctggcttctttccagcatggaccgctacatacataagggacatttcgtaaccactctttgtaactccatctgcattttcaaagttctcacgttcaccagaaatgatcattttcatttaggtctatttttacatgattaatatttggggattaactgaacctccttcttgtataaactgtgtgagctagattgtccctttgagcttcctcatgttatggaaaagacacagttattctgtgatggtttcccaatggcatccagagagtgaggacaggacccctgaagaattctcctgttgtcatttcagagcttccatttgtgcacctctgtgtctctgctccattctccaaggcagcatagcctcgtttagggcatgggctctgcagctcctcaccaactgtgtgaccaggagcaagttacttcacctctttgtctcaatttcttcatctgtcaaatggggataatgacagtatctacttcacagcttgttgtgaagattaaatgagatagtattaaagcacctaggatagtg

SEQ ID NO: 178880 - DNA, 725 bp, Homo sapiens
tatgttgttgatgcagattattgtaaaaatatattttccagagtgatgtctctaagcctttattgtttattttcacagtaatttttttctatacatggatttaaataatactgttgtttttccaatggaaatgggtaagttcagggacagggaaaggggaggtatattgagagctgattatgtagataaggatatgagacccctaggatggcagaaatataagtaggcatgatcttcaagtgctttaaaagcaaattaaactgggctcagcacagctcaacctggacaggaatactgccacctttctctgatatgccatgttactcaaactaaaaacccctcagtgtgcagatgctggataattgtaacttggcataattaccctggtgggagccattggtcaagatcacttgcctgtgggatttctttgaaaggagtagatgttttcactgtcagctgttccaagaaagagtagatcctggggccaaaaatggaatctaaaaagacagagtctagaaaagcagataaattcctttctctctctgaaaattgaatctggcctccaagtatcaccagcattgaggacatcatctgtgactcatcctcatggatgcaggcctatggagctaagagggtcctcatctagaaatgcttttaggttacatgttctatatgccccttccaatgtccttgaatcttcattagagttttgtcagtgttgtgac

SEQ ID NO: 178881 - DNA, 257 bp, Homo sapiens
taccacttttgtttcttttaggtgatttttaaaaaacatttgctgaaggagaggttgatgctcaaagggtacagtgataaatggagagacgggagtttaaaatgaaggataagccgcaaatgaggatgaagttaatggatagagaaaagatgggaggaagaggtatctctctttactcgtaagctgcccatcgatatgatttagactctaggagaggggcgtttctttcctcagtaggcacactcatagagtaaact

SEQ ID NO: 178882 - DNA, 352 bp, Homo sapiens
ggaagcaattagaataggcttccaaaaaataaaggagggacattaagccaagccttgaaggatgttggattgttcagagtatgattggagctcataggcagaggacactgcaaggacagtagcagtgaacataatgtggttagggaatgagaagtagtttgcagcagctggaacctctcgtgtgtctctaccttctggttctaaggtttgcattttaaatttttatcaatttattgtgtgttataacattttaaatctttttggcctaagccagagattctcaatcttggcaagtgacatccctgttggccctgtaatcatagactaagctatattttcttagttgtcagtg

SEQ ID NO: 178883 - DNA, 220 bp, Homo sapiens
ccaggagtccttccgggtgggagagaaggcgattttctttctccttacataagagccatgcggctcagcccctggaagtcaggagtgtttccatagtcctgagcagtgagtccacacagctaatctgctttggattttcggaagggcctcgctactgggcccatcatcatcctgtgtcttatcttgatgttttccaaaggacattgcttaaagaaactca

SEQ ID NO: 178884 - DNA, 516 bp, Homo sapiens
  misc_feature (513)..(513): n is a, c, g, or t
  misc_feature (516)..(516): n is a, c, g, or t
gaggcggaggttgcagaaagccgagattgtgccactgtactccagtctgggcaacagaaagagactctgtttcagaaaaaccaacaaaacaaagcacgcacaaaaaaaaaaaaaaataacaaaaaaaaaaacttttgtgggtgggccgggcttcggcgccctcagaaaaaggttttcatagacccattcgcgtttgtgggcgccggcggcgcccaggatggtatagtgtaacagttgggcataagcggtgtccactagaggagagacccgtggcgccatgagaatcaagtgtgcgctgtggggtttttcttcacaccaaattataaaaaaaaagcggcgccgggggggacaacacacgagggctttctttgagaacaaatcccccaaggtggggaggtttccagagagggggccaatcagcggggagcttctatctcacaagaggcggggttcccaaaagagaagaagatcagaggatatcaaaaaatttaacgcccccggcctggggtggcncgn

SEQ ID NO: 178885 - DNA, 346 bp, Homo sapiens
ttaccagccacagatgccaacagatgccaacagatgccacagatgccaacagatgccagccacagatgccaacagggtgcctggcacctgagaggacaggagacaccactgaggccaaaggagttcgaggagagaaggagggaatgtgggcatgggtcccaggctttcttcttccttcattcacacactccaggacatcatctcagaggggaaccaggaagcaggaggaaatgggaattgacctaagctgactgtttcagttgttgaatggactcaatgcaaccgatggaactaaatttagttctttccacttccgtgtggtacggacttgtaaagaatcacaggg

SEQ ID NO: 178886 - DNA, 197 bp, Homo sapiens
aataatgttgatggctttaaaacttctgcaaataaagtaaggacctgagccaaaatttggcctgttattctgccagtgaagaattttcaatacagtcacaaaccaaatgtgaaccacataatgacggttctgtcagtgcttgagtgcctataggaaggaaggtagtcccataagattataactgtatttttactgta

SEQ ID NO: 178887 - DNA, 183 bp, Homo sapiens
aagatgggattgtaaaaagcattagggcttcctcatatcaaaattccaaaccctaaggcagttagactatgcagttcttaaaacatgaacaattgcaaacttaattgacttgaaattttttagttacttgtcctggatgaagagaatatgatgacaatttctttttgttctataactatctct

SEQ ID NO: 178888 - DNA, 390 bp, Homo sapiens
cgctttctgaaattcgattcccaaatgcccaggatttcccctgtggttccagagaaagggagatatgtggcttctgtgaacacctattgagtgggatcacaaggaagcatcccgtgacctttcttctattttgagatgaggacgtaggtggctgtgctgctgaccagtgagtgagtcagtgggcccagggactgaacattgtgtataggtggagaacttgggaggcagaaccacatttaaagaaatgcttctggtcattctggtctaatttggcaatcaaataattttaaaactgaaggagtccacagagatttgtatacaagaatgtttatcgtaatgttttagtagtaacaacctaagtgtccacctgtaggggacggaggagatcaa

SEQ ID NO: 178889 - DNA, 409 bp, Homo sapiens
tgggggttcacctccctggcctttctctcttcatcctggcttctcggccaagcactcacgtgcacaaggcccagcgctgagctgtctgttagcaagatctccttacatccctacaacctcctggaacgctcatattctgtgctctcagcaatactcgtcagaaatttcagaaccgcagtgtcctcatctagaaagagacgactagaataggattgctgtctctagactcaaattttcccatttcttaaatatggctttatagattataattattaaaaattatacatgcaagccagacacggtggctctcgcctgtcatctcagcaccttgggaggctgaggcaggcagatcgcttgagctcaggagttcaagaacagcctgtgcagcatggcgagaccccttctctac

SEQ ID NO: 178890 - DNA, 206 bp, Homo sapiens
tttcactctgtcacgcagtctggagtgcagtggcaggatcacagctcactgtaactagggcttcagtgatcttcccacctcagtcccctacccccaccccctgaagctgagaccaaaggtgcgcaccatcacatcctgctaatttttttttttttcctgtaaagactgggtcttgctatgttgcccaggttggtgtagaatttctg

SEQ ID NO: 178891 - DNA, 484 bp, Homo sapiens
tgctgggattataggccttgtgagccactgtgcctggttctgtccctgcatttttgtttgagaattctgctctctgacttgggagaatttatacagtctgagaaggactggaaacaaatgtcttataaaggcaaaaatttatccagtttcgtatttctgccactcagtatccattcttttcctgcagcaacaataatgagattttgctgtggtggaagtaactctaggccccacacagatcaaggagaccacctgagggcttctgcttgagcacagctgtgtgtgggaagaagttatgtctgatggtgccgagcccaatcatggaactacggccaaggaggcagaagcagatggaccgtaactctagccctggactttttttagttatatgaactaacagcccttttatatttaagcctgtttagactgggttttctgtcacctgcaacagagacagttctaactgactaaggtttttaaagaa

SEQ ID NO: 178892 - DNA, 274 bp, Homo sapiens
tgctgggattataggccttgtgagccactgtgcctggttctgtccctgcatttttgtttgagaattctgctctctgacttgggagaatttatacagtctgagaaggactggaaacaaatgtcttataaaggcaaaaatttatccagtttcgtatttctgccactcagtatccattcttttcctgcagcaacaataatgagaacgtcctgtgttggataccagtttacgccccaccccaatactcggagaacgcccgagggcacaagttcgctca

SEQ ID NO: 178893 - DNA, 447 bp, Homo sapiens
tagagacggggtttctccatgttggtcaggttggtcttgaactcctggcctgaggtgatccgcccaccttggcctcccaaagggctgggattacaggcgtgagccaccacacccggccaataagattattattaatattaataataaaaatattgagttacagagataaatatttatacataataataggtattcagtagtttatcttttagtctcaggattgtcttactgatactggggctcaaaggaggtacagaaatttttgtttcaaaatcagttaattaaaattgtataacaactactcatacttcttagttataaatgattgtcaaacaaaaagagcatccaaaactgaaaataacctttgaaactatctgtaagtcaacattatgaagacatacgaaacttcacttctcatttcacaccttactacactgatagaactgt

SEQ ID NO: 178894 - DNA, 249 bp, Homo sapiens
tagaggaccccgttcattttctaccccgggaaagtgtttctttacagaaaaatgccaactaatgaatgaagacagaatgatagcattagaaaatcacaatctaacaagtaccctacaataaatacttctggcgagaatcatcactggatgttgaaacattgggtaaaaggttgttggaggacaggatgttccacacagcctctagataccatcctgtgtaaattacaaagagaaaaatgtaactttaca

SEQ ID NO: 178895 - DNA, 357 bp, Homo sapiens
cttatgacgacccaaagccttaactgatctggcccaccactcctttctgactccatccctcagaaccagctccactggctttcttgctaccaaataatagtttttgtaattgctcttccctcttctataaatgctttccctcagatagccacgtggctcctgacccttccagggttctacttaaatgtcatcttattagcgaggccttcctctactactttggagaagtagcagttccctgcctccactccccattacttctctgttcctcttcatctttcctatcctgttttaaaacactttttagccacacctaacatcttaggaagtatatcgatttacactctactttcttca

SEQ ID NO: 178896 - DNA, 286 bp, Homo sapiens
gggggtggaggaaagccttgaattactttgagaaagaaagcctggttccatgtttctgcagtgcacaaataggatggcagaacacatgcttggaagcttccaccaggaggtcacatgagccagtggttaaggggcaggggtgatgggagcaagtaaaaagggatccaaatccaggttccacctctaataaccatagtgaccccaactacttgtggtcccatgagccagttgacccttctgcataatggtcatgctgatcatccccatctcccttttgttgtggggg

SEQ ID NO: 178897 - DNA, 192 bp, Homo sapiens
ctgtgtgtctgtgtgcaggggcagtctctgtgtgtgtgtgcaggggcagtctgtgtgtgtgtgtgtgtgtgtgcaggagcaatctgtgtgtgtgcaggggcagtttctgtgtgtgtgtgtgtgcaggggcagtctgtgtgtgtgtgtgtaggggcagtctctgtgtgtgtgcaggggcagtctccgtgtgtg

SEQ ID NO: 178898 - DNA, 196 bp, Homo sapiens
tgctggatacacctgtagactaacaatagagaggacagacatacaagaattaatacaaaatttgcaatagtggaatttccaatggttttaacccaagtgacagggttaagatttgtgaggctatcaacagcttttaccattgcctccgtttctgacaccagatttaactgggcttttgatgtttcaaaaatttgtt

SEQ ID NO: 178899 - DNA, 857 bp, Homo sapiens
cacacatctcctgagaacacatgccaggctgtggaactgtggggagtgtggtggtgccggggaacattgtctgggaggctgggcggggcggggtggtggtggggactatattcttgaattcccttccagtagagctgggcttagggaacagccacagtctgagcccaatgacgagagggaggctggccctgggaagtgggaatttgaaaagtaacaatttctacaaagtcctcagttgactctttgcaaataacttgaaatgtctttaacttctgaagcaaagatgttagggaccagggatagggcgtcagaatttttagggaaagggagagtgggacagcattgcccccaaagaccagggaagagtaaaactccttcttcggttcccacttccacctgtctcctctccttgaggatagaccagcagctaccatttttgtcagtttacaccagcacctgtcctccaggaacaccgttggctagatgtgtgcttgtccatcaggtccaaaggcatgggggcagtgaatgcaagcagggatgggagctgcccatctgagggagcatgagcccagatcctttaacatctatcctgtcttgctgcttcagtccctaaggctgggtagggtgaggggcatgagcctttcagcagacggactgggatttatcacctgagggtctcctggctaagaatatgagctttttactctgccaataggttgtggccttctcctttccccccaagagggctggaccacgtgacggctaggtgatactgtatctgcagaccttactacaaccagtgggggtcagaaagagaaatgacatttgcagtctaggaaccctttgcatcggtcatg

SEQ ID NO: 178900 - DNA, 705 bp, Homo sapiens
gcgctccgacctccttctggccacgctggtgagatcagaggaccttgcaaagagactgtttacacttcagctttgtttttcctgagtgtttttgcgttctctgcaagagtgagggagggttttcctcactctgtgccaaagaatgatctgaaaatataattaaactgatgacttcacatattaaataccaagtcctaggaatataattgtttttaaaatttctaatggacttaagtctttgatctccctgaaatctgtgaacaaatttcccacatcataactcttttaacacatctaaatgtgccctcaggaaccagtatcttcttccaatattgactctagccatagaaaatggatggttaaaccgagaagagcagactgttacctctctgagagttatttctacctggtccatcttatcaggttaataagtgttactatgtataaatatagtaacccacaatatcttgattaaaaaaaaaagctgttattcagttgggatactttaaagccttgttttccatttacatgcctccttggaaatctatcttcttccccacatttttcattcccagtccataagggaagagcagaccaatccaagaagcccttcaaggaaaacagcatacttatgtgtagaccccgtgactgacaactccagcattaagaatttgtcctatagaaggactcacacaagtgcccaaa

SEQ ID NO: 178901 - DNA, 713 bp, Homo sapiens
ttctagatgtaaccctccgtcagcccacgctggtcgagatctatgatggaacccttccggagactgtttacacttcagctttgtttttcctgagtgtttttgcgttctctgcaagagtgagggagggttttcctcactctgtgccaaagaatgatctgaaaatataattaaactgatgacttcacatattaaataccaagtcctaggaatataattgtttttaaaatttctaatggacttaagtctttgatctccctgaaatctgtgaacaaatttcccacatcataactcttttaacacatctaaatgtgccctcaggaaccagtatcttcttccaatattgactctagccatagaaaatggatggttaaaccgagaagagcagactgttacctctctgagagttatttctacctggtccatcttatcaggttaataagtgttactatgtataaatatagtaacccacaatatcttgattaaaaaaaaaagctgttattcagttgggatactttaaagccttgttttccatttacatgcctccttggaaatctatcttcttccccacatttttcattcccagtccataagggaagagcagaccaatccaagaagcccttcaaggaaaacagcatacttatgtgtagaccccgtgactgacaactccagcattaagaatttgtcctatagaaggactcacacaagtgcccaaa

SEQ ID NO: 178902 - DNA, 1011 bp, Homo sapiens
ccagcactcaggttgaatgtcgaactgtcctactccaaaattgacatctcagatgatttacagccaaaaggaatgtcttaaaaacaactaagtcattcatgtcagaatcctttgcctggatgactcaaaacagtgacattgtatgcttggctgccggtacatgtattttgggagttgtgatgtttcctccactgtggtggttaatatccaggcctaaacactgtggtatttaatgtccctcctcctccaaaagtgctaatgaggatctatgctacggtctagccagaggaaaggagaaggaaggcatggtttgctgctgtcatcagaatgatactcacccaaaaggatgacccaggtccagccagaatgacagaaaaacccttgtcctaaactgtcaatataaatgaacagaaaggagaactagctatagaaatttgaaactcacattgtaccaaacgcttttagctattaatttagtaaaaactattatgcattagatttatttatattcatttgtatattctctgcaacactaacacatgatttaactaatcaaagcataatcgctcaggttctgctcttttattgtcagatttggcagacttgtctttccgtagctttttattttaagaaagattttctttcatttatcaagtattaattgcatgtctattactcagtgactctaaaagaaatggatggcactgaccttagcctacagcagcttagatagatttagttaagtaatcacacacaagagtagaggccagatgtcaaaatgaataatgtaactaacaaatactattgggattcagagaagaaagagatatgtattgactaggacaattagaaacaatttcatgagctggaaggagtttcatgactctagtgattgagcaccatgtggccaggagggaaaatcttgcaggttcttcagcaaatacttcttgaaggcctgctatgggctaggcactgggctaaattcctaaacataaggtattaatgagaaat

SEQ ID NO: 178903 - DNA, 325 bp, Homo sapiens
tcttttgattgtctcaaagtgaagtttctcattttggagactaccctctcaggctgtttcctcttgagggttttaagatgcagtgattgcaccacaaataattgtttagtctctgctgtctgtaccagcagtcattcattttaatatggagagattgaaacagatctgagcttagtctccgccctttatcctttttaactgttaggaatttggaaactctgtatttttttagtggctttattgaaatatagtttaccatagcgttgacttgactaataaagtctaaaaatcagtggtttggcagcttttcaataatgtgaattaa

SEQ ID NO: 178904 - DNA, 449 bp, Homo sapiens
catacacaaaagcattgccaacaagggcaagtcatcttttttgagaaacaaaaacaactctaaatgttgaatttagtgggcagaggcaaagtagtatttgagaataagtctttagaagagctcaaaatgtctgaatcattggtccaaatttcgggcttgcagtagccgaagcacatggaaaatagctatatctattcaatttcctgataaatgcactaagcctgtgaaactggtcatccctgtacaagctgattcttgcactacatagtacattcttgtctcagccaaccacgcaggaccccagagcttagtacttaaggaggtcaggcttaagaggatgccgagaccagatgatggctaaggtccatcaaaccctgacttctgtgattctggagataacacctggattaacacttggctatctctgatatttacattaaatatactga

SEQ ID NO: 178905 - DNA, 599 bp, Homo sapiens
catgggtgttatgtgatatttaactagtattcttctgtcacagagaattttattccctttaggaatattgagaaactttagtgcctaaaattgccagatttgagacttagcctctggctgtggtaatttcaccaaatccatgctgtcctctgactcttggcagtggactagctggatctcccggttatacctcttcttcaacatgcatgattgtcatctccccttcaaatgtcaataaatagtaacttgttttttgaagccatcttttgatagttccatgcctgatgattctttaaaaaataattcatttttaattacacaatacgtgatatgttctctatgtaaaaaattcaaagactaaagtgccttttgactgccatcctccatgcctccatgcctgtttcctttccttccctgtctactcttccttccacggtaatccttgtctctgatgtttgtgttacaaccttccaaactggttgtttttgttgttgttttttgggtttttcttgagatggagtcttgctctgtcgcccaggctggagcacagtggtgcaatcttggctcactgcaccctctgtctcgcaggttcaaatgat

SEQ ID NO: 178906 - DNA, 566 bp, Homo sapiens
catgggtgttatgtgatatttaactagtattcttctgtcacagagaattttattccctttaggaatattgagaaactttagtgcctaaaattgccagatttgagacttagcctctggctgtggtaatttcaccaaatccatgctgtcctctgactcttggcagtggactagctggatctcccggttatacctcttcttcaacatgcatgattgtcatctccccttcaaatgtcaataaatagtaacttgttttttgaagccatcttttgatagttccatgcctgatgattctttaaaaaataattcatttttaattacacaatacgtgatatgttctctatgtaaaaaattcaaagactaaagtgccttttgactgccatcctccatgcctccatgcctgtttcctttccttccctgtctactcttcccttagaactgctgtcttttatattgagtatgggaaaaggatggtcagtgtacctgactgtcaaatatggtaagattcataagtaaattgtaattctgctgcttatccccaccattgtagctactgtgtggtttactga

SEQ ID NO: 178907 - DNA, 834 bp, Homo sapiens
gttctggtggggcatgaaccagtggctggggcattggaagcttcccaggcgatgcaaatacaaagccctaataaagctttcaaaactgcgttagaaacaggtcacttttacatttgtgttggaaacttgtcttgagacaaatgaatacatttgagccactgggatttttggggaaaatacagctaaaagggttaggaaatgatacataaggaaattctcccatctgatgctggctggcttgcttgcttgctgcaaacccgagtgttttctattaagtgaggcattgtggttcctatgctagccctgatgggccttcagcactggcaggtgtaaatgcggctcattaattttttaagaagttggaactctgacagttttcagggatgctgagtagctggtaccagatgtttcttttgttaagggcatggagaggcagtgtcacaggtaatcaggctgtggtcgttcactcccttggtctgagactatgcgttttgtggtgctgaatgttttcttaaaccaagaagggtgtggggaggtgcatgttctggtttctagttgggctttcccccgacactggctcttgcagtattatcttaggtagaggtgttgactcaattatcattagacccagctcctgttggaagagagtaaatggtgcttggggcctctttatctagaccgttttgccaccgctgaagtgacagcctgtgcttctaactgaattcagtccttttttttcactccctttctgtggaacaacagcaaagtcggctgctcatcattcgggtgcagactttacagcctctgaacagcctctgcttttgcagtttatga

SEQ ID NO: 178908 - DNA, 138 bp, Homo sapiens
gataaggctatttaaagacagagttactaagctgggtagaaagcactcagggaacttttagcaattcagttattatattggactgctgaagaattgtactggacgattgcactataagatgctaggaggtcatatata

SEQ ID NO: 178909 - DNA, 307 bp, Homo sapiens
ctcccgtccacaggtccctcctgaccagctcttctccccaacaagatcgtgtgccccttgggaagccacctggtcaggtaggcactgccatgagcccctgttacaggagagaactgaggctcccagccgggcagggctcactcgaggtctacaccctggatgcagatgaccctcacctctgtcctgtgtgggagccacaggaggaaggtggggacaaaagaccaattcctgctgtttagccacccaccttctggagggaaaggcagagaagtcaaccgcaatagtaataataacaagagaccgccag

SEQ ID NO: 178910 - DNA, 465 bp, Homo sapiens
ttctaaaggggccacgcagcagttgttaacaatgaacaacataaattccaaaagtttgggcatttaactattatttgggcatcattaataaattagttgtttgtttctaaactctcctgatgctaagcaaatccagaccatcagcaatcaatctaaagacaatgagcctacttgatatcacacaatctcattaatcttcatctgtcctaccgcatcctatcactcttacgcaaaatgaacactagaggacgcaacttcaacttctcttcactatctaagcaggaggtagaaaaaagcctcggggatttagggacatcacaagcaattatttcaccagcctagtgtgctacatcacagcaaatgagtctgacatgtaaatgtgacatagcaaggagtaaaataacgcagttcttgagctatgtgtctcactgtctttgctaaaacaccagagcgtggccagaaact

SEQ ID NO: 178911 - DNA, 326 bp, Homo sapiens
gaggggaggagaggtggcggcgttgaagcgccatggttcatctcataggtgttccggaaggggaatgaggaggagcaggagttgtagatagaagagctgagaattctccacagctgacgaaaggcaggagacccaggttaaaagtgttttccgtattcctagtaggataagtaaaaagaaactcacacctgtccacgttgtcctacctgcataacatcaaggtagctgcctaaggaaagagacctgcccagaaaggaggccttggactgaaccaggagaccttgacctcgtcaagggaggaccggaaggcagagggttatcatcta

SEQ ID NO: 178912 - DNA, 452 bp, Homo sapiens
ccctcagattacctcaacacaatgaattccgctcaccaactgtgaaaaattctgatggataaaatttgtcactctttatccctgaagagatttgaataagttggtagaaaggagcagaaactttttatataacacagacccttgctactcaaatgtgtggtggttcttgaatcagcaccgtctgcatcacctggaagcttgttagaaatgcagaatttaaggcttaatcccagacctactgaatcagaatgcgctttttaacaatacttctctctactcctgggtgattgattcatgcattgaatttgaaaagcgcttcactcgttgccagatgttttgctctaaattccttcttctgtgtactaaggcataatataggaaagactcaaaggatttctccctacagctggagttcataagcttccattattgaagtgaggtgtatagtgttt

SEQ ID NO: 178913 - DNA, 741 bp, Homo sapiens
agctcatcagttttgctactattcttcatttacagactttcctttgaagattgttttcttttctttattccttgctttctgcctcctcacaattttctctgccttttctttccacacatgaatatatgcctccagactattttaattaagaaaatagcacaaatccaaaagtatgtcctgtggctgcatacaagtcagagacttgagagtgaagtgtctagggcaaagacccgtatttcctcctctgcactgtgcttctcccgctgaagcatccttctgtgccacactggggtcctatactgtttccaacagtcttacttattgcttctcaaatttgtcttttgaatacttaatgctcctcttttgatttccacccagaaaatgtacctctctgagttcagaaaacttcagaatcctctatttcccaaagtttagggtgattgaactgaatcacacagctcggtattgtctgaaacagttaagaacttctagcacgagcatcgcactttcctcagctcatatttcacattttctccattcttctctgaaaggatcctggaccttctaccaatctttgattggttacttcataattgatttcttaagtaacctagatgtttatctctttcacatcattgtttagcttacagtatctacagccagaaagcacctctttccctttcccatttatagagagaaaagaatcctgaggcaaactttcacttagggattgaaatagcc

SEQ ID NO: 178914 - DNA, 629 bp, Homo sapiens
ggcagggcaggacagggcgggggtgagggagccactcctgggtgggaagagtttcgagtggccagtcaccttgccccctcctcacagcactcccacgcaggggcttttatgactgctttgtggataagaaaactgaagcccgtggaaatgaagtgactagctctaacgcgcaccatgagttggaatcagcagaagacccaagctctgattccaactacgtcccagcggagcccttaataaggtggttatttgggcatctacggtgtgccaagaactgcaccaagtacatctcagtaggatctcattaaagacccaacaacccaatgaagtagagagcatcacctccatttgggaaaaaaaggaaacagcctcagggaggttaatttgcttgcccaaggtcacagaattagaaactggcagagttgaatccaaacccagatatgactgcctcaatgaccttcctaaaatacacatctgaccaggcttggcctctgcttcccactgctccctggtgcctcaaggaccacaggctaaaacccaagagccttcacctggcattcaaggccctcctcactcaggcccaccttgcccttccagccgattccctcacattgctccttctccagccc

SEQ ID NO: 178915 - DNA, 341 bp, Homo sapiens
caacctctattttcaaaaatagaggttgaatatattcaacaagtcttatattgagggcctatagtgtttcaaaacctgttgtaagtatcaagagtataaaaatacttaagaccagccaggtgtggtggctcatgcctgtaatcccagcactttgggaggccaaggtgggcggatcacctgaggtcaggagttcaagaccagcttgactaacatggtgaaaccccgtctctactaaaaattcaaaattagccgggcgtggtggcatgtgtctgtaatcccagctactcaggatacagaggcaggagaattgcttgaacctgggaggtggaggttgaagtgag

SEQ ID NO: 178916 - DNA, 229 bp, Homo sapiens
agctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctc

SEQ ID NO: 178917 - DNA, 308 bp, Homo sapiens
gcatcagtaggaacgaagaattattctttctcaactcatagctactttcatatcatcgtagttaatgagatgacaggaaaagtacaatgtctggcacaaaatatcttccttctctactctttctcacagcccaatccataatcaatataaggcttactaaaacagaaaatgaaataaattttcctgagcaagtcatcattcctttcatattttcatctcaccagtgaaacaggaagaaaaattttcctacctgtatctcacctgttcaactagtaaagtaaccaaatttagaatgtaatgcctattct

SEQ ID NO: 178918 - DNA, 900 bp, Homo sapiens
cccctagtcgtggctcgctggctgtgttccagccacaccaccagccaccgcccctgccccccgtccccacgcttcaggcctctgcgctcgcaccacctgcctggaacacactctgccacgtagcccaggcctagctccctcatgctcttcaggtcgctgctccgacattaccacctgattaccatctaatttagacaagactttggattttagagtttagaattgatgctggaatgagttaagacatttgaggttgctgggcggaattaatgtattttgcacgcaagaacatgaattgtggaggaggggtgggatgatattgactgtttgagttccccaaaagccatgttgaaatcctaacccacaatgtaatagtaataagatagtaaggccctcctggggcctttgggaggcatcatgagggtaaagccctcatgaataggattagtgtcatgaaagacacccccagagagctctcctcccataagctttttagaatgtgagactacaagaagacagcagtctcaagacagcctgaaagaggacattctccggaacctgggtatactgacaccctgatctcagagtttcaatctacagaactgaaaatacatttctgttgtttataagccacccagtctatgctactttgttagcagctcaaactgcctaagataactgatttctcctttttcctcatttgattcctccttcttcttcgagttcctgcattttaaacagagtggaaaacaattaatcataaaaacagaaatactgtactttaattttgcctgagaatgcttaatctaagctgatataaattgcataacatacagtctgagaatacatccctgatccttgtatctgcttaactctcattcacactagtgaagccacggc

SEQ ID NO: 178919 - DNA, 546 bp, Homo sapiens
tagacgatcccccaaacgcagagaggataaatacaaagctgtgagagtattaaatatggacactagatgtacatttccaacaagaaattcatctccctccaaagtcccagaccagggctagaatgtggttcatttttaacaatcaaagtggcaagatctgtttggtgatcactgtaaaaacaggaaacatagctaatgccctttcatgttgaggtgctacaaaggtccaagcttttaaagactatggcctcaacgtccatgtgtgaaacaagtgtattagaaaattctttaagtcttgttgccttaacttagagatctccaggcaacaggcctgacgatagccatggctcctctctgcgtttgcaaacgcagggaggaggaggaaagctggtagtaagtgtggagatcttttaattgcaagaaaataatctgggagcctaacatttttgcagtattttaaagtgtgcaaagacttcacaggactagcacattctcaaatgacacctctaagaccaacccaagcataaagatcttctgaggcttata

SEQ ID NO: 178920 - DNA, 608 bp, Homo sapiens
ttagcattgagtcaaataggttgaaagtaacagaactgaaaaaatctatattccatgcaaatagtaaccacaattgggtgaggtggtaataattatattgtatataatatgcttgtatataacagcataggacatatgcttgtatgtaacagcataggacaaacacgatattatataacggtcaaatgagtcaatttaccaggaatctgtaactatcatatctatttatatgtatacatacatatgacataagggctccaaaatatataaagcaaacgttgacaaaggtgaaggaagaaatacatagcaacataattgtggcgatcaagacatcatttgcaataatagaaaattcagataaaatatcagtaagaaaacagaaaacaggcattatagactgtattaactattttgcatatagaggaatacctgagtgtgtaacttacaaagaaagaaggtttatttggctcacagttcagcagactgtacaagaaggatgtaacagcatctgcttccggtgagggtctcaggaaacttacaatcatggtggaagacaaagagtaattttggcgcctgtaatcccagctactcaggaggctgaggcagca

SEQ ID NO: 178921 - DNA, 394 bp, Homo sapiens
atggaatataatctatccattataatttaactgacataacttatacttttcaagaaaattatctgaaaatttatgacactctatctactgttaaaaagaaattacttatgaaataccaatggattaggctaatgtggtagatggttgagtctttccctaaatttttcatcatttttgagctggtgtctgtttagtgttcctgaattgtcatcaggtttctgcttttctaccttgtgtgcagaggtaaacagctgaatatttatgtaaacagctttgtatagaaacttttccgtttaaaactaaaaagggaaggcaattgcacttaagattgaatgtttcctgaaggggttgtttcagcattttacagcagctgctgcctcctcttttggagatg

SEQ ID NO: 178922 - DNA, 720 bp, Homo sapiens
atattggtgactactttatggtatttctgtcgtgtggcctgatgtttcatagaaatttgatttgtgacttgttactttatattataaactagaaatttgctaatacattcaaagctgtgttcaaatagatttctccaagaagcccttctcttttctattctgctagccaataaccaaacataattttgcattattgcccctcaggtttattgtctggactttcaggtgacacggctttctaatgaatggtgactgaaagtcaaggcaataaaattaggggcaatgggatctaggaactgtgtgtgggtttccaggctgtgcattaggtagagagacaccctgtggtctttgtgtacattacaggacaacttgggcaaaacttgatctgcttgggctggtttcagaggtgcatggacttttcaccaaaacactttaatgatcctctgtaaatactcttatctaacagatgaagaaactgaggccgaggtctgcaggtgctcaccgggttagcaatcctctcagagttagcacttgaatgcaggtctccaaactttctgttcagagccctttccaatatattaccttgctcctctgtaatgtacttccatataaatctccaatttatcaattgaacagtatatttgaagaatatttcacttttaaggaatatttttagttctcgacatgtggggttattattgaaatcaggtctcaaagatg

SEQ ID NO: 178923 - DNA, 262 bp, Homo sapiens
gagagactgaaaaaatatctgagtttttacctgaagctgcaacaagaacagcaaagcaaacgcaaagaaagcagaaggagggtagggcattgtagctcacatttgtaatcccaatggtttaggaggccaagactggaggattacttaagcctaggaatttgaagccagcctgggcagcataatgagaccccatcgctatgaaaaacaattagctgggtgcagtagcatgcgccagtagtcctagctactctggagaatgaga

SEQ ID NO: 178924 - DNA, 323 bp, Homo sapiens
atggatacaagcttcaaagatctctattctgccaagctgtcttaccctcattttatagtttactctgcaagatgagaataaaacctgccttccagggattgtaaagattaagtgaaagaataaatgtaaagttattaacacatagtaatttgtcagtaaatgctgctggttattacttctgtatagtatggttgatttttgccattttgaaagtaggatttatttttaactttattagaattcatcatgttgattcaattgagatcacattgaatcttctttcttttatttgtgatattggctacttttcccagctttgtatg

SEQ ID NO: 178925 - DNA, 334 bp, Homo sapiens
gaaggtactttcgctttccctttctcgtctcaacatactcctaccgtatgatccggcaatgtgttcttgggtatttatccaaagatgtagaagacttatgtccacacaaaaacctgcatatggatgtttatagcaaacagctttattaataatggtcaaacctgggaagcaaccaaaatgtccttcagcaggtgtatggatgagtaaactgtgatatatccagaaaatggaatattatgagactgagctcttcagtcatgaagggacatagaggctatgtaagtgcatgtggctaaataaaagaaaccaatctgaaaagactactgtgttattc

SEQ ID NO: 178926 - DNA, 138 bp, Homo sapiens
attaaaatcagtaaaatgaaaaaacaccaactgttgatctcccatatgctgctggtaataatataaactgacctggccactctggaaaacttttagcattagcagaacaactatcatactctagagctcagcaattct

SEQ ID NO: 178927 - DNA, 653 bp, Homo sapiens
attcctggagttttattgtgggaattctttgaagcctgtgtttagcttaccttccatgaggtaaaattttcatttatatttgcttctgccacctgcttagaggtactactaatacataacctcttaaatgtaaaagttttctgaaccatatacataacataatttctatacctaaacctctgccagcttttgattagaatttggagtggggtataggggctttttcttcttttcctccctgagcgaatgcttagactgagaaataccctctttccatggtgactttcttgatcactcttagggttggtcacttactagggttgttgccttttgcctgttccagctctgcgcagtctctgatctgagtcatctaccttgagaggaccctggccttggcccattaaaacccaagttctcatcatgaaatggtgcctccctgcaaaaccccccaccacccaccagaggaaacactgttttggctgattgcttacttctctgaagttctcctttctcttttctagcctctgacaatttctcttaatttttcacctgcctagctctgcattaaaaattgaaaaagcattattaaagcataatctgtataccataaaattaaccattttaagtgtacaattcagattttggtaagttta

SEQ ID NO: 178928 - DNA, 384 bp, Homo sapiens
ttggtgatcagtttattacctgtgcaggtaacaacctgaactgcccgtgtggagtagtacatcctttgtcttatcttttttgaaatgtagctgacttgggatgttctcttgtttttatatggtcaacaaatctaagttaatttacctgtgctgttagcggttttgtagattttttgttctcaggtttgggacgatcctgcttgccagctgcagttggtgagttacctgctccttggtgatgctgctttttaaaatgcatattgtcagtgcagacttcctgatttccttttgtaagttgctacacgaggcccgctttgaggactttttagaaaggatgtagtacaagttttaaaactaatttgggcccttgggtttaaggctgtt

SEQ ID NO: 178929 - DNA, 474 bp, Homo sapiens
ccttaaaggcctcaccacaggcttgagatgatactccaagcttctgcagataccacaagctcttttggaattcactgggtcactagcactgatgcctaggcccaatagagccttttcttgccttaagacctactgaaatctcaaatctcacagctttttttaaaaagcacatgtcaaatgaaggctaagtagaaaaagtatgtgcttagtagaagaaagacagagcaatagtgattaatttatctttatgaatgtatctagatttttgaaatctagaaaaaaattgtttaattttaacaaacacatatattgtgccttttcataagttaaaattttattttggatcacatagtagggtagaaaatcatttcggtacttaaacgtcagcaaaaggtcttaatcagatatttagtgaataggccaaagcagccacccattgaaaactgtattacctccagaaacgaaacaagtcca

SEQ ID NO: 178930 - DNA, 473 bp, Homo sapiens
atttataatttatatgcaacaagatgtagagatattaagtgataagtttaatgagctgaggcaattgcttatacagctgtaatccacatagaaaccaacatccacaagaatctcagcaccccagaaagttctcccatgtccccttttttgctcccttctcctctacccaaaaggcaactaatctttgatgtcaataaccatagatgagtttttcttgttttggaacttcatacaaatgaaacaatacagtatttactcctttatcacaggttactttcactctatataattaaatgtttctcaaattttatgtaatttgtgtatttatatatacattcatatacagtttttgctattttgattctttatattaagtagtataaacacataaaaatttgtttattgattattagttggtgggcatttgggttatttcaaggcatagttattatgaataaagttatgatgaatat

SEQ ID NO: 178931 - DNA, 351 bp, Homo sapiens
tgccacttttctcccagtaactgtgtgcctcatgagtattcagtttgttggatggaagctctccactgctctggcgtctctgcgtttctttgatgctggcataagaggcatggtttctccactggcagcatcagctgggacattggatttgggaaaaactctgaggttcctttgcatcaggctgggggctgagccctgaggtccatgtcttcatggagcctggagtctatggaggcacaaataagtcaacaaagtgtccaattgcaatgcggtgagcacgactccagagggaagcccagggcattattattaaagtgtgatgggtcgtgattaccggtggcttatgcctgt

SEQ ID NO: 178932 - DNA, 436 bp, Homo sapiens
gataaggtaaaaagttttcatagagggagataaagtttcttattctcaatccctcctttagagataatatattctaggttcaaatgcagctcaagaaaataggttaacggcactccattttacacctcccagtcatattttcattatgggactccttaagatgctaagggctaaaactggttttgacttatcctgaaagtggcaatatagagttttcctagtgctgatgttcttaaaaatctctgattacgggggagagtgagatctttcttgaagaaccaaggaatagttcctcaattttcaaagattcaaaagttccgttgaagccgtcgacggcttcatcggatctttacatctatgattacaaaatagaaaactcggctgggtgcagttggctcatgcctttgtaatgccagccactttggggaaaggccga

SEQ ID NO: 178933 - DNA, 404 bp, Homo sapiens
  misc_feature (17)..(17): n is a, c, g, or t
cagctcctccttgtacntctggtagaattcagctgtgaatccgtctggtctggactttttttggttggcttttgagactgcagtgtgaacagaagacacaacaacccacggagtgaagaattctctgggctgccccagcaatgcagagcagtgttcccctggagggtggatgaactcaggcagaggggcagccccagccctgggctcagggggaatgggaatcaggtttgcccttgcaccccagggtagctggtgaaggctgtcttggataatcttcggcctctcccttccagactcttctttaagcatccccatcccaccttggtatcctagtccctctgctactcccgtgcttgccttcctgggacagtgatagttgcagttcctgctgacttggagtgccc

SEQ ID NO: 178934 - DNA, 553 bp, Homo sapiens
tacaaaaaaatacaaaaattagctgggcatggtggtgcgtgcctgtacttggtgaggagggcggggggtggggagagctgaggcgggaggatcacacaagtcgaggctgcagtgagtcatgctcatgctactgtactccagtctgggtgataaaatgaggccctgtctctggaaaaaaaaaaaatgcagctgatttccttagctttgtaggaatggttaagaaaatagctacaaacaattgaacaaccacaaactttgatttaaagatatccctggaggaaagatcgatcttcctagaatggctaatttcagagtttgtctaaggaactcaggaagtaggccttaagccacagggctcttctgttgtttgcacaaggaggaagtgagccctccactgcctgaagtaactgactccaaaaggaaggcaggatccttgagaattttctttccctgtgggttcagaccagcccctggaccaacagcaacagcatcacctgcgaacttattagacatgcaaattctcagcccctccccagaccacagagtgattccg

SEQ ID NO: 178935 - DNA, 661 bp, Homo sapiens
gccatacagatccaccgcagcacagggctgcacctggcccaaggctctgccatgcccatcttgcccgccaacctgttggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagcctcccaaccttccattatgaggtagttcaggctcccaggaaaggcaaccttcaactacagggcacgaggctgtcagatggtcagggcttcacctaggatgatgtacaggctggccgggtgacctatggggccatggcacgtgcctcggaggcagtcaaggacaccttctgtttccatgtcacagctccaccat

SEQ ID NO: 178936 - DNA, 570 bp, Homo sapiens
ctgatacgtgacttgcgatcctcaacatgctgaccacacacagtgtgttccgaactgggcttctgagtttggggctgtgtaatgtctacgcgtggactgagtcacttcctatgggttgctgcaccttagtgagatttcgctgttacagtcctcccccactcctggccctctgttctgtggttttcggtcttgctgtactgtactgtgttgaagtagcctttctttttgttcagctgcctacaactatacatgtatttgttggggctcagaaaacgacaccccttggcatgctgagtgcttcgaaccaaaggagatgggaaggtttcagaagcagccttggaagcaaagtcttcctttggccttctcctgccctcctgtctcccgctcctctttctccccctgagtgagtcatagaaattagaattcctcttccccacagtgggtcagagagactagaagggtcactatgggggaggccaaggcaggaggattactcgaggccaggagtttgagatcagcccaggcaacacagtaagacctagtctctacaaagaaataagttaaaaaaat

SEQ ID NO: 178937 - DNA, 295 bp, Homo sapiens
tccccttgaaggatgcagcaccaggtgccatcttggaaacagagagtagcactcaccagatgaccaaacctgtcaacaccttgatcttggacttcctagcctcctgcactgtgaaaataaatgcccgtttttcacaaatcagccaatctcaagtatttttgttatggcagcataaaactaagagagtagctcttgtgattagagtggatgtggctttcatttcaattagaatggatgtggcttttcaattgcaatagggtcttactacttacgtaacaatactattgatatttta

SEQ ID NO: 178938 - DNA, 671 bp, Homo sapiens
gtgttccgaggatctccggtcttgttcctgcacttccctgcactgtctggtaacattgactttcgatgctataagatagctgtagaagaattctggttgcagaacatccagggtattagaattggaacgagatgggaccctcattggatctggttctgaggaggacacacctggtgttggatgacctttataatttatctatgataatgccagaagttctcaaactatctaggaagaacaatatttcccactgatacgttttggtccaacttatggatgtgcatggaaatcaacgacctacgcagactatagatccacagaaaatgacgtgctggagacaatacccctggctgtagtaaaatggcgcgatcttggctcactgcaacctctgcctcctgggttcacaccattctcctgcctcagcctccggagtagctgggactacaggcgcccgccaccatgcccagctaatttttttgtattttttagtagagacagggtttcaccatgttagccaggatggtctcaatctcctgacctcgtgatccgcccgccttggcctcccaaagtgctgggattacaggcatgagccgccgcgcccgtcctcgttcattctattttttgtagccattaaccatccccggttctgtgcttttgaagcgctaggattc

SEQ ID NO: 178939 - DNA, 477 bp, Homo sapiens
gatcttctgcctgccactggagaagcagtgggtccgggacccaaaaggcatgtggatgagtccagccctcggacaacctagtcctcattgggcagagggagccatctcctggaatttttaattcgaggactttttaccttgacctcttgcgaaatccctgggccatagtgggttaactgtttgtattctggtcccactgattttctgtgtttgcttcagagaaggtgaaggtgaattctgcagattttccatcctaccgtctttggaacaactgggtactgtgtctccttaatgataaaagggagctcttcttgaaataggatgatcattttccacagtttcttggtaaaccaattacactagtggtgattaaattaggtctttgataggcatgcaagtaaaagcatttgttgtaatttacaacaataagtaaattgtctaaatggttttaatatcattaaaaatttttatctggca

SEQ ID NO: 178940 - DNA, 192 bp, Homo sapiens
tgccaagagcagaaaggcatcgggaagctttccccagttttcagagagacacagctgacaaatggaaccagaggcactgcagttcccaggcggggctttaggggagagagctgctcagattcacaaccaggaccagtctttctactgccagctgggccggaacagatggactgggtgcaggcaactgtctat

SEQ ID NO: 178941 - DNA, 219 bp, Homo sapiens
aacacaaccttctcaacaccttgtgagacccatttcagacttctgccatctagaactgtaacatagtaaattgtgttgtattttaagccactaaatttgaggtaattttttatagcagcaacaggaaagttaaacagtgggagacccagtaggcaagtagaaatggttaccaaatgaccagaaccctgaactgaccagatgagaactccctggatggga

SEQ ID NO: 178942 - DNA, 443 bp, Homo sapiens
aataaaaaaaatgtttcccaaaaggtagtgaggagttaggttaaatggttaagttcaggaaatcctctcagatgtagtgaaggtgcaaaataattgctacgatttccagcatgcctaacgtgccagtgttgtaagtattttacatgcttcttgaggcaagagtagacaagcttttctgcagaaggtcagatagtaaaggcatttatctttgcaaaccatatggattctgctgcaatatgtaaccaatgtctgtgcgccaagtggactttatgaacataaaaacttgagtgtcacataattttcatgcatcacaaaatattattgttctttggagttttgaaaattattcagacatgtaaaaaccattcttggctgggcaccgtggctcatgtctgtaatcccaggactttgagagccagaggcaggcagatcacttgaggcca

SEQ ID NO: 178943 - DNA, 609 bp, Homo sapiens
aatgcactccactttggaagctactgatttagaaaacaaaacattattcagtacatgcaaatggttcttttggagctatcacacttatcctagtttgatttttgaaaaatgtggtttttagtaaacttcagaataaatgtgtcttgagtacaacttctggtcacgatcaattgctatcagttatctgtttcagttatctattatgggagtgtggtaaccaattaaccaggacaagattctacaatttcattatgaaatatttaagacatacaaaagtataaaatgtaatatgacaaatgtgcatgttttaatccaccaccttaaaaaagttaccttccagcaaagtgctgggattacaggcatgagccaccacacccagcctgttttgaacgttttaaactttatgcagtacctacatacaatatatagcatacatttgactacaactatttttttttcgccctctaaatgtggttgattatgggtaaatctagttcattcattcccacagctgcattctctaaagtttgagaatgccacagtatatccattcgtctataagtgacttttaggttctctcttgcttttcttttttttttttttttaaac

SEQ ID NO: 178944 - DNA, 368 bp, Homo sapiens
ttagacctttgtcagatgggtagattgcaaaaattttttcccattatgtaggttgcccgcactctgatgatagtttcttttgctctgtagaagactgagacattattaaacagataatttcatggcctgatatttcatttacattttaacaaaaagattttctcctgatattccatgtttttctcaaaattcatttctaataaccatatactattccaacttgtacatgtaccaatatttcccagcaaccatcatcctttcttgttacatttgagattctttttctctcaaatattgctgtgcattggctttttccttctctcagatcgtttactaatgatagaattatgagagtgcgattatggggt

SEQ ID NO: 178945 - DNA, 235 bp, Homo sapiens
tggagaaaccctgtctctactaaaaataccaaattagctgggcatagtggtgggtgcctgtaatcccagctactcagggggctgaggcaggagaatctcttgaatccaggaagtggaggttgcagtgagccgagatcacaccattgcgatcttcaaaaggaacattatatttaatattttatcaaaaattatgagttcctatttacatacacctttaacaatgttagctacctaa

SEQ ID NO: 178946 - DNA, 455 bp, Homo sapiens
tttgaggggaagcaaatgctcatctagtggcctttcttctttgcaaaggtctaagtcaggtcatctgctaagagaaagactgggagtgaagtggacaggtggtttggaggagagaaggcggctccatacagttgtggagaattgggagtcctatgtgcattttgtgtttgtcagccatcctgagtgcattatgcaattttcccctttaatcctaacaaaaactgagcaaggcctatgccttaaccctttaaaaatctaattactacctttgttgaaactaagggtgcttgagtaattcaaaccctggtccatgtgattctgagatatgaaatctaacactgtgtctgacaccgtgtcctgttcattgtatgatgaatcccagcagaacccagcacttaattggcttttcagtgccctttagaactctctcccctgccctcaatagctggatgtat

SEQ ID NO: 178947 - DNA, 271 bp, Homo sapiens
tgtaggttgcactggggaaaaatattttaagaaatataggtagtactcatagcagataggaatagcagatcatttgcttcttgctgctcacatttgctaagactcttatgaagattttccctgggcacatgaatcagtttaataatgattgctgccagttggtggctagacatcagactgccagcctactcaacagtgttgccatctgctatttggattcacagtgtgttgctgctacgcaccacctcattaagaacgggacccttgtgag

SEQ ID NO: 178948 - DNA, 177 bp, Homo sapiens
actggccaggccagtctccactagaggaacaaaaccaaagtccacggccaccttcttagcgcagagcagcctggtaaagagagacccaggtacaaatcctgactctttcataggctattcccacgaacttgggtaactcaacggctctgggccttagttttcccacctgtgaaatgg

SEQ ID NO: 178949 - DNA, 307 bp, Homo sapiens
gaatatttgggtttgtttcacttgctgctgcttcctcagcacttagaactgtgtgttgaagcacagtaggtgctcaataaatagtggttgaatgaaagaaaatagacagtcccagaaattaatcttaatactgatgctgtgaaatgaaaagctctcaaagtgggagtggacatacttttaagagatgattccctttcatttaacttaaagcccaaaggacttttcaaaatgaaattgttattccaactacacccaaaaatcattaaggctgcccctgggtgctcacgtacgttttaacaaaaagcaa

SEQ ID NO: 178950 - DNA, 557 bp, Homo sapiens
gattagcctctcgtttgccttcagctcctaatctgctcatcttcctgtaatctttatccgaacctgcaccctcattcctgaaccttgctctctacttatatctgtgcatgtctctcgtttctggaggtaaatcttcccccaggagattcagatgcacaccatatttgggaacaactgagttaaaggaaggaccccttgccaaaatacttgtgctctaggtactttgagttgagatagttatacttaaggcaccttacgaactaccatcgaacccagccatagtattcatttgatttagcaatatcaagaaatccgtgacccatctagatattagggaaggggcttgttcatatggtacaactataaaggattattgtaagttgctgataagactagattgaagaacataccagccaattcatgattattaggaggaactaccagtttctccagcatgtacctcctgatgccaatagtggtgccttcctgttctgcttgctgtagcccccctcatggttactggacacccatgccaccttattgtcttgatgcatgtc

SEQ ID NO: 178951 - DNA, 536 bp, Homo sapiens
agagagcctataagcggacgtgcaagtagggaagatatcactaaattcttttcctagcaagaattaatactctgggaaaggaatgcattcctggggggaggtctacagaaggctgctctgggagtgcctgtcttatgtggttgagataaggactgaaatacgccctggtctcctgcagtaccctcaggcttactaggattgggaaaccccaccctggtaaatttttggtcagactggttctctgctctggaaccctgttttctgttgtttaagatgtttatcaagacaatacatgcaccgctgaacacagacccttatcaggagttccacttttgccctttgccttgtgatctttgttctcctttttgccctttgaagcatgtgatcttgtgacctactccctgttcttgcaccccctccccttctgaaatccttaataaaacttgcttgttttgtggctcaggcgggcatcgcggccctaccgatatgtgatgtcacccggggggcccagctgtaaaattcctctctttgtactc

SEQ ID NO: 178952 - DNA, 111 bp, Homo sapiens
gggtaccatgagatgctctgtacccttataatagattctcttttctgcttttcatcacctgaaatgggttctattacccataaccaaaatagctttaattaaacccatcag

SEQ ID NO: 178953 - DNA, 179 bp, Homo sapiens
aaggttatcttctacacagtgtgatgttagctgtaggttgtcatagatgccctctatctggttgaggaaattcccttttatttcctgacaattgttgtcattaatgaatgttgaattttgttaaacattctctagcatttattgccatgattacatggttttcctactattgtctgtta

SEQ ID NO: 178954 - DNA, 647 bp, Homo sapiens
cctgggcaacatggcaaaacctcatctctacaaaaaaatttaaaaattagccaggcatggtggtgcaccagaggtcccagctacttgggaggctgaggcaggaggatcagttgagcccagggaggtcaaggctccagtgagccttgacctgggcaacagagtgagaccttttctcaaaaaaaaaaaaacaaaaaaaaaccccataaagtttgaatgttatcagccctggggatccttcgcacccatttaagctctataatcctacaataataatacaaagaatgtctcacccatgtgagctactctagaatttagaagatcccttcataatcatgatctctttgatcctcatgatctttggccctgtgaagtagtccaggcaaatatcatcagctccattttagaggtcaggagtttggagatcagccttggcaacacggtgaaaccccatctctactagaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaagagacgaagctaaacaacg

SEQ ID NO: 178955 - DNA, 728 bp, Homo sapiens
atgcatgcttggtgtgtttgagaaacagcaaagaggccattgtgactggagtagagtgagcagggggaagagtgctgggaaatgaagtcagagagagaatggtgacctgatcctgtagggttatgggtgccattgtagggactttgaaatggcaagcagaacagaggggtgacatgaagtgacttacgtttaagaaggattactctggttgctgtgttgatagaagaacaagggaaggagcagagagatcagctgggaggctatgctgctgcccaggcaagaaatgatgacagcttaggccagagtggtggcagtgagttattgagaaaagatatatttcgaaggtagagtcagcaggatttcttgatggactggatatgggagggaagagaagagttaaggatgacacatgaatgattgaggttggaagtgcctgagtttagagtttgggagtagtttggccctcattgtcttatgccccagctttagggggtggccaggggcagaaccagaataatgagtggactagtcatatcttgtaaatgtttgtgaagccataaatttcttctttaagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagtaccagtcttcctcctg

SEQ ID NO: 178956 - DNA, 428 bp, Homo sapiens
agggttgttttccttcttacaatataaaagttaggttaagctggtattcagataatttttttctaatatttttatgttcatcttttagcaaacaaatgaacaatgataagaaagcctaattggcagcctttgcaaattcactaaaaggacactggcatacatttgttcaccatgatatactacactgtgttcaacacctatgctgtaaaattcggttttattatctaactcctttctcagcccacacatctattatcaacgaactcaattaattttctaagtcttaatgcccttatcctaatttatgctgttttaaggataaaatagagcaaaaagactaccctgaaagatttatatcttattccctataccattcctttcccacatacacataaagataattttctcattcttctcttagaagagtt

SEQ ID NO: 178957 - DNA, 257 bp, Homo sapiens
ctcgtgatccgcccacgttgacacttcagcccaaagtgctgggattacaggtgtgaaccactgcacctggcctctggctgagatttaaattgagctttgtgaggcaggcacagatgggagcttgaaaagggaagtggtgaaaaatttggccatccatagcctaggcacaacccagccatcaaaccctgggatgaaagcttcttggggagcatgtactgtacatcccggttagggagtatagtaagcagtgtcaacgt

SEQ ID NO: 178958 - DNA, 528 bp, Homo sapiens
gagacatgaacagaaaatcttttcaacccatgcggggttggaaacaggcgaatgtaatctggtgcctgagttgagacacaggcattgataaatactagaaatggcccttgcagaccatgacgtggggggaaggtggcgggtgccctgtgccaggcaagcccatcctgggtgacacccggccaccttgaccggccaccggtgggtgcgctctctgccctccgtgtgtctgtcccgtgttctcatcaagtcctccgttgtccacctcttgctcagaacaggatccctgctgtcttggctggggtgctgcgaggtattggaggaaatagtaccacttttgctgttaactccatgaaaggatggagttcgagtgtgggctcttttaatctgtctcatttttgcgttagacagacctccctgagtgtgcctctaatgctgcagcctggacattggtttttatcctaagtgaaagtgaagaagtcctgtttttttgttttgttttttgttgagacgaagtcttgctctgtcacc

SEQ ID NO: 178959 - DNA, 437 bp, Homo sapiens
cgagagtgagcaaggactgtggagccagcagcaggcagcgtggagcccaggagcctttagacaaagcattctgctgcggctctgtcagcgcgcacatccaccggcagcaggcaggaccacagctgcccggctgggggattacaagcaagaatgaatcagcacccggggacacttgacttcatgggcatagaagaacctgccacgtaggctcctggagcagacttccccattcaagggcaggggagctcaagtatcccccagactcggcatcttggagcgctgcggcagcgtgcatccagaaggccgccgggtccctgaccatcatctgttctgcaggagacagaggagagggagtggaggctggcagagttggtcaccagggtcttgtagataaccaaggaagttggcattgtcctgccccaaggggcagaaagtac

SEQ ID NO: 178960 - DNA, 486 bp, Homo sapiens
  misc_feature (30)..(30): n is a, c, g, or t
tcagatcgagccggtaccgattacgctccnagacggcatgcctgttctttgccatacgtacatcagtgttgactctggatgatggatagcatctcaaatttgaatatcaattctgaaaatatgctttgttttcatatgtaactgtagtttgcagaccacaccatagtcttcctcccttacatatcttggcacgtggtattataatcccttctggaatactccttccccccttactttatagttttgagcccatcttaatatttccatagcatgtacattcttaccacaagttaattgctgtaactctttggaggactgagtctgctattggacggagtccctaaaaagaagaacctctgtattctcagtgtataacaagatgcacggcatttaatatatagcttgtcaggcagcgttagaggaatagatatgtatggttttaaatagaattttgtatcctttcaccttcccgtctaggagcgtaat

SEQ ID NO: 178961 - DNA, 173 bp, Homo sapiens
aaagtaaatatatccaataggaaaacaaagaattcttccatctgtaaattttctgtgtctggcaggattaaaccaggggtcagttatattactataaactgctaatggcccttcctcttaaaatcagtcccaacaagttttcttacatatggtaaagagacccaaggaatact

SEQ ID NO: 178962 - DNA, 368 bp, Homo sapiens
taaaccaagacaatgaaacaaggccttcttaacgaaaataatctctaacctcaaactctagaacaagacaaacttacaataaagtatcgtagaataaagacacttcaaatatgcaacaactctgttatccacaaagagaccgtaaaccaagaaacaggaagacagaaaaactgaaaaagaaacaaaaagaaaaaaacaaaaaagcccctcacagcagaggatgaacacagaaatcagtatgaaagcagtgcgctggatatagaggacaatcagtctagattgaagagatggacattctgaggatggtcatcaccaagatcctgagggcaaaatgctcatatataagccttccccactgctgggaccag

SEQ ID NO: 178963 - DNA, 260 bp, Homo sapiens
caagtagctgggattacaggaatgcgccaccatgcccagctaatttttgtatttttagtagagatggggtttcaccatgttggccaggctggtcttgaactcgtgatccacctgccttgggctcccaaagtgttgggattacaggcgtgagccgccgcacccagccaagaacattctttttaataatcatagttacaatgatcaaaatcagcaaactttaagttgatgtgatgttattatgtaatccacagtccatatgt

SEQ ID NO: 178964 - DNA, 1132 bp, Homo sapiens
ctgggattacaggtgtttgccaccaaggctggctaatttttagtagagacggggtttcaccatgttggccaggcttgtctcgaactcccaacatcagttgatccacccatctcggccttccaaaatgctgggattataggcatgaaccaccgcatctggccttgtctttcatccttaatgacactttagtcctaataatgctaaaatcattttctactctttgaattgaaacacagcttatctacatgagcccaaggcagtagcaacattcacctccatttcttctctgatctctaccttctgaaccctgtggacttggttgtaaatggatgagggcaagtcttgcttccttcccctgtgtttacagaggatcgtggctgagatgctgggccacactctgggcctgctggcacccctgggccggtggctgctgcccctcagggtgctcaccacctagaccagaagaaccaaggtgagggagagcctgttttctttcttcctgtggctgcgggggctgtgaggcatgggtctagtggctgtgtttagctggggatgcctcctagaaatcagctccaccgttgaagagatcaaagcaatgcacagtgccacttgaaatgaaacgattgagcttatcagcgcttttgcaaatgtacaagagggtagctcccccggacatcctgaactgagccatgctcttctattttgtgtaacagcccagtgacccctgaatcttcccctgaggcaggtccccgaagcttcatggaggatgttcctcagctgaccaaggtgaggctcttgagctcctaaatctttgtgatactgtttatacatctttgtgctgtactttttaagctgacttcgtgttatcacctgtatgattttatgttttgcttctaaataagtacagattattttaaactctaataatgggtgctacaaaattaaagattatgtcaatcactggtcaaaaaaaaaataaaaaaagaaaacaacaaaaaaaaaacccgcggggctctcttttctcgggggggggaaaaaagggttcagaaagggccgggccaaggttttccgcacccttttgtgcaccaggggaaacgcgggccccaaagggcgaaaaaggaaaccgtactag

SEQ ID NO: 178965 - DNA, 510 bp, Homo sapiens
tttagcaagaaagagggcaatctcattttaaaaatttactcaataacagcacaaatttgaaactaaagtgtgagactcctacttttggttatcatatagtcgccacagtaatgactaaaattcatgtagcactcacatagctaactctccctgaagaaatgcttcctttctcaagaggtttaagtggaaaggaatatgaaatttcttaacacatctatgttcgaaataactttgtttcaggagtaatcactctgaaacaactgagtgttaaataaaaaccagcaacccccaaatctttgctgatccatcactttaactgatcagtttactaccaactacagtatttacctttccagtaacacttctagttccatacaaactgttttgttctacataactgcactggatttggatgtacactcagattttaaacgatgacctacattcagtggtgtgtgggtacctataaaacacagaaaagggcccactttcttttttttttttgagatg

SEQ ID NO: 178966 - DNA, 959 bp, Homo sapiens
acagagcaagactccatctcaaaaaataaagcagcaaggttcaggaactcaggcttattttaaaaaaaagaaaatgaagaagaagaaagaaggaaaaggggctggatacggtagctcatgcctgtaatcccagtattttgtgaggccaaggagggaggattgcttgacctcaggagttcaagagcatcctgagcaaactagcaagacctcatctctactaaaaaccaaaaaaattagctgggtgtgatggtgcacacctttagtctcagctacttaggaggctgaggcaggaggatcacttgagcctgggagattgaggctgcagtgagcttgatcaccccagtgtactccagcctaggtgacagagcaagaacttgaatcaacaaccaaaaaaaaaaaaaaaaaggaagaaaaaagaagcaaaccacctcatgtgtatgccacactcacaggaaattaaagatgtgaacaccaaaaggtgggatcactgggggccatcttagagtagtaatttatatttagtatggaacatataataagaaacacgtatagcatagaacatatagaaatataattcatacttattatatattacgatatgttaaatattttacagcattgtctttaataataataataaacaaaatgaggaaaaacagatttcggaaatagtctttcttcttgtgaactttaaaagccattaaaaaaaaatgatgaaggaccaggcgtggtggcttacacctgtaatctcagcatcttaggaggctgagacaggataattgctttaacccaggagacgaaggttgcagtgagctgagatcgcgccattgaactccagtctgggcaacaagagcaaaactccatctcaaaacaaacaaacaaacaaaacaaaaaacaaaactaccatagccggtatgtcagtaatgagtaagggtgcattctaataaaactttatctaa

SEQ ID NO: 178967 - DNA, 536 bp, Homo sapiens
acagagcaagactccatctcaaaaaataaagcagcaaggttcaggaactcaggcttattttaaaaaaaagaaaatgaagaagaagaaagaaggaaaaggggctggatacggtagctcatgcctgtaatcccagtattttgtgaggccaaggagggaggattgcttgacctcaggagttcaagagcatcctgagcaaactagcaagacctcatctctactaaaaaccaaaaaaattagctgggtgtgatggtgcacacctttagtctcagctacttaggaggctgaggcaggaggatcacttgagcctgggagattgaggctgcagtgagcttgatcaccccagtgtactccagcctaggtgacagagcaagaacttgaatcaacaaccaaaaaaaaaaaaaaaaaggaagaaaaaagaagcaaaccacctcatgtgtatgccacactcacaggaaattaaagatgtgaacaccaaaagcaggtagttccaatttgccagcagaatgagtacagaaagagactcagaaacgacattt

SEQ ID NO: 178968 - DNA, 188 bp, Homo sapiens
acaggtaactaacgtggcaaggagcatccagtcccttccactcttaagttccccagaggacattaaaataaacagcaggccctggcctgtacaggctcacgcctgtaatcccagcattttgggaagccaagacaggaggatctgttgaggccagaagttcaagactaccctgggttaggtctacctgg

SEQ ID NO: 178969 - DNA, 467 bp, Homo sapiens
taaaagaaagaatggtaaaggcaattcacaagaccgctgaaaaaaggaaacattcagtggaaatattgtaaaatcccataaaattaaaagatccacctttcagagcacttgaacagcaaacttttcagaaggaacaaacctggagttcaaggttagaaagaacaagatggtccaatgaacagctctaattagcatttttcctagatgtattgcaaaggaaaaatgaaggtgtaagtttgggtgaaataaaagccagtgcggtttaaccctcacatacgtttgctcacctttaatactactactatctcattaaataggccacaactcttctgtcgctggtcgttagggttcagagtttatgtcacaattgtaatgggttattgactgcctcttaaagaacttcatagctccccaggctttgaatccattaatgaatgttggagctgataaagttgagtttaattaca

SEQ ID NO: 178970 - DNA, 114 bp, Homo sapiens
gtgttgagaattaattgtcttttatttttccaggagcctaaaggatgtagtggtggttaatctgtgacatgaaatcattaacataccttcttaggtctcaacagaatatggaat

SEQ ID NO: 178971 - DNA, 434 bp, Homo sapiens
tcctgctgccaccaccccaacaaagagctttggctggcattcccccatcggagtgttgtggacaatatagagcatgaacactttggcccctccagtgcagcagatgcctaaccttgaaagaccagagaacaaagcgggggggcccaatgccagttcctcagagttagagtatgaagcctaggagtgcagggctgagcctttgctccctataatcttacagagacaatgccagttcactaaacaccacaatcacatcctccaagtgcatcaaagaagataaaagcaaaaaacaacccatccaaaaagtagcaatttcaaagactgaaggaatatcagcccacacggatgacaaagaaacagcccatgaactctgacaactcataaagccagaatgtctccttacttccaaacaacagcactagttccccagcaat

SEQ ID NO: 178972 - DNA, 628 bp, Homo sapiens
tagctttttataaatggttggattactcatgatatatattatatgtactatacaggcatatgctttattgcactacaaaatattacattttttccaagttgaaggtttaacttgaataagtctattgacaccatttttccagcaacaggtactcatttcctgtgtccgtgtcatgcaatattctgtaatatttcaaatgttattataatttctgttacggtgatgtgtgatctttgatgttaatattttaactgttttgtggtgtcatgaaccatgcctatgtaagatgcaaacttaatcaataaatgtgtgtgttctgactgctctaccgaccagccatttcccccatctgcttccctctccttggacctccctattccctgagccacgacaatattgaaattaggccaatgactaaccctagtagaatggcctctaagtgttcaagtgaaagaaaaagtcacacgtctctcgccttaaatcaaaagctaggaatgattaagcttagtgaggaaggcatgctgaaagctgagacacgatgaaaaccaggcctcttgtgccaaacagttagtcaagttgtgaatgcaaaggaaaagttcttgaggaaaattaaaagtgctactccagt

SEQ ID NO: 178973 - DNA, 493 bp, Homo sapiens
atacaatacctttggaactcttcaaaatatgtttgaatatttaaagcaaaaattaaaacacggtcttgtggggtggctaacgtacacagatgtattatataagacaactatactctaaagcgacctagagagtggcaaggtttctattaatacattctacttgaagtgaatccacactgattcaaagctgtgagaagactgactggtagattcaggagttttcagcctgatctctccattatgaaggccccatcaattttttacctaatggttttaagcagtcattgatgatcattacctagacccatttttcattaggagttacaaaatgaaaaatgggtctaggtaatacactgtaatgacttagcacaatgtgatacagagtaatcactcctcagatagatatcttaaaaaataattgggtcttgggagaggactggcctgtagggtctgatttgggagttattgtggtgtgaagcaatgtgatgtctga

SEQ ID NO: 178974 - DNA, 650 bp, Homo sapiens
cacccttgtaatcccagcacttagggaggcagaggctagaggtttgcttgagccccggagttcaagaccagcctgggcaatatagcgagatctccacaaaaacaaaaacaaaaacaaaacaaaacaaagaaatagaaatccagaataaactcaaagtcaaaactaaatatcctaactgctgcaaattttcatttcttttttttctgagacagggtctcactctgtcacccaggttgtagtgcagtggtgtcatcacggctcactgcaaccttgacctcctgggtttaaatgatcctcccatctcagccttccaagtagctggaaccacaggcatgcaccaccatgcccaactaatttttttagtttttttttgtagagatgggctctcactacgttggccaggctgatgctgcaaattttcaagcaagctagcccttagcaatcttgttccacacgatgtttatctcatctaagccccaagaagggaaagtgattaagtatatttttgtaagaattttgattacattcattcctaagaaaacatcggacctgacttaccagtgaattccatggctgcattcatgtcatttactatgcagttaacataaccactccaaaactttgtctctgaaatcagtgtgggtagatct

SEQ ID NO: 178975 - DNA, 120 bp, Homo sapiens
gtatatttatagagtacatgagatgttttgatacaggtgtacaatgtaaaataagcacatcctggagagcagggtgtccattccctcaagcaaaaattgacaattttctttaaagtgata

SEQ ID NO: 178976 - DNA, 346 bp, Homo sapiens
gtgctggggtcgatctagaggattccctgtatcccggggaggggattattgacgttgttactctgtaggttttaaggatttcaagtcatcagtgtcttccagctaaggtcagatgtgctgctgatgacccagagggcttgcagggtgacgtctctctgctgggggaggcctcggggtctttcctgtgctgctgggtggtgtctccctgtcctgtgacccagtgtgttttcttcataatgagcattcattgcatttgggacagtacagtggagattaccgctgctcccaagggtgggcccagtgagggtgttgctcccacctcagtccacatcagctctctccaaag

SEQ ID NO: 178977 - DNA, 1047 bp, Homo sapiens
gttccatgcccttcaccccaccctcgccgacccgctgctgacatgcagcggtccctaagccgtcccccgactgcccagcctcttgggcatcctggggaagcgtgggcctcagagccaagcactgcccctcagaacgttccagagtgtccccagctcccccagagtaaacgcggagtcctgcagtgatgccctgcggcctcctgccagctctgtcccagccgttcatggctgtgcctacgactccacgaggccccctcacccccgacaggcttcacatttctctgtagcagcactcgccacatgcttggactggctgcctcttacttctgggcctcccatggtatagagtgtaagcgccagcaaggcgggagccccatgctcatgaggtgttgacccactgcccaccattactagctgtgagcgccagcaaggcaggagccccatgctcacaaggcgctgacccactgcccaccattactagctttgttgatggcatttcctgtgctggctgctgagagaatcatcaacacccacgtgcagatcctctgccctccctggcgctgtacctttgtgcaggtggagatcttccgccttcctcagtctcttctgctaaagaggcactggcactgacagcaagaggacctgctatgagaaccaaagggatggaagggcccggcaccactccttcccagtgcagctgtggagcagacgcagctgctgtccctttgtcatttacggggaggggattattgacgttgttactctgtaggttttaaggatttcaagtcatcagtgtcttccagctaaggtcagatgtgctgctgatgacccagagggcttgcagggtgacgtctctctgctgggggaggcctcggggtctttcctgtgctgctgggtggtgtctccctgtcctgtgacccagtgtgttttcttcataatgagcattcattgcatttgggacagtacagtggagattaccgctgctcccaagggtgggcccagtgagggtgttgctcccacctcagtccacatcagctctctccaaag

SEQ ID NO: 178978 - DNA, 302 bp, Homo sapiens
gagggtgactcccaggattaccaggtagactaactggttgaattgtcataggagcctgggtgagcagaatatttctcttcacacaaattcccaaaagtttcacagtctctgcattcttttctgtttctgataagaaaaactggttgccctcctctagtagctgggcttatttattcatgaattaaccttccatcatccacagaaaaggtaaaatgttattctttcctcatgcttgaacatgcttcaagttaggattctgagttttttaatacttcatgtagatcaagtgttagtctacctgg

SEQ ID NO: 178979 - DNA, 128 bp, Homo sapiens
tatgtgtcagttggccaccagtagtttgtagatgttacctttccaggtgacatgtttacaatttaatgaagcctctggagatagtatgccttaatctaaaggaatggttctaatgattaaaatttgag

SEQ ID NO: 178980 - DNA, 317 bp, Homo sapiens
tgttgccaattgaatggaagaatgtcaaagtctctgctctgtgctgaattggactaacttacacaagttgagagtagaccacttgagagtaacacagaccctcaactggttagaaaatattatcaacaataatatcagtagccaaccctcaaggggcacttaccttgtttccccattaggaatgagctaactgctttataaggatgaactcatttaatcctcaccacagcccaacatgtcagatcctattatcctcaatttacagacaaggaaactgaggctttgggaggttgtgcaatgtacccgaggtcacctag

SEQ ID NO: 178981 - DNA, 183 bp, Homo sapiens
gtcacgccacagtactccagcctgggtgacagccagaccctgtcttaaaaaaaaaaaaaaaaaagttacttaaggaaaatgggaaaaggcttataatgagggccatcttctcagagttgatttttgcatatggagtgaggtggggatccagtttcctcgtatcctatatggatacacatttgt

SEQ ID NO: 178982 - DNA, 1476 bp, Homo sapiens
cagagcgagactctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagc

SEQ ID NO: 178983 - DNA, 1313 bp, Homo sapiens
cagagcgagactctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagc

SEQ ID NO: 178984 - DNA, 426 bp, Homo sapiens
tgtcgtcagccaacaggatatgtccagccacagggtgttcagtatccagtggccagctcctcaagggcatggctgtggaccacattacttctgcttggtcttctgctgggctggtgctggagtgaccgttgaagggcagggctcaggcaccttgggctggcagggctctggaatcctgttggctggcgacacgttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagc

SEQ ID NO: 178985 - DNA, 269 bp, Homo sapiens
cctctctcagccaaggtttttcatgggcctgctttgcacgagaccgtgagctgggtccctggggccactgtcctctggatgggacccttttctcgtggtgccgttcaggctgtattttgctggttgccttgacaggctcatgcctgctcagtgtgtttgcagatggttcaaggtaacacagtaaagtaaggagcggcgtggctggccgtgttcctgctggagagaggaaggaagccatgccgggcagcaggctgcagggccgcacgtgt

SEQ ID NO: 178986 - DNA, 430 bp, Homo sapiens
tacatcttccaacgtgtgacatttctaatcgtggacaggcacgctaactgtttaagaggctgggaccacaggcataaactgaagctccaccagcaagcctggatgtgtgatcaccctaagtcagacttggaagtgcagctcctgaagggcaggaaccatccccacgacccctctctgcccattctagttcacttgaactgacttttggtgtcaggaaatttatttttgtttctaccccatccaccaaccccacaccaccaagcatttcagatcaagtatctgtgaatcataggtcaggttgactcatttcttaaagattccaggctgtgaatgaaaatggtattgatggctgggaggatgatcagatgtagggagtgtcaatgtgacttgttctacatttatctacaaaaatgcaaaccagatctgcaag

SEQ ID NO: 178987 - DNA, 447 bp, Homo sapiens
tctgaattttggatttttggattaaggatgctcgaccagtaagtatagcacagatattccaaaattccaaaaaaattcaaaacacttctggtcccaagcatttcaaataagagatactcaacttgccccaccctggctggcatcctgcctcatcattaagtctatttctgttttcatatttgaaaacataactaaaattgaggggttctttacctggggcccaaagtttgctcccagggaatctaatgaaccacctggaatcaaacatttggagagaaggccagtcacttttatcggaacgtcagatggtcatggaccctcaagaatgattgaagaaatttgtaagcccagttaaaacatccacagtcttctttcctcagtgcaaaagttgccctttttgatatctcatatttagagtaaaaaaatttcgttaataagagatcctct

SEQ ID NO: 178988 - DNA, 426 bp, Homo sapiens
aaggttgcaaggaacaaaggttttctctgacatagccttaatggcctaagcaggttgctccttgagtaaattacacttctgcctttgagaaaaccaggccaaggtgcttggattccaggccacctgaaagctcagttctaatcattgagaaagagtttttggaaataacctaggattctggcaaagattaaaaagaatactagcattactaagaagaggaggaaccattccttacacattaattttctttgaagttactctaaaatttctataaaacccatagtgaattaaatttctttttttctttcttttctttttttgagacggagtctcgctctgtcgcccaggctggagtgcagcggcacaatcttggctcactgcaaccttcgcctctgggttcaagcgattttcctgccttagcctccc

SEQ ID NO: 178989 - DNA, 212 bp, Homo sapiens
gggctgaaaaccaagaagaaccgagaaccagctgaaacttgcagtgttccccaactcgcacacagacctactgatagagggatggagactgacctggcaggtgactcctggttcagtgctccttggagaatttggatgccatgaagtgatattagatgtcagtttagctacctgttattttgagtgcttccttagcggtactgttgaggcag

SEQ ID NO: 178990 - DNA, 302 bp, Homo sapiens
aaacaagaatcaaccaacccaaaaatagcagaagaaaagaaataaaggtgacagcaaactaacagaaaaagagactaaaaaagaatacaaaggatcaatcaacacaaagttcgttcttgaaaagacaaaactgataaaccactagctaagctaaccaaggaaagaagcaagaagaccaaataaaattagaagtaaaaaaggaaacattacatctgatactagagaaatagaaaagatcatgagacattattatgaacaagtataaactaattgcaaaaacttagaaggcgattagggttagt

SEQ ID NO: 178991 - DNA, 501 bp, Homo sapiens
ttcaccccctttttttcctccctttcatcatcatcttcatcttcttcatcttcatccttatcccctttctttatcaatatcttcccatccttcttcatcatttatctccttccctttcttcatcatccatattgaaaaccaagtagtactgtaatggatttgtccaagtattatctttgatgaactctcccaactcaacaacacctgcatcagaacggtcagtaaaccaggtaaagaagctctctggttcttcgtgctgcctcttcctgctgactttactctgcgtttgactggaacgttttcattatatcctttccagatttgcatttgacttcagtggactctaaaaatagatcaccactctcattcagatgaaattccttggagagaactttattttcaaactaaagattttcatcaaaataaaaatctttctgtaacctgatttaatacctccaaattctgtcacttcaactcgtcaaataatacagtgcctctttg

SEQ ID NO: 178992 - DNA, 630 bp, Homo sapiens
atatccttctaatcaattgtggaataaagcctctatggttccatgataaattatatttaattttatagtgttttccttgaagcattttaacatgctagagatagatgtgtgtgtgtgtgtgtttacagttagatgtaaaatagcactcgtgttttcttcttgaagggagtcatttagaaattacctctcagccaggtgcagtggctcacacccgtaatcccagaactttgggaggccaaggcaggtgaactgcttgagtccaggagttcaagacctgcctggacaacatggcgaaatgccgtctctacaaaaaatagaaaaattagccaggcttggtggtgcatgcctgtggtcccagctgctaagggaagctgaggtgggaggatcacttaagcacgggagattgaggctgcagttagctgtgattgtgtcactgtactctaacctgggcaacagagtgggaccctgtctcaaaaaaaataaataaataaaagaaagaaaagaaatgatctctcctcatagtttgtgtgtaggaaaagaagtgataaaactgacctaattgaacttcaccttttgctcagtgacagataaagctttccttgatagcatacattggctcagtgccagtag

SEQ ID NO: 178993 - DNA, 750 bp, Homo sapiens
  misc_feature (694)..(694): n is a, c, g, or t
tgctggtttatgggaggtggagcagaggctgggcctataattagcaccccgcctgccttcagctttcatacgtcaagttatttgggtttttttgtttgtttgtttgttttttgagatggagtctcgttcttgttgcctaggctggagtccaatggcgcgatctcggctcactgcaacctccgcctcctgggtcaagcgattctcctgccttagcttcccagctactcaggaggctgaggcaggagagtcgcttgaaccagggagtcaagaggttgcagtgagctgaaatggcaccacagcactccagcctggcgacagagcgagacctgtctcaaaaaaaaaaaaaaaaaaaaaaaaacctgtgtgaaagctcctttttgaaaacgggggggaaccgggggaccaccttggggaaaaatttctggggacccccagtggaaacccttttgtggcggtgaaaaacgtggccctcaatggtggactctccaagggcgtgaggaacccagggtgttcctggtttccccaaagaagctttgggctcccccaaagggatttcttgttgtttccccctttgaccccccttttctccgaaaatctccaagaacatttcattgggcgtgaatccattgtgcctgcaatctctccctatcttttagacgctggttgctacaccattaaagggcgtgagacacanggccaggcttaaaccgaggggctcacaccccttcaatacaaggcccgggaaaccgg

SEQ ID NO: 178994 - DNA, 211 bp, Homo sapiens
caaagtaacaaacaaggtgtagtaacttaataggtgcttctgaccgcagaggacttaaggccagatgagaaagacaggggcagttcctccactcagggagaactcagcttgagggagcagatgtagagccacagtgggaaagactgttagtgctcagagcaggaagcctggggatttgtatctctgagggttgaggcctcgagggcagccc

SEQ ID NO: 178995 - DNA, 512 bp, Homo sapiens
aatatgacatgtgagagaggaaccaaggatgattccagggtttctggtctcagcgttagaaagttgccatcaacaaagacagtgatgactaaaaggagcaaatttgaggactagattaggaggagttcaattttaggcatagtaagtttgagattgcctgttagatattgagttgatttgataaccaagtctgaagttcaggggaaaggtctggaatggagataaattttgttttcaccagtttaggtattattcaagccatgaagctggatgagattaccagagaatccttggtagaaagagagaagggccaaggattggtctttttattttttttttaagatggaatcttacattttccccaggctggtcttcagcctgggctcaagccattctcccacctcagcctcctgagtagctggaactatagatgtgtaccaccacacttggcttgattggttttttaaatgcctgtgttaagagaactgttttagtgtgcagtttgaggtttt

SEQ ID NO: 178996 - DNA, 830 bp, Homo sapiens
  misc_feature (87)..(87): n is a, c, g, or t
gagggttgaggattgcttgagcctagaagtcaaggctatagtgactacaaatgtgcactgaacttcagcctggtgacagagcaagancttatcccaaatttctcttttttcgttgttgagacggaatttcactcttgtcaccgaggctggagtgcaatgttgtgatcactgcaacctctgcctcgtgggttcaagcgattctccagcctcagcctcccaagtaactgggatacaggcgcccgccaccatgcccggctaatttttatacttttagtagaaatggggtttcgccatgttggccagggtgatctcaaactcctgacctcaagtgatccacctgcctcagcctcccaaagtgttgggattacaggcatgagccaccatttcctaagtgagcacagctgttcacctcccagatagagaatcagacctttaccagcagcccagaagccccattttgccctcttccagtcactgccttgctttccttttttcaaaagtaactactatcctgtcttctattctgacttccatggattattttttcctgtttttgaactttatatatgtaaagttcacaaatggaattgtactgtaagtggaattgtacagttcatattttaagaaaattgaccgaagtatgaaaaagaacatatagacaggttagacgagtgcacgtatcatccatgctcagcttgatgaattttccaaccaaacacatccacacagccaacatctgaatcaagacactgccagtaccgagaaggcccagctgtgttccttgcagtcactgccatcccctgccctccttcccactctgagcaaaccgc

SEQ ID NO: 178997 - DNA, 272 bp, Homo sapiens
ttatttgtcattcatctaagatttgtctttctgcagtgtttagactagtgctaaataggtcatttatgaggaaagtgtagaaaaactctttagtaaggtactatatattcttcatatagaagtgtcctttttaaaattaattttgttcacaatatatgcttcacaatattccagtcaaatctgacctaactgaggctattgcacacatgttgtgacttgtaaaggctgtgggacaggacagagaaaaggcatgaagcaaattttcagtccca

SEQ ID NO: 178998 - DNA, 561 bp, Homo sapiens
tcacctgacctggagagttcaaagtgcctaacacagggatgctgctacccacaagcctggatcctggcgtgctccgcggctctccttcaagccctggcctcatcagacctccaaggctccctagacagggttaattattcacgtggcctgggacccagggttcgtttgtttgtttttcccgacacagtagggtccacgaggaagtcaggatccaccggcaatatttgcagtgttatgttgaatgtggcaactggctgcgtgaggatagagaagtaaacagcatgtccggtggcagtcggttaccacacagaatttaggaggcccagtgaaatgcaaatgctaggtccccctcccctctgggtgagcctggatgccagcaccctgttccgcccgcccagcatgcagaacaaaagcacaacgcacagaaacacagccggtgcgcgcagggcggcaggctggcttctccctccctcctgccgaggtctccggccccttcccccttccctccttccctcccctctcctcttctattagaaaatgggagtgttagggttgaattgt

SEQ ID NO: 178999 - DNA, 2110 bp, Homo sapiens
  misc_feature (971)..(971): n is a, c, g, or t
  misc_feature (1016)..(1016): n is a, c, g, or t
  misc_feature (1027)..(1027): n is a, c, g, or t
  misc_feature (1040)..(1040): n is a, c, g, or t
  misc_feature (1062)..(1062): n is a, c, g, or t
  misc_feature (1067)..(1067): n is a, c, g, or t
  misc_feature (1098)..(1098): n is a, c, g, or t
  misc_feature (1121)..(1121): n is a, c, g, or t
  misc_feature (1129)..(1129): n is a, c, g, or t
  misc_feature (1202)..(1202): n is a, c, g, or t
  misc_feature (1205)..(1205): n is a, c, g, or t
  misc_feature (1752)..(1754): n is a, c, g, or t
  misc_feature (1925)..(1926): n is a, c, g, or t
  misc_feature (1955)..(1955): n is a, c, g, or t
  misc_feature (1960)..(1961): n is a, c, g, or t
  misc_feature (1972)..(1972): n is a, c, g, or t
  misc_feature (1980)..(1980): n is a, c, g, or t
  misc_feature (1990)..(1991): n is a, c, g, or t
  misc_feature (2013)..(2013): n is a, c, g, or t
  misc_feature (2017)..(2017): n is a, c, g, or t
  misc_feature (2032)..(2032): n is a, c, g, or t
  misc_feature (2098)..(2099): n is a, c, g, or t
cccaaagtgctaggattacaggcatgagccactgtgcctggccatatgggacatcttgtaactgggagttggagtcctgggtacaagtcctggcttcaccgtgtaccagctttgtgaccttgggcaaatcacttaacctctctgagcctgttttcttgtctgtaaaacagggataagagtgcatggggacccagcccccagcactgtgggtttgagaggagactgcttgtgtaggatgctcagtacagtgtctggcacagagtgagcgcccaggagatgccagctctagttcttgttgccatagctgctgctctgggagggctgctgagacccgctgaaccgggcatcccatcagccagcacctgccctgcacccagcccttggtggggctgggaacgggggaatggtccctctatcctgaacaggctgaaggcacctccttcccatattcgtggtagggaatcgagtcacctgctggacctggcatggccgaggggacggccctctcctgactgccagagtctcttggatgggcttcctgaccatgagggcacagggcaggcagcctgggcccctcactccccactgccagcaaggcggtccatgcctgctctgccttccattgggaaagatgtgtggtcacatggaaacggcctgtgcagtggggcgtgaggtgggctaggacaggggatgtccccagagaagccaggtgactgaagtggccctgtcagggcctggctgccatctgctgaggcctaagctgccagagaagacccctgaaggccttcaggggtggggtggagggcgctggcatgcttggttggccagctttggaggtcccagaggccagggcagtggctgcttaccagacagaactggctaagatctggttcctccactatgttgggcaagcccctgcctcttttttttttctttttttgagactgagtctcgctctgtcacccaggctngagtgcagtggcgtgatctcggctcactgcaagcttcgcctcccnggttcatgctnttctcctgcctcngcctcccgagtagctgggattncaggngcccgccaccacgcccggctaattttttgtntttttagtagatacggggtttcnccgtgttngccaggatggtcttgatctcctgacctcgtgatccgcccgcctccacctcctaaagtgctgggattacaggcntgngccaccgcacccggccagcccctgcctctttaggccttggggtttcccatctgttccttatgggggcattaataggaaaaaaatgcattaccacactggaggggctcataaacggtagtgactgttattagcagtgagggatctcacttcaccacccacaggactccgagcccctcgagggcaggggcagctccatggactctgggtctccgtccctggacagggctcctctgcggtgggggcagcccgagcatgcctgcccctggaaggacatacaggaactcatgatggctcatggctaaggagtcttatggggaagcaggctgccctggtgggcacggctgtgtgggagtctcctgctctgtccactcctggcaggggcagggacgcggctgtttatatccgcgccgggtgtcaggagatggaagccagggaggacgggaggatgcaggagcatggagagcatgtgggctgcagatccgggggaggatgggcaccaggacagagcttgtcctgacagtggtgcgggaggcagtgagcagaggtnnngctgagaggtcactggcggcttcctccactgaggcatggctggcattcccttcggttcattaaaacccatcagtgggccgggcgcggtggctcacgcctataatcccagcactttgggaggccaaggtgggtggatcacctgaggtcaggagttcaagaccagcctggccnngatagtgaaaccctgtctctacaaaaatncaaannttagctgggcntgatggcnggtgcctgtnntcccagctactcgggaggctgnggcnggagaattgcttgancctgggaggcagaagttgcagtgagctgagatggtgccaccgcactccagcctgggcgacagagcnngactctgtctt

SEQ ID NO: 179000 - DNA, 132 bp, Homo sapiens
agtcccttatttgttttccctaagcataagaaactaaaagataaaaatgatttggtttattgggttgggtagttagctgtttctaaatgttttatcttataaacttctgagaaaacaaagcttgcttctata

SEQ ID NO: 179001 - DNA, 467 bp, Homo sapiens
tcatcataaacttctgctgatagttaacattttggccaagctatttggaactcaaccccttcaccatgtcaataattgcaaatttttattaccattcaccgaagtttattcatggttttggttttttgttttttgtgtttcttttggcattttcattattcccaaactctctggttttccagaaaatgtagtgctgccctctgctggctcttatgataatgacaacctgaaaatgtctcccatgacttttaggctgttggattataaacattgcttagagatattattcaatgtatctatctgttaaataaatcttccttataatatagtttcccacagtcaaggcagtcacaacataaaatcagatggagaagaaatagcactgtatagttctattaaaaaattgacctaggggctgggcattgtggcttatgcctataatcccagcactttgggaggccaaggtg

SEQ ID NO: 179002 - DNA, 419 bp, Homo sapiens
ttcatatctataaagtgatgataataataaataatatctaccccataggctcgttgtaaggattaaatgagacaatcgatataaaatactacttaacccagtgctggacatgtagtaagcattcagtaaattttaattgttctttgatatgttatttaattttttgttatttgggattcctcattaactagcatcttattatagaatgaagtttctttactaagaaaatgccataatgaccttgccttgagctctgtgtttaatattcctgcatttcaggtttccttattaattttcctataacttgcattttcagaatcttaaagatgctgttcgctgggcatggtggctcatgcctttaatcccaaagtgctgggattatagacgtgagccaccacaccagcctattctatttctaa

SEQ ID NO: 179003 - DNA, 259 bp, Homo sapiens
tgtttcttctagtctaacagcatttcttctcacaaaattagccattcccctggtttcctagtataaaattaccgtggatatatgcagttggatctacccatagtgtaactgaatcagtcctttgtagaaggattgtataatcattttgtgattaatcccacttaccttggactttttagaaggtggtattattagattgggtctaaagttagcaaaattatccacctatctaaacaatatcaaatgtgagtgcatttgt

SEQ ID NO: 179004 - DNA, 318 bp, Homo sapiens
gtgtgatctagaggatccctgtgaatacacagcgacagaataaatagcagactggggtcagtctcctgtgggattcctatgttggggatattctccctcctccttgggcagcccagtggctgagctaagtctgatgtgcacttagtatcagagaaaggttaagtcattggtgcatgaggctggaaatgactgatgacctgtaacatgttgcaagagggggtaggtcaaggactacatccaccctgtgtggccctctatgcttggctcactgactgtcaccacacttctggtctctagcctaggctcttgctggggatt

SEQ ID NO: 179005 - DNA, 184 bp, Homo sapiens
cccaaatcgtgcctttaagctgtttgttggtcttggaggacctgcgattcctggaatgttttcagaatcagcaaccattgctgatttttgcctgaaacaattactcctgtggtgtggcccttcctccttggcaagactgtagcctctgcaagagggtctgggtgcctgggagcaggagatgtgg

SEQ ID NO: 179006 - DNA, 241 bp, Homo sapiens
gagacgatacaatcgagctcggtacctcataggttcgcaggacttggattatcccagctcttgcctatttagacaacctcagagattctatttccactgtatgtggaggggactgagtattggtacttttgaaaagtttcttggatggttcaagtgtgcagccagagtcaagaacccctggattagtagagctttccaggccagctgaccccacagtcggcccttgggtcaagttcaagct

SEQ ID NO: 179007 - DNA, 387 bp, Homo sapiens
tgttagtcattccttgctgtgtttaacaagatatagtaagagataagctcaggtaagaacatactgacttgcaggtgaaaggaaaaggaatagaaggagtccagcaatggagccttgtagggttggagaagctgctgaaccccaacaacaggaaaaaagactgaaaaggctttgagaaacacaggtccactaaggtatttcaattaaacagaggaattcagcactactgcaaagaacagtttaaaggtgttttctcttacctaaacctattgtttcctatggcctcactgtaactgccattaagttgagagagagaggcatggagtgaagaaagaaagagataagcaaaagttgatatttatgtcttgaaaaaaatccagcctggcc

SEQ ID NO: 179008 - DNA, 523 bp, Homo sapiens
caggaaaaatccgggtatttcttctttaatgatgtcctgatagggcagaaaaaaataatttgtcttcagaagattggcttagagtggctgaatatatttaattcaattactggttcttgcctcatagccaggaattcttcaagtgatatttgctgagtgtgtacatggagggaaatggagacaaatgacattgcttgtgacccactgccttgagaggaaagccttcggtaatgattccagtaaaactagagctagagcttgggaagctaaacttgtgattacttactagtaaacaagagaaaggacctgttgtaggtgcaaaaatcttactgaaatgcctgagtatgcactggagaaagccctggactgcacaccaggggtgctcacccacttgtttactttttgtggctttgagcaagtcatccattctgcctttggtttttcacttgtcagaggggtgctagatgatgataattactgctcagtgggcttcagttacaaagcaccttaacatagagtagct

SEQ ID NO: 179009 - DNA, 532 bp, Homo sapiens
gaggatcccgagggccaggagttcaagaccagcctgggcaaaacacagcaagaacccatctctacaaaaagtaaaaaattagccaggcatagaggcatgcacctgtactcctagctactccagaggctgaggtgggaggatgacttgagaccaggagttgcaagggatgatcatgtcactacactccagcctgagtaacacagcaagatcctgtcttgaaaaaacaaaaacaaaacaacaaaaaactcacaacaattaaaagacaactcaaagaacagccaaagaatgcgaatagatatttttccacagaagatacacaaatggccaataagtacctaaagaggtgctcaacatcattactcatcagagaaatgcaaatcaaaaccacaatgaaatgagataccacctcacacccaaaatggaatggctacagtcagaaagtcagataacaagtaccaatggggatgcagagaaatgggaacagccatacactgttggcaggaacataaaatggtccatctctggaaaacag

SEQ ID NO: 179010 - DNA, 247 bp, Homo sapiens
tccttgaaccaggggcggaggttgcagtggctgagatcatgccacggccctccaacctgggcaacagagtgggactctgtcttaaggggaaaaaaaatgatgttttacagatttgttttatgcccaagttaaggtttaccaagcagctggcatgctttagggacccaacaaatgctagtcccttttcttgtccattgaatgaactcaacattcctttaaccttccacatgtgataacagcacctgct

SEQ ID NO: 179011 - DNA, 222 bp, Homo sapiens
attcatgtaaaggttaggattaggccatgagctctaacatggcttctatagccatggttccagcatcagttcaactttcaaaggcttatgctgtgccatctgaatttgtcccacttttgtatcatcgaatggttagcctgggtgacagcctttatttccaagtatgtatagttcagggaattcataaagaactttatggtattgcttttccaagcttctctt

SEQ ID NO: 179012 - DNA, 530 bp, Homo sapiens
tgcattggttgcctgtgcttgtggggtattactctagaactctacccagtccaatgtactggagaggttttccactgttttcttttagtagtttcatagtttgaagtcttcaacttaagtctttaatccattttgatttgatttttgtatatgatgagagatatgggtctagtttcattcttctgcatatggatatccaattttcccagcaccacttatttattttgtttgcaacaaagaaagagtttaattgtcacagggccaaccaagtgaggaagacagtagataattctcaaatctgcctccctgagaattcgggggctagggtttttcaaggatagtttggtaggcagtgggctaaggaatggggaatgctgattggttgggtcttggataaaattgtagagagttgaaactgtcttcttgccctgactcagttcctaagtagtggtcacagaaccagttgagtcagtttcttcatatgggctcctggtccaagtggcaccaggtggtccatcaaaatgcaaggt

SEQ ID NO: 179013 - DNA, 274 bp, Homo sapiens
tcatgccattctcctgcctcagtcctccaagtagctgggactacaggtgcccgccaccacacccggctaattttttttgtatttttagtagagacggggtttcaccatgttagccaggatggtctcgacctcctgacctcatgatctgcccgcctcggcctcccaaagagctgggattactgacttgagccactgtgcccggccatcctggtcttatatctttctgtcatgagccctttttccaaaagattggaatgaagaaagtgctttgatg

SEQ ID NO: 179014 - DNA, 592 bp, Homo sapiens
taaagacatgcttcaagtactcctccctcagagctgagagtacaagaaggggtcccagacttatttgttcctttccccaaccctcactgattctaaaattacttctcaatcactgaacattagtcaatatgtttattttttaaagtaaagtgtgggaaggttgtggagagtgaatgatgagattctataatctgatttaaatcttatctgcaggttataaaatgttaaaattcatgtttggaatagaatgcaacacaggcacatattctccttgaaaattttattcctgcagtttaatttagttgggaagaaatggtcagaccagctatttttttaatcacgtagatagattgtgtgtcctgtccaaacctggcaacccctgggatcactgccttcttcctctcctgctaatcaaattcaacccatttttcatgtaccaggcaaagtcccactcttctaggagggtcgcctgggcacccatgagcttcttgagggcccagcctctgtttcagccatctttgtggcccagcaacaagcaaagtcagggacttggtagaagtgtggggaatgaatcaaaatgaacaactttctc

SEQ ID NO: 179015 - DNA, 185 bp, Homo sapiens
ccatatttggtctagaggccatactttgctgaccctaatataataagtcttactatgtgaccattaaaaagaaccaaatagaattatatgtactgacaaagatatccatcaagttgtttttttgttttgttttgttgagatggagtctcgctcttgttgcccaggctggagtgcaatggcgtgat

SEQ ID NO: 179016 - DNA, 188 bp, Homo sapiens
gttgcattgaattgatgaagcatctcatttgttttgaagtcaaccgtgttgttgcatctggctgcctttgattccccctggaaaactaagtacccctctcttgtatcatctttattcatttacttattcattcatccgagtattatcatacaccataacaaaggcctggggattcaggagtaaatata

SEQ ID NO: 179017 - DNA, 224 bp, Homo sapiens
ctatgattacacattaattatttaatcactcatctattgttagatatttgggttgtttctaatttttttttactattttaaatggcaccaccataagcatgtttctatcaaaagtcttgttcttatttcctgaagggagattcttagaagtggcctccatgtgttctccatagcctagtcccacctcttcccagagtaccagccgtttccttgcttcatctcgt

SEQ ID NO: 179018 - DNA, 187 bp, Homo sapiens
gggagtagtccaaaagcacactgagtaaaaggagaaaaaaaaaagaagagggatgaaggagtgtgtagtgggaggcgatagtaagtaaacacatgtacaaagcttatgtagaaaaatggaagtgaggttaaaaaaaaaaaagggcggccaaattaaattaaaggggaattgccgggtaagagagcca

SEQ ID NO: 179019 - DNA, 525 bp, Homo sapiens
catctcaaaaagaactaccggattacagttatgttatgttcacaataccagcatccaaaaatatccagtgacaggatacagcaagaaacatgactacaaggtctatgaaacaggagactacagtacctaaaaaggcagatttaaacaaattcctgtaatgtgctcatttcagtcatgctaacttgagaaagcttttaaaacttttaaatgtaaataatccactttcacatttcttccaaaatgaaaaataactccttttttctgtcactgactttggcgaattttccaaaaaataaagagaaaacagttttgttttttggttgttgttttttgagaccacgcctggccttgaaaacagtatttatttattttttttttttttgagtttcactcttgttgcccatgccgctcttgaactccttggcctcccaaagtgttaggattacaggcgtgagccactgtgcctggccccaatttagcaccttactgggtgctgaggctgtgagccatagtagaatgcatgtg

SEQ ID NO: 179020 - DNA, 535 bp, Homo sapiens
tgcctattttcctccaaatattactaagtatttcatcatatacaaaaaaaagatatcttagcattgaatttagtaaaggacaaaggaggatacagctgcatgaaaatagatgatatattcaaatactactatgtttgcaaaggactgtttctattctgttcattggtagcgagaggcagcattggaaaaaattttaggataaaatagattttaacagctgtcttagtccatttgttattgcttataacagaatacctgaaactgggtaacttataaagaaaagaaattttttttttacagttatgaaaactaagtccaaggtcagggggccacatctggtgaaggccttcttgctgataaggactctgcagagtttggtgtcagtgtagggcaccacatgacagaggggattgaacctgctagctcaggactctcttcttacttttacaaggccagcagtcctgtcatcatgttaactcattaatccactggtccattaattcaggaatggattgatccatccatgaagacagag

SEQ ID NO: 179021 - DNA, 316 bp, Homo sapiens
gcgagagaatgagatgctgtctcaaaaagaaaaacagaaaaagaggaagaacaacccaggaccttgagtggagtgaggaacttgttggccctgatttgtgtccctctgatttcactttaaaactgaaacctcccttcctgatgcaggtttatttgcagcacttttaacatcagtacctatggtcaggcttgcctatgggctcagtcgggtggaatcaaggaaggtcagggagaggaacgtaaccaggcaagggcaagggttggcagagtgagatgaacgcgctcagcgcgcctgtgtgcgaggccagtgggtcgcc

SEQ ID NO: 179022 - DNA, 372 bp, Homo sapiens
gctaagtggtagagcacggattagaatcatctattggactcccagaccagtactctgagtcactctgaatcagagtggaaagggcaggggagcacagggcaccagggcagacagagcctagggtgggacactagggtctgaggatgaaagctggataaggttcctaaggaggagcatggggaagaatgtgacaccccaggtcctaggggctgagctccggtttcccaggaggcagggtgggtgtgggaagaggaatccactactgccaagccctcccaaactccctggagcttatactcaccagaaccccaaagggatgagattagctgatctacagctccctaccgcattccctccagaaagaaagaggaa

SEQ ID NO: 179023 - DNA, 751 bp, Homo sapiens
ttccctggatgggggtcaccacgtctccagcaagaacttggaggtgaagatcaccttttccttcctctccttacagagcctggcagaggcatggcttgttgctgactgagagcatctggaaatgagcccccagcactcagagtcaccaccctcaccatgccccccagctctgtgctgtcagttcctggtcagactgcaaagatgcccatgagtggactgtgcccatgccctgcccctgctgctaacacccagtcccccaagtcttctctggcgccagggaccaggtctgagacagctctgtttccaccacttgccctgtggctggcctggcatcctcaggatctgccctggaggggaaagaaaggcagggagagatgggcccagtataccctgagttcttttctctacccaatgactctggcttggctgcccagagtgtggcctgggctttgatagtgaacaatagggaagcttctaggcctgtcttgccccagagagccagctttgagtccctgccagggcctttataatccatttattatacatgctgtcacaacagggctgagctgactcctgggggcactccagcacccctggatgccagtcaaatgaacccctgcttggtactgggtgacttacctcttcaccacatctgcaagagggacagataaatatgaccttccagaagtgtctgcatcacctaacaatgcccttccagtgaagatgaacccctagctgcaggtcaggccac

SEQ ID NO: 179024 - DNA, 516 bp, Homo sapiens
tgatggctaattctgaaatgggattttgttataaccaatccaataaaactttttgggaccagattttcaactttttggtgtgagcaggaagaggaattttaaatcagtttatggctcagaaaacactaacggaaactcaaagtaaaacatttctgttaaagcactaccacaacagtttatacaaacttctatgcaacccacagttggtcaactaaaatggaaaatgacacctctctagggcctgaaaatactcaaaaaacagagtgatgatagctgatactgagcactcactgccatccaaagcccagagaatttagtccacagctaagacactgtagggctagggttcaaacccaggcagactgggctaagaatctacatttttcatctctacaccagtgtttctggctgaatttagtcctcccgccaaagtttttatgttgaaatcccaaccactagtacctcagaatgtaactgtatttgaagataatgtctttaaagaggtgattaggataa

SEQ ID NO: 179025 - DNA, 463 bp, Homo sapiens
catacacacaggttcctcagggaagtgcaggacttgagtatgtgcagattttggtatactcaggagtcctggaatcaatcccacatgtataccaagggatgaccatattttcgtcattaattggtacagcttgagtatctcaaatctgaaaaacctgaaatcttaaatgctccaaaatccaaaactttttgagggcccacatgatgctcaaaggaaatgctcattggaacatttctgatttcgagttttcggattacgaatgctaaatcagtaagtataatgcaaatattccaaaacacacacacacaaaatccaaaacctaaaacatttcttgtcccaagcatttaacataagagatatgcaatctgtactaccaggtattcagcaaatattgaaatgaatgaatgcatgaacaatgaatgaataagtcaaataaagacctgaaccacatgagaacttttgc

SEQ ID NO: 179026 - DNA, 365 bp, Homo sapiens
gtatggctggattttatatgagatttatcgaaaactgttaaaactttctaaaagaaaggagatgaaggtaaagccaattctataaaacaccaaactgcaaacagagcagttaggaaccaactttcttcctaaaagagcagtaacagaatttgtttcctagcttgtcagcatctgacgagatgatctgacagaaatggtcttttttcaacgggaaacatctaaggagttggaagaggcagacaggatgtagctcagagttggggaaacagccagagtctgcttggatgggatgctgacactaaagagaacgcagagatacacatgactctttcatctactttcaaccttggaagagtccagcacag

SEQ ID NO: 179027 - DNA, 428 bp, Homo sapiens
  misc_feature (13)..(13): n is a, c, g, or t
tcggtacccctcnacgctttatacttctcagggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtcctttttttttttttaaagatgctttgacaaccttgtgagaaagaattgaagggaagcaaaaggtgt

SEQ ID NO: 179028 - DNA, 464 bp, Homo sapiens
cttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtcctttttttttttttaaagatgctttgacaaccttgtgagaaagaattgaagggaagcaaaaggtgt

SEQ ID NO: 179029 - DNA, 233 bp, Homo sapiens
ctgcttctttccacatttcatatgggagaatggtcagttggatggaatgaaaataaacttttcttagacaagttacatgatagaaaacatcttgaatctagttaatagtcttagctccattaattgttagaattttgtcagagtagagcaggtagaattgagcagtattgaaacaaaacaaaatcttgggttattagctttggtcttgctattcacagtgtgtgaggctggag

SEQ ID NO: 179030 - DNA, 251 bp, Homo sapiens
tcacctcagcctcccgggtggctgggactacaagtgcacgccaccgtgtctggctaatttttgtattttttgtaaagatggggttttgccatgttggtcaggctgttctcgaactcctcagctcaggtgatctgcctgtcttggcctcccacagtgctgggagtgtaagccaccacacctgtctaaggaaagggatttaatgcaggtattgcaaaagtatcaaagtaagcttgaccaaggtaggtggaaat

SEQ ID NO: 179031 - DNA, 460 bp, Homo sapiens
atctcctgacctcgtgatctgcccgcccccacctcccaaagtgctgggattacaggcgtgagccactgcaccggccaacagtgtatttctaagaacgtaaattcttaatattgataaattgtgtttttcccattatatctaagaaatctgtctaatccgagaccacagagatgttctgctattttcttctggagattgtatagttttaggttttacatttaagtctatgattcatttggagttaatttttatatacggtgtgagggatggatggaaagttctttagatatagatataggtatatctaaactttaaaaaaaatcactcgtgcttgcttcagcagcacatacattaaaattggaacaatatggagaagattagcctggcccctgtgcaaagatgacctgcaaatttttgaagtgttctatatttttcagggagtctcaggccaaggatgtcg

SEQ ID NO: 179032 - DNA, 196 bp, Homo sapiens
ccattagagggctgctctaggactggagaggatatatacataaggggcagaaaacagtacctggctgagttggaactcaacactgctctcttttctatactagtcttctgccttgggacagaatcaaagaataagcattccctgtgacctcagcaattcccaaggagaccttcaggagataaggatcagacagaag

SEQ ID NO: 179033 - DNA, 681 bp, Homo sapiens
tgctcctaagcctgctgtttccagatgccaatgccagtcaatgcctgtatatttacccagagaaaagagagcccacggacccatccaaaagtcaccagaggcctgatgtgggagtatgaaggagagatcaaggttgtaattcaaaagaaaatgagattttctcatttttattctgctcctgctggcgatggcgctggcccgggaggcctgaggaagcgagctggggagagggaagcctggcacaggtggtggcaaagggtcccctggctgccctttctggtctggggtcaggtcattcccccacccgtataagcacttggaaggtggtcctgaagtaagaaaccaggccactgcaggtcttcaaagccccaagcagcaggaatacccaaaaaagcccccaaaagtactggttctactagatggagggaagaggccaagctaggagcagccttgggcaaggctgacaaaaaggatggcctgagctcctacagcttccccaagttcctccggggtctccgagcaccatggatgtgaaccaactgcttcacctcatatgtgggtaaactgaggcctggggagactggtcagagactgaggcagaaagaaaataatcaggaggaagaagtccaggaagcagatgttttcatgaaaacatcgacccaaccctaaagccctcatata

SEQ ID NO: 179034 - DNA, 239 bp, Homo sapiens
gggcgtaacagtgaaagccacgtgaatgtcatctgggaaaaacacggatggccaattcgtaattctttaaaagtcttaaaaaacatggcaccaagctgggcgcggtggctcacgcctgtaatcctaatgctttgggaagctgaggcagggagaatcttgaacccaggaggtggaggttgcagtgagccgagatcatgccattgcactccagcttgggcaacagagcgaggctctgtctc

SEQ ID NO: 179035 - DNA, 311 bp, Homo sapiens
agcttcaacttcttactctaactctacaagccagactggaagacaaatatttttttgcttttcctctatgtttgctgggtgttcattctcactgcagtagaataatgaattatccaatatatagataatagaattagaaggagggagcttaatacggaaagttctaaatagtgttttcccttatgggtagtttagccagcctttatcctttcaaattcacttaccttttcctgttctcattccaaacattaattgaaaataggtcacagtagaaattagccggtttactttgtgggtatactaagatggag

SEQ ID NO: 179036 - DNA, 670 bp, Homo sapiens
ttgtaacagtgcagcacgatattaattaggaaaaagacccatgaaataatttttaaaaaactttcaaaaggaaaaaactatttgggcttccttctgctgaaattcgcctataaacataccacgccagctagaccagcattccctttcacgtggtctgtacaacatagtactgcacaatgtgagcaattactttgatgaacacattgtttttttgtgtaaactgatttcagtttacacaatttataacctggtattcaaggccctctacaatctaccctttcttgctgctgttttgatagtcaaataacataagtgaagtattatgcaaatatcactgtggttgttaggctttgtctttttccctcactgttacctttaccagccccaggtttaaatcaaaccagtctaatcagtatccttaagcatactttgtgtttttttctttctcagcatctttgttatagcaattccacttccctggaattctctccctcccttctttcctcctatatcctttttgaaatcttactttttgaaatcagagtctcagtgatcattcacttctttgaatcagttgtaacatattttttataccatgtgttatttagcctgtgcatccttaaattattgtttgatttgtgtaaactgattgggatcctctcgacatcta

SEQ ID NO: 179037 - DNA, 465 bp, Homo sapiens
ggggtgtctagaggatcccaatcagtttacacaatttataacctggtattcaaggccctctacaatctaccctttcttgctgctgttttgatagtcaaataacataagtgaagtattatgcaaatatcactgtggttgttaggctttgtctttttccctcactgttacctttaccagccccaggtttaaatcaaaccagtctaatcagtatccttaagcatactttgtgtttttttctttctcagcatctttgttatagcaattccacttccctggaattctctccctcccttctttcctcctatatcctttttgaaatcttactttttgaaatcagagtctcagtgatcattcacttctttgaatcagttgtaacatattttttataccatgtgttatttagcctgtgcatccttaaattattgtttgatttgtgtaaactgattgggatcctctcgacatcta

SEQ ID NO: 179038 - DNA, 670 bp, Homo sapiens
tagtaactgaggtctaagacctggtagcctttttatctccttccccagttatcactatagccttataaatttcttcctttctgttcccactgctgtcactttaacctgggtcctttttagcttattgctgaactgtcataactagtctccctgcctctagtttctttatcttctaatgatggagtattccatcttagacgtgtagatactgctgctagaatttataacctggtattcaaggccctctacaatctaccctttcttgctgctgttttgatagtcaaataacataagtgaagtattatgcaaatatcactgtggttgttaggctttgtctttttccctcactgttacctttaccagccccaggtttaaatcaaaccagtctaatcagtatccttaagcatactttgtgtttttttctttctcagcatctttgttatagcaattccacttccctggaattctctccctcccttctttcctcctatatcctttttgaaatcttactttttgaaatcagagtctcagtgatcattcacttctttgaatcagttgtaacatattttttataccatgtgttatttagcctgtgcatccttaaattattgtttgatttgtgtaaactgattgggatcctctcgacatctagattgtgaaacttttgatg

SEQ ID NO: 179039 - DNA, 409 bp, Homo sapiens
gtatattccatctcaagaaactactttctttgctcatccataagcagcaactcctcatccattcaagttttatcatgagattgcagcaattcagtcacatcttcaaggtccacccccaaagaacatcctcagggtcttgaacccctccaaaggcatccatgagggttggaatcaacttcttccaaattcttattaatgttggtattttgacctcctcccatgaaccacaaatgttcttaacggcatctagaatggctaatcctttccagaaggttttcaatttaccttgctcagattcaccagaagaatcattatctatggcagctacagccttacaaaatgtatttcttaaatagtaaatcttaaaagttgaaattactccttgatccacgggctacagaattattag

SEQ ID NO: 179040 - DNA, 300 bp, Homo sapiens
aggtattaagagctgttgccaaaatcacatgaaggtaagagctctgtggagaaactggatcctctctaaggaacagatttatgcttaactcatagaaacctaattacgcaactgatcttgttttcctctttgctcagagtcaaatctgtggtctgcttttagcagggatctaggtctgtggcaaacacatcactatccaaccttcttcctatactcatcttttttcttaaatcgtaattaagccgggcgcagtggctcacgcctgtaatcccagcacttcgggaggccaaggcggacaga

SEQ ID NO: 179041 - DNA, 251 bp, Homo sapiens
gacctgttctaccataaatcattatttacttaccccatttacattatagtgcaggtccaatggaagacaaattatactgagctcaggcagactaatcaatacctgactactgatcacagggtgaaagaccaagtaagttcaattaccgataacaataagactgtattagtccctacaaattttccccacaatgaagtagtaacaatggaactaggcctaagaacattgcattgcatttttctatttctatt

SEQ ID NO: 179042 - DNA, 828 bp, Homo sapiens
ctcccagaagtccattttacagatgaggaactgtgaggtaactcacccaaggtcacacatttattaagaggcaaaggtcttatgtggatctctgccagtttgacttcaaagcccataatctaaactactatgctataaagtcttccataaaacatagtctaagggaacagtcatttaatagcgtgatgctggagtgagatcagggatacacacggttggaataggctacaaaggagcgattatgtataagaaccaatcctacctaaaaatgcaagccatgataacacaagcactacacaacaatgggaaatggggcaggcatttgaggggggaggaaattagctaacactttatatctaacactaaaatgacctccagacagattataaagttaaaacttacataaataagtaatacaattctagactagctagtaggaaataaattctttttagcctctggaaaagcattcataaattttccttaacttccttaacgttcctgaaacttcctaaggagttttataaatgttctagcaaaagaagaaatcacacggaaaaagacaaacctgtttggccatgtggtgagcagttttgtggggtggcgagggggtccccaggagcaccactactgcagacatgtgcaggagtgaccaaccgagcaggaggaagccacagcgaccagcagtgtccgtcatttttgaagaccgagaaatgacaacaatatcatgcacccattggtctcccacaggagtgctcctttggggccaggcacggtggctcacacctgtaatcccagcagtttaggaggccaaggtggatggatcac

SEQ ID NO: 179043 - DNA, 234 bp, Homo sapiens
aagaagatgagggaaacgctgtttgtcatttgatcatggttacataaagttcagaagagggctgagcgcagtggctcacacctataatcccagcactttgggaggccgaggtgggcagatcacttgaggtcaggggttgaagaccagcctggctaacatggcaaaaccctgatctttttaaaaagatgagtctgacttgggagagggggcagaattaagggtagtggccagctg

SEQ ID NO: 179044 - DNA, 134 bp, Homo sapiens
gatattccttttttatgacttttctttcaaccttctcttctatctacggtcattcagagaaggcacttctaggaaaatattgttacaaaggggaagggtgttttactataataaaaaagcataattaggccaag

SEQ ID NO: 179045 - DNA, 315 bp, Homo sapiens
tttgtcacattcttcacatttctaggatttctcacccatatgatttcttttatgtctagaaaagtttggggtgttgtcaaaagcactgtcacatcttttaggtttgtatggtttctctccagtatgaattttcttatgtcgagtaaggtttgaggaccggttaaaagctttgccacattcttcacatttgtagggcttctctccagtatgaattctcttatgtttagtaagagttgaggaccagttaaaggctttaccacattcattgcatttgtaaggtttctctccagtatgaactctcttatgttcagtaag

SEQ ID NO: 179046 - DNA, 389 bp, Homo sapiens
ggtgtggagggaaggaaggggagggctgaggaactgggttctcctgagagaaaggctgccagcctccctgggggcaacacctggcgaggtacaggagtcgcccagtccccaaccagggctaccccttctggttgcttatggttgaggactctgatgggagctgctccaactgtcctcctcttgctgggtgagagcagggctgagcaggacagctcaagggagtcggggatgagaggtgtcagccacataagtgcacatagcaagggtgaggcacagagcttctatacacccgtgatggcctgcagagagcttggacttccctccagagcaggaggagctggtttgtttgtttttgagacagggtctcactctgtcacccaggctggagt

SEQ ID NO: 179047 - DNA, 340 bp, Homo sapiens
agatgcccaggtgacttggaaggttctgaaacaggacaagagcaggaagcaaagtggtatttgaactggggagaggacagtctcctgttggccagaagtcactgctgaccccttgtcagtggtgctgctgatccatggtacctgaatgtatctgaggggctgtgaagagttgaatagacttagaggttacacctaaagacttaaaattatattgtgagagataacaattattagtaacagtaattagacgtttaaaaaatgtacgtgcatctctttattaagctgaacaatgtgattccctaaagaaataaatggaaccatgttctgtccagaaatctca

SEQ ID NO: 179048 - DNA, 850 bp, Homo sapiens
tggaagatggagattctcaccttccctgaaaggaggaaacgttcccatttccacacccctctctctgtgcataaaagggggcggagggcactagccaaactggccccctagacctaaagggacctgagacatagacgcagagagaaaagagaacatctttggcagaaaggctgccctgccacgttgaatccattaaaaattgcctagtgcaatttttgtactaaaaaaaaaaaaaaaaaaaaaaaaaaaaaaaaaaaaaaaaaaaaaggggggggcgcgccccaaagaatatatctcccccgcgagggggccacacaagtttccgcgcgccgtcccccgagttttttgtgtggaaaagagaggggcgcccctatatagagggagagaggcgtatatatatataaacagagaggagcgcggggggcgcggcgcgtttataaacagagagcgcgcggagagaggggggaaacaacgggcgcgaacacctggggagaaaacctctgtgggagaaggaggagaacacctctatatttgctggggggggggggggagaacacaaatgtggggggccaaacctcctctcctctccgcggagagtatatttaatagggccctctagagagagagaactatatatatccacaaatctttctaacgagcggggatatatatatggggggggtgataaaaaaacaaacaagcgcgcgcaatatattgcacgcggggagagggagtgagaaaaaacattatggcgcgcatagcgcggagagaaatatctgaacattttatcagaaaaacacatttttattataccggggggagggataatgttatgcttaaatatacatcg

SEQ ID NO: 179049 - DNA, 330 bp, Homo sapiens
agggacggtagatttaatggtgtgatgagaacgtctgaaagctagatcgagctggtggctggctgcacaacatcgtgaatacacgaaacaccactgagtggtacactttaacaccattacctataatgtcaattcctccctccctgtttttctgacaccagatttctgtgcaagggtagaaatctgttcattcactgaaatgagaaacataggaggaggtttgtcaagagaggggaggaaatggtgatgggcttggtattaaatgccttttgttagggacaaaaaatacattgctttaaaagaatctaccgtgcacggtggctcccgcct

SEQ ID NO: 179050 - DNA, 383 bp, Homo sapiens
tgacactagagcggacagtaataggagtacctgagatgtagcagtaatatcatgttgccaaatttctttagatcttatttccttaagaaattgaatggtcatcctaggcccagcttcctctgtgctcctccggccactacgtgtccggccacgtggccggacacgtatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacttccggcca

SEQ ID NO: 179051 - DNA, 968 bp, Homo sapiens
ctgtgtgctgtgatgctaccaagctagaagaccagccttaccagatcagatggcctgggtttgagttccagttctgcccctccctggctgtgtggccttggggagttggttaacctctcagcagctctgtttctcctctgtaagggagcccaccacccaaaacagatgtgagggatgaattaccccggcacgtcacgtttaatatatgcttgcaattgccctcgttatgaccgccgcacctgctctgcccatcacctcttttaatcctcgccataagccagcaagttcagtaggttctcattttcgcaaagaaacaaaggctcagcgctggcaagggaaagagctgagtccaggtctggcttcaaattcatgctttttgaccctcacagctgcctctggtccaggcagctgttctaagtccgacaccccccattcattcctatctcagagtcaagcgtggtgccataacaattcatggccagtggggaggcttaaaacaaaaggaatttaatctcttggagttcgggaagccagaagtcggaaaccaaggtgttggcagggtcacgcgctctccagaggctctagggatggatcttttcttggcccttgcagcccccgctggctccttggtttgtagtattaggttggtgcaaaagtaattacggtttttgccactggatgtaatagcatcacttcaacctctgcctctgttttcacaggttcttcctccgggtggctctgtgtgtcttcttttctgtctcattagatttagggcccaccctaatccaatgtgagctcatctggatcctgatctgaattacccctgcaaagaccttatttccaaataaggtcacattctgatgttttaagatgcacatgaacttcaggaggccacaaacccacaagaatgaatggccacagccttgcaagcttcctgacaacaatgtcactctctccaggggcttgag

SEQ ID NO: 179052 - DNA, 180 bp, Homo sapiens
gtggcatacatacctgtgtccacatggggcaaagtctgacagtgcagaagaacagaatcgctggaatcactttaaatttttgctcggtttcttcttgtcttcctagtcatcatcgcagttactgctgatggagactgtactacatcccaggccctctaatgcagcggtccccatactaca

SEQ ID NO: 179053 - DNA, 1018 bp, Homo sapiens
ggccgactctagagtatccactcgccttttgataggcaagggagaatatgaagaattgactaagagataaatcaaaagtatccaggaatggaaaaaaagggttatgaaaggatgagtagtgaactctagcactgtcagagttcaatcagagaaacagaatcccttggagatggaaccacagttccagctgagtgaaactgacatacgacaaatccatcacaaccctgcatcacttttaatggaataactgaggctaagcaagtgtggagttagaattctcaaactaacaacgacaacaacaacaaaaaaaacctgaaggtgggaaaaacaaaaacgggaaatataaatactaatttcctcaacttcatagtggagaggacatctgcctgaacctgataaatcaagaaatagaggcttgagtatatcacttaagattataaatgtaaatactacaagatctaaaaacacacataaacttttcaagttatcacagtgaaagcatgaaacacagaccaaagaaaacagaccctatatcaaaagataaaccatggtaatgaatttaagaccaaaacacatttattttgtcaataaacataaatgaaataagctcacctactgaaagaaagatgcccttagtttgtatttaaaacatgtcccaaatatgtgatgtacaaaataaatctgtgtaaataattaatctaaaaattatgatgatgaaatcattttactgagataatgtttaaagttttgctaaaagaaaaatgcactgccttaggcagtcatgcaaatacaaatggaaatagattagttgagtattaaacttaagtgagaaaagaactgtaaaataattaagaaatgatgacgtaattagtaaggatataggcagaaaataataaattagaaaaaacaaaactagatctgctaaatccaagagctcttaaaaaaaaatcaaaggtcgaacaatgagaaaaagcatctaaagacaattagcaatcagattggggaatgacaattgata

SEQ ID NO: 179054 - DNA, 130 bp, Homo sapiens
tgccaaattgcttatcttggcactaggcagccctgtattctatatgtagacagtgaagactgagatcatggatgccacacattccagtttagtggtcattaagcacctgtcatattttggacatggggtt

SEQ ID NO: 179055 - DNA, 707 bp, Homo sapiens
gtctcctcaaagtggctcctgtatttttttcacaatattgagaatgctcaagcggcaaggcttactcatatttcaatgtaacagctagaacatattctgagtgagatataaaagatgtactggtactctgtcatttctatatcatctagaatatactcctttccacaagtttggataaacaagcaatgtatgttgattgataactccttacaagcatctttcattctgtaaccacatggtgggcaccaggcatagtgttgtgcactcaataaacacccgttaagtggaaaggaattgagactgcaacagtgggatgtttttcattttaatagaaaatttccattcctaccactatcctgagagatctttccataccaactgagttaagtgtagcactggtgttaacaattccacatccatatgaaatcatgtgtatatttcacattccttctatcctcttgtctttagcctgacttatttattagctcataaaagcctggcattatttttacctatcttgctttgtatatcacaaggtctcttcaggtagaccttgattttccttttgtagactggttttctttaaaaatgagggaaggcaaatatgtatatagaggaagacatgttcttaaaatgttgccaagataaatccagttcatgtttacagtaaccttccaaagacagcatgtaacatatgaacaaccaag

SEQ ID NO: 179056 - DNA, 436 bp, Homo sapiens
tcagacggagtctcactatgtcaccgaggcttgtgtgcagtgttgcagtctcggctcttgtaacctctgcctcccaggttcaagcaattctcctgcctcagtgtcctgagtagctgagaattcaggagcatcaccacacccagctaatttttgtatttttagtagagacggaatttcaccatgttagccaggcttgtctcgaactcctgacctcagatgatccatcggcctcggtctcccagagtgctgggattacaggcgtgagccaccgcacctagcccgatctccctgtatttctctccatgtcctggtctctgggcctctcacttttccctcaccgacactcaaacgactgttcacctggactagactctgagctcagcatgtgacatgcacggccttgctgtgggggaggccctgatacgatgcccacttc

SEQ ID NO: 179057 - DNA, 400 bp, Homo sapiens
ttggctttagcccccaccctaatccaatatgatatcatcttaagtaatgacatctaaaaagacccaatgtccaccaggcacagtggctcgtgcctgtaaccccaacactttgggaagccgagacaggaggatcactgaaggtcaggagttcgagaccagcctggccaacatggtgacaccctgtctctactaaaagtacaaaaaatagccaagcctggtggcgggtgcctgtaatctcagctactcggacggctgaggcaggagaatagcttgaacccaggaggcagaggttgcagtaagccgagatcacgccactgcactccttcctgagtgacagagcgagactccatctcaaaacaaaaacaaaaacaaaaaccctatgtccaaataatgccatgtt

SEQ ID NO: 179058 - DNA, 218 bp, Homo sapiens
ggaaggggctgcctggggaggctgagagagctggggtaggccctgggtgggggtaggggaggggagtgagaggccatgagaggcagtgaggctgcctcacttccttctttggagatgtctgcctggatttggggttctgtatcttgtctctagctgggttgttatgacaagtgggttggggtgggaggagaggtgctgaaacatcaaagggaggtccc

SEQ ID NO: 179059 - DNA, 447 bp, Homo sapiens
agttagctcatttcagtttggaaacaactcacagacagttatataggtgcttcttcactctggcatccaatcttggaaggattttgccttgaaaaaaaggcctgctatctctctggcacttaacgaatctgaagtttataaaacaaccatctacccttttgagagtcattaaaataaggtgggaaaatctttggtggcctgtttatacacattttaaaaacaaagagatctgtctagaatatattctcaacacaaagcctttcttcctaatatgtgcttttaactctgatctcactgaaactacatgatttctacagtcttgcatatctggtaagaataaagttcacacagaataatattcttatactcattatttttactgcagtatgcagctcttactatgaattggtggttattacttgaaaaaggaaaacaaaacatcactgg

SEQ ID NO: 179060 - DNA, 555 bp, Homo sapiens
gctttggggtctccatccgctgggcctgggcttcctgctgtccaacgagggaccctaccatatcagaggcacacaccggatgttcgaggcgtaacagcccctgggtggccagaccatcctatttttcaagaaaggccagaaatgcaggctttggagtgaaacttcttttttattttattttatttttttgagacggagtcttgctctgtcgccaggctggagtgcagtggcgcgatctcggctcactgcaacctccacctttgggattcaagcgattcttctgtttcagcctcccaagtagctgggattacaggcgtgcaccaccacacccggctaatttttgtattttcaggagttcgagaccagctggcaacatggtgaaaccccgtctctaccaaaaatacatagttagctgggtgtggtggcgggcgcctgtaatcccagctactcgggtggctgaggcaggagacttgcttgaacccgtgaggcggaggttgcagtgagcagagatggagccactgctctccagcctgggtaacagggagactctgtctc

SEQ ID NO: 179061 - DNA, 277 bp, Homo sapiens
atcagttaaaggaaaacagaggacaacctacagaagtgccaagacccaggattaggatgggtgtgcaagatttgagagggaaaaatctaggatagggctgaaatgtttccttgttttccttttataaaactggaaatggaggcccaagttcggcttgttcatttccctttataacgataacctgctattatgttaaactccaggctgggcacggtggctcatgcctgtaatcccaggattttgggaggccaaggcaggagaactgtttgagcccagg

SEQ ID NO: 179062 - DNA, 554 bp, Homo sapiens
ggctcggtaccgatacgctcctagacggcagagtattgagaaaatcttcataccatttgcttgatagatagaatatatatggatatatataactatgtatataaaaacatacctatagatatattgaatctgtatgttttaattctgtgtagacacagtccattaaggagttctgtgtgtaattagtattttataatgttgatgtactgtattcactacccaatagactcaactggtattgtggttatccttcttaaagcattgtatctgcttctaaatatttcttccagcctcctcctctcttttgattttaactaaaagaggaaagcaagaggctagtatgggacatttccttccctgtagacacgtgtgcttggcattcctcctccccctttaccatcatgttacttgttgcgggaagtccgggaccccgaacggagggaccagctgaagccatggcagaagaatgtggattgtgaagattttatggacatttattagttccccaaattaatacttttataatttcttatgcctgtctttactgcagtctc

SEQ ID NO: 179063 - DNA, 240 bp, Homo sapiens
ggctgcgggtttaggggaggaaggccacagaggcccttctcacctcatcctgtcagtcagccggtgtgtgatgtcccgtcagcaggtgtgtgatgtcccgtcagcaggtgtgtgatgtcatgtgacttctcgctggtgtgtgatgtcatgtgacttctcgctgacgatattcagcccgatcatctgtctctgtgtggttttagttgcatctccctgcttttgaggaggactggagcatca

SEQ ID NO: 179064 - DNA, 414 bp, Homo sapiens
ctgaaacaagagtggtcagcataaggtgtcacccacgcagcctcaccttgaatttcaaccacactaaaaacgttcccttccctgtaaaattctccatccacgtagactcatatttgcacagacgttcactttaccttggcatgcccaaccagatggcatttaaggtatccaggctaaggagcagctaactcagaagctgcactgacctctccagagctctgtcagcgtcaggggcagttagcaagcgcctcccttactccctccacattctcttccaagcctgtcactctgccaccaaatgcactgctaggctgcagggcagagactttttatcctcaggagaacgaggacttcaatgcctaaaacaaagtccttgtccaaaaaacatgttttgaagcatacaatacaatctta

SEQ ID NO: 179065 - DNA, 449 bp, Homo sapiens
tagcagggctgcagctgatgtacactttgcatatccaagtgcatagtagggtatgggtggtgtctgttaaagaaggagcttagttgatggattggttttgactgatgagaatgttggtgcatgtcctatatttcattttcccactagtggatgcttctgttatttccagtcctttgctgttataaacatcctggacatgtctgcaagtgcccttgggcaagacattctctagagtatctctctaaaagtggaacactgagcagtaagacattcacattttcagcatgcctggaagctgtcaagttgctatccaatctgtgactctccctctagccttgtatgagagccctgatgtctccaaaccttcatattatcagacttttcaattttgccaatcccagagtgtgaaatggcatcttgctttaatccctctcccacgatgaccccta

SEQ ID NO: 179066 - DNA, 273 bp, Homo sapiens
atgggacagacaggtcatagggtgtcccggagagaacacaagcttgaggcctcgaccccctccctgaatgtgaactcagcaatgttacctctctcagcctttgtttcctcttctgcgaatgggaaaatgaacagctcctaccatagtaagctatgaatgctgaagcaggtaatatacaaagcatttctaaatatggactcaaaaattctttgctttgggggctgaggaagcagaacacacaaagaccccctcgtgggggaaaataggagcatt

SEQ ID NO: 179067 - DNA, 342 bp, Homo sapiens
tctggctttagaattagtaaccaaaaaattgcttaatgaacacagaatcagagaataatgatgccttaagggttgtttgttcataattatagtagaaattctcaacctcccacctccctttttacagagtccttacaaccagagatactgtacacttcagctagattctatgtctttattcctggagtgtgttgaactgacatctcttctcattccagcaatcttctatgctttcgctctgatgctcagtcttatgtttaatttttcttttgatatgttgctgtgcacggattttgctctgggccacttactagtatgcactgatgttataattcagagttg

SEQ ID NO: 179068 - DNA, 280 bp, Homo sapiens
cttatttttcttcccaaagctttttatttttagctgaattgcaatgagattgctttctattttccaaagcatcaaagttggacattttcagtgggaaaattacactaaaaccaggaggatataaacttaatgaaatctttagattttaggaaacacatacttttccttttacttgttctctcaaacttcaattcaatttaaaagaaaatgttccatcatctctgaggcttcatttaattttccttactgcactttacagtgttagattactacttctagc

SEQ ID NO: 179069 - DNA, 326 bp, Homo sapiens
ctggcacagcagctcaggagctcccatcctgcaagttacataacctcccaagccatgattttctcatctgtaaaatggaataacaacagtacctcccccaaggttgtggggaatacacagaaacagccgtgctgtgcccagcacttgggaaaatagcagtggctgatcctaggatagtaatattccttccccttctacatgcactcaccaagccagaaccggacacctactccatgccagccactgtgctgggttctcagggtctaaggagctgaaagtagtacccccttctgcctctataacccctcaagagcatgggacggcgt

SEQ ID NO: 179070 - DNA, 548 bp, Homo sapiens
gcccaccccaattttccattagtataaacaatcctgcaaataaatacttttttcttcttttggataatttccttagggtaaattgtccaaaatactaaatcacaggggtcaatagatacaaggattggtatattccgtcaaattcttttcaaacagatttaatgctaccagcataatacagtaatgcacaaatttcatggtattaggcaatgccattttaagatttccaattgaaaagatggaaaatgatacctcattttcaaattttgcatttctcaattggtatgttaaagtttttcccattttactaattttatttccactcatacgtattgtctatttttttgcacatttatctatccaaacctagatgcttccatcacattctatgcagtgcatggatactaacaatattaatcccgtgtgtaataaacttgcaggtatttttctgagtgttttatattttacagcattctatacagtttagcttttatttattcaaagttgtaaatctgtccttttgtaacttcaattaattcaaagcttac

SEQ ID NO: 179071 - DNA, 780 bp, Homo sapiens
  misc_feature (715)..(715): n is a, c, g, or t
cgtgaccacgcctggccgcagtcattattttaagtcacaacaaagttacgtgaaatttcactatcatgtccttcattatcatgttttccacttccagaattcatgagagatcaattgtagagatacttaaaaaccactatctatagagtaataggcccttatatataaagtagcatctatagagcaactagagtcatgttatctgtaaggatgcttagaaggcattgatcctgtgtgctggaaaattgttggacatcatcaggaaaagtaggagggacaaagtaggaaatgtattctaattattatagtgattaatagtgattgatatttgagtgtgtgcaacatgccagacattgtgctatgtactttatgtgcattgtctgtctaacccttacaactgttacaactgcccattttgtttgttaactgagatttagaaacattaaatagcttgtccaagatcacatagccagtaagtgttagagatgggattgaaatccagatctgtttgattgcggagcctgaactttagatctgaatcgtaatgggatttaccaaattatacccattaaacccactgctgtaaatcaccaatcatagttacctaacctcaagtaagaagaatagactagaattgatttatgcacggtaaaaatgatacatgctgaaaaaagatcaaactttttttttcaggatttgtcttcttcactccagnctgagtgacagagcaagaccccctcaactagatagagaaaccgtcgaattcgagtaatcctcgga

SEQ ID NO: 179072 - DNA, 302 bp, Homo sapiens
cgagttagacaggactggagagatccaggtgggtactctgagcatgaagatgactaatttcatgaatgtggataagctctctaggtggagagacagcaatgggcctggaggaaaaataaactccggagaaggagagaaaggaggagtcaatgaaaaaagggctcattcatcagaaaattaagatggggttaacaaatgggtagagtgggtaagcaggacaaacaaggccctggtcttggagctctaagtggggaagagagacattgaccatatagttagggttgtgctgggtgctacaggag

SEQ ID NO: 179073 - DNA, 240 bp, Homo sapiens
agaatcctcctttctcccagttgtttctaccatcatgtagtatactcacatatactaaagatttcagctgtgtcttctgacaaatagcttcatgcagatatctccttttctgtaatctcacctgccttcttattctatattttgccagcaccctggacgagtattctgtgaaattcttcttccctcagcttcagggttagaaactgtgattctctttcctcctggaaaatcctttccctc

SEQ ID NO: 179074 - DNA, 462 bp, Homo sapiens
ctaatgtaggaaagaataaatgtttatctcctagtaagccggtaagaagaatttcaaatttaaaacattaatttgatctagcctgggcaaaagagcaagaccctgtctctaaaaataaaataaaaagtaaaacattaatttggcaggaaattggtctcctgtgccttactgggatggggctgataacctttgtgatctcatttccctccttaattaaattaatacatttggaatttaggatatataggttgaaccatagccaattttttgactgtttttgacactcaaaacagcagtttcatagggttcaatccaacagggtcaggcaagcttccagagagctgaggggcatggaggcctctctacatcctaagtaaggctaagtggaattaaacccaaagttcagatgtcagctcagagctgaaaggagctttggtgccttgcctgtgcggctcattagta

SEQ ID NO: 179075 - DNA, 552 bp, Homo sapiens
aaagtatgatttcaataatcgcacggtgtattaccatacaaagagattctcttccctgcttccctacaatgctcaaacggggagaaaatgagaaaaaatcttgtagggaatacactcgatagacacagtgagttccattttatttagagtccaattgatgaattctggtagctcaattaagatagaatcaggcctcagtggaagtaaagtctaatcacagttcgatatgtacttttctatgggagcttctcaggagagatggtttgaccacacaagtccttgtacactagtgagtggtgcaggtattggcaggtgagactttggagaacagcttgaaggctgacaaagagtagtcctgctgcatcctgaggtctcagtgtgtcttgtcaaagtcctggggttaggtcaggcatgggtggttcacacctgtaatcccagcactttcggaggccaaggcaggaagattacttgttggcaggagttcgagatcaacctgagcaacttagtgagaccccatctctgtaaaaaatataaagattagctgggtgtggt

SEQ ID NO: 179076 - DNA, 459 bp, Homo sapiens
ttccggaggtgggggcggggaacggtctcgtagcggggagtggtgctagttcctcttccctgcgaccgctcgggccgcctgcgcgttcgcgtccccagacgctgcaccccagtttgctgcaacgtctgcttggagtcgcggtagcgggtgctgcgcggagtctaggacgacgcgagacgccatttgcatcccccctccctcctgcaggttggcgagggcggcggtgtcgcccgccgcggaagcgtattcctggcagtgacactgattagatgctgtgtcgatacgtgcacagaatcggggtgggccttcacctctcgtgtgcgcacacactttctgttggaaaagttgcgatattttttctccccctctcgccgcacagctgctgtctcccgggcggaattaggcgaccacgtttgctcaacccgaaggagagaggatcgcgcgggcgctgggcggccg

SEQ ID NO: 179077 - DNA, 391 bp, Homo sapiens
gcatggtcctggataccctacctgctgtgccatttaattttcacaacaaccgtaaaaggagtaaaatgaagaaatggaggcttaaaggggttcaagagaaatgggaagcaaacatcactatagctgaattggcctcacctggatcaaaatgaaatgtatttctctaaatgagacaggctcccccgtaaaaaaaggaaaggaaggaggttcacagtagccaagaggtgtaacagctaaatgtccgagggcagatgaatgaaagaaaatgtggtaaaccgtggactactatttacccttacaagagaaggaaattctgcagggtgacaacatggatgaaccttgaagacatcatctgagtgaaatgggccggtcacaaaaggacaaatactgc

SEQ ID NO: 179078 - DNA, 240 bp, Homo sapiens
gccaagaggttagatcccaggactaatatttggctctccctttcaaagattagatcccaggactaatatctgacaatccctttcaaagattttgtggttataggtttgttgaaagcataagtaaaacctgaatgtctgttggtagcagaacatggataaaattttggtatcttcatataatggatgttgtaaagcagataaagtgaataaaatagaactatatcaaacaaaattgatata

SEQ ID NO: 179079 - DNA, 138 bp, Homo sapiens
cctcggtccgtggcggacgtaataggagtacctgagatgtagcagaatggtaggattggggtttgaacccaggcagttttgactctatcatgtagcttcttaatgattatattatactgtcccccaagttgtatacta

SEQ ID NO: 179080 - DNA, 363 bp, Homo sapiens
attgggagggaggagatagactttaaaatagtttaacttcagcataatgattaattctaaattttattaaatcctaataacttgcagatatgttacctaatgtgtatgtttatgtatatattaaatgtctctgacatacataggatgcatacatatctctgacatacatacatattttaactccattttattgatggagaaagtgaaagactaatggagttgtaaaaattagtttgaaataagaggaataggatctgggtttctccctcctattcaagtgtgtctcttctggttattaacttttggagatatagatttttaaatgaattacattaatacatttttaaaaccaaaatttgtctg

SEQ ID NO: 179081 - DNA, 312 bp, Homo sapiens
ccttaataaaaatggttattgattcttaaatgactccttagtatggactttcattttgcttctgtccctgcaaacgtgacatgttgaagttccaacttccaatatgatggtattgagagatggggcctttgggtggtaattagggttagattaggtcatgagggtggggctgccataatgggattagtctttgtaagaagagacatgagagagtttattctctctctctctcctccacgtgagagagtgagaaaatgagagagaccgagaaaggggctggctagctataagctgggaggaaagccaccaccc

SEQ ID NO: 179082 - DNA, 184 bp, Homo sapiens
tgcctttgctggctagtgtttctgacacattagtcctgactaatgacaacaggaagataattaactctgattttgatatattacatttgaaaagacttctctagatggcaaggagctcaagagaaaaatcatggctagaaatatagatgtaaaagccacctttagataagtggttgttaaagct

SEQ ID NO: 179083 - DNA, 599 bp, Homo sapiens
ttaaggtcggttgttgatgagatattggaggtaggatcaatagagggggaactagaatgatcagtactgcggcgggtagcctaggattgtgggggcaatgaatgaagcgaacagatttacgtacattttggttctcagggtttgttataattttttgttttttttttcttccccagcttaattgttgctttagtttgggatggagttttggagttaccttttccattttcagcctaccccccacatcagtttttgagtaattactctgtggaacaacagatgtgcctggcccatcttgtccttttcctgcagtacctctaccattagccatttctccaaaggacattgttctttctagtggaggatggaatttaaaaaccaagatctgggtgcttattgctaaaggttgtcactgcctcaatccctctcaattgacagttaggaaatacatgtgtgtatgtatacatacacacacacacacagaaatacacatgtgtacacctatttttgtattggtctgtctatacatattttttaaacaatgagtttacgtagacatttcccagtttcaatcttaaccccatagcctttctgttttc

SEQ ID NO: 179084 - DNA, 493 bp, Homo sapiens
cttctacggatactcaaaaacaccccctctccaagtacatcaaattgagaattaggtttcaatgtataaagttgaggtgggggacaaacattcagatctataagcgtcaggattgtctgtgattttaaatcattgatgacctcactaaaaagtaaaggtctgaagaaggtgaaaacacaaatggtgaggataccatggagagtggtattccagggtagagagagctacaggggaaatgtccttaaggtagaaacatacctgatgtggtaggagagaaacaaagaagtactgtggcaagaggagcgtcaccaaataacacagtcatagaagagtaagtcaaagaggtaatggggtggcaatcatctggggacctccaaaccattttaccattgagttttaccctgggatagatggaaagctactggaaactttgaagtaaggagtaatgtaatctgaactcatttttaaagggatcattactccatctgttgtg

SEQ ID NO: 179085 - DNA, 818 bp, Homo sapiens
tctcagggacacacttgccactgctacccacagtgggtagcaacaaggactaaatgaactctttaggaatactaggtataggaagactaggtataggaagattctcatttccccttgttgcactgaccactatgtctcccatgcatactctgggaaattttaggagccctggtggagatacacgttgctgatgtgcatttgattaataggttttactatgtcttgcaataaagacgtttagccttaagacccttgaatggaactccagctgtgatagagctgccaatgccccttcctctctcctcccttatcacctagtgttgcttaaagaggaggccattgagggcacacttgatgccccagacagcctccctctgttgctaaatcattgttattgctctatatactgccttctcactcgcttcaattaaaaattaccttcaccagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgt

SEQ ID NO: 179086 - DNA, 575 bp, Homo sapiens
tgtgaggtcgtctagaggatcccaactcagggcgagctgccaatgccccttcctctctcctcccttatcacctagtgttgcttaaagaggaggccattgagggcacacttgatgccccagacagcctccctctgttgctaaatcattgttattgctctatatactgccttctcactcgcttcaattaaaaattaccttcaccagctcctgtgccctccacctgggggagacttcatgatcctctcagcactgactgcaaacatcagagaaaaaaacattttctcaccaaaggtgttcatgttgagaagttttaatttctaccccctacagctcaaaagaatcaatgtgaatttatctgcagcttaaattcaagtgaaacttcattctcatgcaagcatatcagacttattctggaacctctagaactggacttgaattccctgcaggtgccagactggtgggtgccctccctgcctgccattaaacttttcttacagccactgtccctttatctgtgacttctgagtcatccgacggatccattagttgttcaatgagaagttcacagatcttgt

SEQ ID NO: 179087 - DNA, 475 bp, Homo sapiens
gactagttctagatcgcgagcggccgccctttttttttgcctcagcacacattttagttttctcattctctcgctgttagatagaatattcttatgtatttttttgctgttccaaagttagtttcatctgtttgacctttttgtaaactgattcttacatgcatcttacttgactgctaaattaattttttaatttgcccacaccgtgacaaaaaggcagtcttccttatgagcttcaagcgtgaagtcccggagaaagacactgattggcccagcttgggtcatgtggccatcctgaagaaaagaaatgggctattatgatcatatgcccatccccgagggtgaatggacagtgggtactgtggtgacagctctatcacaacaatgtgagatgtgaaatacaggtttccaaaggaaggaagaatgttgggtaggtaaaaaacatgctggataatgcctataatcccagcattca

SEQ ID NO: 179088 - DNA, 983 bp, Homo sapiens
ttcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaagcccaggccctctagtgtcttacggaacatcctgtggaggtgagagctgacttgtaggtggaagcagctctttggaggtttgatttggaaggtgaactgagaagaaggtggtgatgcaagccggccgtgctgaagccaggatgaattggtgtgactgggcttcagttaggctggcatagcagttgagagagcttagcagtgggcagcagggcactgttgggggcggtggtgagcggtggattctggctgtttggaggcagacagggtggaattcgatcattgattggacgtgggacagagaagggagaagagaagactcatctaggatgagtcccaggtttctggctcagtcaactggggaaacaaagtcacagagctagggagtagttagagaacacatctgggggtgtgactcatggtcagttttgggctcgtcagttttgagatgcccaaatatcatgcagatctgtcccacctgaaaatggagaagacacgggaaaggagaggagtaaaaactaactccttttcacaaagtggaagttaccagaatgtgatttcagaggccccgggggatttatcatgtgactactgacccatcccacctcttgcccctgcctgttgcacagt

SEQ ID NO: 179089 - DNA, 212 bp, Homo sapiens
tagaaaatgcctcagtcagccactgatgaaaatcaatggagactcacccaacagcagcattgcagcttctcccaggtcacctcgcggtgggtttctaaggcatgagaggaggtagtctcctcttgtttgaggaggcagtcagcttcctgaggccagggcactcccttacaagaggggttatcatttgcctccaccgtgcctgttccattagt

SEQ ID NO: 179090 - DNA, 327 bp, Homo sapiens
ccacgatttgctggtccgtgaaatgagagggaggctggatcactagctctttaacggtcttccagctctagattcttatgagtctatgacttttacaaagtggcagatgatttctgttaggtgccagttaaattactttaacacggcagttagtgatgtaggaactggtgtagagtgagcacagcttttgtttttttcaatttggattcattcatgatggagtctgaagatgtttctcaggtttaaaagatagttttccttcagtggtagtatcagttactaggctgtgaccttttggaatgaatgtagcctctaacatcttcctat

SEQ ID NO: 179091 - DNA, 440 bp, Homo sapiens
tttcttttccttatcttcactacggcgctcattctatgtctgactcttgagtgtaattagtgtaagtcctttttatacactcacgttctttcatcttccaacaactcttgtggttcctgatgaggaggcaccacgatgatgattccttgtctgttccagaagggctcccggcccttcacttggggagtttgctggaggagagctgggttgccttgctctgtcagccccaagttgtaaagtgtcacagaattggcagggagggttcgtgggtcactgattagtgtttatacttctccagcaaggatggaggctgggggagggctgggcagcctcaggagtgccaccccctctatgagcaaacagctcagtgccagccggtcaataggatgtgggtcaaagctcatgctgcccctgatgtccaagtgtggagctctgtcctt

SEQ ID NO: 179092 - DNA, 1668 bp, Homo sapiens
ggtccgggcgcccgcgcagaatcagctgtctgagctgcccaggcggcgggggagcagcgagcgggcttcagcgagccgcaggaggcacaggcctgtcctgggtccccgcaggtcagtgtgaaggcgtgcgctgccggcggaccctgggacaggggtggagggggctggcagtaggattggggagggggcggagaagggatccggtagattggggaggagggggatgcggagtcgcgggggcgggggcagtggagggagaacccccgaagcaagcctggctcgccttctcgacgcccccttgcactgagtcctccatccattttagtgctggaaatggggggtgggggtagcgaccccgcagtgcgacagtgaaacgtagacatattctggaaataaccccttctcacaatctacacccatggaaacacttgatctccgcaaaaatgaggtggcgctggggcaggttgcctccggggaagggggacacagagacaaacgcagtttggaaagcatcctggtttggtgcccgaggcctggaaagaaatggcggctggggtgcgggggaggtaggggaggaaaacggtgggtaagcagggcctggactcaggaaagggaaccgagtccctgtgagcccgctaagcgcgcagcccctgcccctgtctcctgtctgtccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatcaaaaacaaaa

SEQ ID NO: 179093 - DNA, 1102 bp, Homo sapiens
ggtccgggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatcaaaaacaaaa

SEQ ID NO: 179094 - DNA, 247 bp, Homo sapiens
tgctgggattacagatgtgagccatctcgccgggccagaggtatgtttttatttttagtttaccagtttaggggtaagcttttataagttacgtgaggagacaaaccagataaatgcttgattggttgcagagatgcagttgccttatttggacttgtcactccgaaataatagaaaggtcaagatttcagttggaagagtttattcaagcggaaggatagcagtggcccatttgggaaaaacacag

SEQ ID NO: 179095 - DNA, 736 bp, Homo sapiens
atggtgtacatgagaagttttgatacaggcatgcaatgtgtaataatcacatcattgatcaccaaggaaatgcaaatcaaaaccacaaagtacttttttaaagtttatggagtcaaatctatttttccttgtcatctgttttcttccagtacttttatgcttagaaagtccttctgcatatagaggacaaataaacatttattctttatagttattttatggattcactttgtttttacatttagttctttaattcatctggaatttactatgacaagtagtatgaagacaaaaaaatcgatccttattttgcaccaaatagccaattgtcacgtaattgtttatggaataatacttccttttacctctgattttgtaatgctgagtttattagacaacaaaatcttatatattctaagatctgtttctgggctctttccattccattgaactatgccataccattttaaatattgtagttttacatttttccttggctattttgacctgtttattcttcttgaacttagtaggcccaccgattaagattttatttggaaaagcagtgtctctgcttttaatgagctgagtgaggcaaatcacttaacctctccatgcctttgtttcttcatctgtaaagtggggaaaagagtatctccttttgcccaagttccagggaaattgtgaggatcaaatgagatggttatgaaaacattttgaaaaagtaaaaaaaaaa

SEQ ID NO: 179096 - DNA, 543 bp, Homo sapiens
atggtgtacatgagaagttttgatacaggcatgcaatgtgtaataatcacatcattgatcaccaaggaaatgcaaatcaaaaccacaaagtacttttttaaagtttatggagtcaaatctatttttccttgtcatctgttttcttccagtacttttatgcttagaaagtccttctgcatatagaggacaaataaacatttattctttatagttattttatggattcactttgtttttacatttagttctttaattcatctggaatttactatgacaagtagtatgaagacaaaaaaatcgatccttattttgacctgtttattcttcttgaacttagtaggcccaccgattaagattttatttggaaaagcagtgtctctgcttttaatgagctgagtgaggcaaatcacttaacctctccatgcctttgtttcttcatctgtaaagtggggaaaagagtatctccttttgcccaagttccagggaaattgtgaggatcaaatgagatggttatgaaaacattttgaaaaagtaaaaaaaaaa

SEQ ID NO: 179097 - DNA, 376 bp, Homo sapiens
ctcacaaagtgctaaaaccattaggtgaacagatttttggtaacaggatatttgcatgggtttttaattgaaagcgagaagcgtatctttacaatggcaagttctggcagtctccatcttaacccagtgatcaaagttagcgtcgctaatggtagcacaatctgacgtatgtgccttccaatgtgataaaatttgaaatccacatcgtctagaagtatttttgcccaaaatgtttaacctaaattgaatcaggctcctagaccagcacatgtcaatacaaatatatgtaagccacttatgtaattcaaaattttctggtaactgcatttggaaagtaaaaacaaaagagaaaagcccggggtgaaattagtttaaa

SEQ ID NO: 179098 - DNA, 976 bp, Homo sapiens
ggccctgtgtcgaagaaggaacgtactttggcgttcttatgagctgcctagtacaaattattggcagaaacaatgaattaaacattcaaaaagtaacccaccggccggccgcagcggcttatggctgtaatcccggcactttgggaggccgaggcgggcgcatcacctgaggacaggagttcgagaccagcctggccaacatggcgaaacctcgtccctactaaaaaatacaaaaattagccaggcgtggtggcgggcgcctgtaaccccagctacttaggaggctgaagcaggagaatcgcttgaaccccggaggtggaggctacagtccggcactgttggcaccaggtcaccaggacccgcttcagcacaaggaatgtcatcaaggtgccactgcagaagcgggcagtgccctccatgaggtgcgaaactgtcttcaagctgactcctgaattcttcagtcctggaaagtccaggggcctagattctcaacaatgcgcacaaaggcagagatggggataccggaggagcctccaggaatcatgggcccagaacctgctctctccacagcacccatgtccaggcccaccttcgggtgtccacacccactctgagcccatcttttgtaccacctccatttcaaacacctgtttactgcctcagaacagttcctggaaagcatggcaggtgccttggtgtctccatgatggtcagactcgccctgccttggacatgtgtcaagagatggagcagctgctgcttcactcacaggaaaggttggtgtcactggagcctgtcatcagtgtgaggtctcgccccacctccatgaccttaaccacctctcttccaaacttactttcagctgagaggctgcagttctgcccccagagagctcctgcctgatccttcccaccaaacactgagaatgtgcacttggaagtcttggcactgtcgaccagaggcctgggaaccaggg

SEQ ID NO: 179099 - DNA, 855 bp, Homo sapiens
aatcaggatactgcaagcaacgagaaaggcatgttgagtggttaaacaagaatacatgtattcaatacagtgttcattaaatgtttgataatagaaggacaggcagatccaagtatttcataggaagaaagaaatcaagcagaccgcaggttatatcaccccatcacacattcagggaacttaatcttttcattccagaggatgggtttgtttaaaacaagttcttcctcctaattacttttgaacaattccccaatactgtccttacctgcaccaagagcatgctaaccaggcctggcaccagggtcagagttgaggctggggcatcagccccctttgtgaggtggcctcagtgacaggggtgctatgaggtggcggctatcctacttaggaggctgaagcaggagaatcgcttgaaccccggaggtggaggctacagtaagttgagatcatgccactgcactctagcactccagctgaggcgacagagcgagactctcaaaaaaaaaaaaaaaagggccggccgggttccgggggcaccccgccgtgtaactcgcagcactttgggaaggctgaggcaggcggactcactaggccaggaaatcgaaaccatccgggctaacacggtaaaccgtctctactaaaattcccaaaatttagccgggcatgttggcgggcgcctgtagtccccagttactcggaaggccaaggcaggaaaatggcccgtaaaccccggaaggcggaccttgcagtagacccggagatcgcaccactggcacactggcatcccagtcggggcaacagaagtgagaccaccgttcaaaaacaacaaacaacaaacccggaggacacaac

SEQ ID NO: 179100 - DNA, 1266 bp, Homo sapiens
aatcaggatactgcaagcaacgagaaaggcatgttgagtggttaaacaagaatacatgtattcaatacagtgttcattaaatgtttgataatagaaggacaggcagatccaagtatttcataggaagaaagaaatcaagcagaccgcaggttatatcaccccatcacacattcagggaacttaatcttttcattccagaggatgggtttgtttaaaacaagttcttcctcctaattacttttgaacaattccccaatactgtccttacctgcaccaagagcatgctaaccaggcctggcaccagggtcagagttgaggctggggcatcagccccctttgtgaggtggcctcagtgacaggggtgctatgaggtggcggctatcctactgcagctggctgcatcagatgtgccaggcctgccctctagctcccaacaccatctgcctgatctaagctttgccatgttgttgtcactgctgggtgcctgtgctgtggtggggccattccatggccctgagtgggagccagtgcagggcctgctctcccagaatcacagctgcagggaccctcagtgctgtggcaacctgcttgtcctctgcctctttctggtctggcaggtccggcactgttggcaccaggtcaccaggacccgcttcagcacaaggaatgtcatcaaggtgccactgcagaagcgggcagtgccctccatgaggtgcgaaactgtcttcaagctgactcctgaattcttcagtcctggaaagtccaggggcctagattctcaacaatgcgcacaaaggcagagatggggataccggaggagcctccaggaatcatgggcccagaacctgctctctccacagcacccatgtccaggcccaccttcgggtgtccacacccactctgagcccatcttttgtaccacctccatttcaaacacctgtttactgcctcagaacagttcctggaaagcatggcaggtgccttggtgtctccatgatggtcagactcgccctgccttggacatgtgtcaagagatggagcagctgctgcttcactcacaggaaaggttggtgtcactggagcctgtcatcagtgtgaggtctcgccccacctccatgaccttaaccacctctcttccaaacttactttcagctgagaggctgcagttctgcccccagagagctcctgcctgatccttcccaccaaacactgagaatgtgcacttggaagtcttggcactgtcgaccagaggcctgggaaccaggg

SEQ ID NO: 179101 - DNA, 380 bp, Homo sapiens
tgcacagagtcctgtgatgtgaacaatttatgggactctcagccttggacaccagtgcatgttccagttgaggtgatggagggtgcaatggactccacgggggtccttagctttggtggtttaatgctctatttttgtgctggttggcctcctaccaggaggtggtgttttccagaaagcatcagctgtagtagtgtggtgagggactggcagtgggtgtggccctagatctcccagaattatataccctttgtcttccactaccagggtggatagggaaggaccatcaggtgggggcagggctaggtatgtctgagctcagactctcctgtgggtcttgctgtggctgctgtgggggatggggatgagattcccaggtc

SEQ ID NO: 179102 - DNA, 621 bp, Homo sapiens
ccagctgtgtggaactgtaagtccacttgaacctctttttcttccctgtctcagatatgtctttattagcaacatgaaaacagactaatacagtaaattggtaccaggagtggggtgtggatgaaaagataaccgaaaatgtggaagcaactttggaactgggtaacaggcagaggctggaacagtttcgagaactcagaagaagacaggaaaatgtgggaaagtttggaacttcctagagtcttgttgaatggctttgcccaaaatgctgatagcaatttggacaataaaatccaggttgaggtgatctcagatggagatgaagaacctgttggaaactggggcaaaggcgactcttgttatgttttaggaaagagattggtggcattttgtctctgtcctagagatttgtggaactttgaacttgagagagatgatttagggtatatggtggaagaaatttctaagcagaaaagcattcaaaaggtgacttgggaactgttaaaagcattccattttaaaagggaaacagagaataacaattcagaaaatttgccgcctgataatggagtagagaagaaacacccatttttttgaggagcaattcaagctagctgtaga

SEQ ID NO: 179103 - DNA, 226 bp, Homo sapiens
tatcacactctccagggatgagaactcatctctgagtcctccctgcatttctactgtagtagcctttccactctattgtttctgtgcgtttttaatgtcccctggggcacccccagacacactgagctgcctatctgggctttccaagttatccctgaggtatgcattattatttggttagcgctgtgattacaaaagtgcataggttttgagtggtctactctga

SEQ ID NO: 179104 - DNA, 168 bp, Homo sapiens
cgttgggattacaggcatgagtcactgcggccagccagagcaagatattattaaaataactttctcacaggggcccaaaataggctgatataaaataaatggaatctatatttcaacagccagcagtcctgaacctcttcctgccacactgttcgtccccagaagccg

SEQ ID NO: 179105 - DNA, 730 bp, Homo sapiens
ggctatatggaagctggaggttgcagaaaagctctgcactcctgaagcataaactgccataggaaccccacaaataatttgtataagcatttggttcatggtagcttaccctccagtcatactgtaaaatacatgtctgcaccaagacaggaacagcatctaaaaaaacagggcacataaaaaagcataaacctgagcccatctctcaagaaaattaagaatggcagtgaggtatacccaagtacctatcttttgctaaagaaaaaccttgggaggctgaggtgggcagatcacgaggtcaggagttcgagaccatcctggccaacatggtgaaaccccgtctctactaaaaatacaaaaattagctgggtgtggtgccacacgcctgtaatcccagctactcgggaggctgaggcaggagaatcacttgaacccaggaggccgagactggtgaaccaagatcgtgccactgcactccagcctggcgacagagcgagactccgtctcaaaaaaataaaagaaaaaccttgggatggagttaattcataactgaagaaacaggcaaaaactgactctttggggctcatacaagacaatatcacaggacagaaagtaaaaaagagctaagttcctactttcactgtgttgtcaatgtacctgaataagttccgaatcccagcttgtgggttcgagtacccttggataaatcatgtcatcagcctgcctgaaa

SEQ ID NO: 179106 - DNA, 341 bp, Homo sapiens
ggcaatggcttagttaatcaggactgggcactgctggccttccctgggtagtgttgtgggagagagttagtgtcactccatcaggccacaccttcactcagagcactctcttcccactcacgatggactaggaccctcaccttgggtgagaatgtgatttgtcatggcatctgtgatcataaagtcactgaacatgacctcagagggacccaagactccttctcttgacagatgagggaactgagcccgtaaatgaacaacagatgtgccaaaccccctcagctggtggctgtttgtcatctgtcacctgatcatggttctcctggcttctatgttgccct

SEQ ID NO: 179107 - DNA, 1035 bp, Homo sapiens
  misc_feature (3)..(3): n is a, c, g, or t
  misc_feature (5)..(7): n is a, c, g, or t
  misc_feature (730)..(730): n is a, c, g, or t
  misc_feature (742)..(742): n is a, c, g, or t
  misc_feature (767)..(767): n is a, c, g, or t
  misc_feature (858)..(859): n is a, c, g, or t
  misc_feature (884)..(884): n is a, c, g, or t
  misc_feature (890)..(891): n is a, c, g, or t
  misc_feature (900)..(900): n is a, c, g, or t
  misc_feature (914)..(914): n is a, c, g, or t
  misc_feature (953)..(953): n is a, c, g, or t
ggnannngcataactcaaaatccaggtctagtttttccttaatcctggaggtactggggcgtcctgcaccttactttgccctgtccataggttccctcttttcttgatcatagacaaaattacccctgagaacaacaacagcctcatccatgagatgtagtttagttttcctggtgtggaaaagaaaactgcaacatccaacagtacactttctgttgcacgacttgttcagtcaggaaatacagtgcatttggagcgtcagaatgatttagcagagcagggggcttttgtctggtcctctttagagtcccactgccagaacatgggggaagttaagacttataatcacccatagctttcaaacagaacacacatagcatctccaccaccaccaaatgaccaccttcatcatcttcatctgcaaccccatcactaccgccatgaccatcaccaccataccactaccaccaccatcaccaccaccatcactgtgaccatcacctccacctccaccttcattaccaccatcaccaccaccaccacctccatctccaccggcaaccccagcactaccaccatgaccaccaccaccatcactgccatcaccatcattaccatcacctccacctctaccttcaacatcaccatcacaatgaccaccaccatcaccaccagaaacactgaataaaataatgaaagtgcagccttaggctgggcacggtggctcacncctgtaatcccngcactttgggaggctgaggcgggcngatcacttgaggtcaggagttcgagaccagcctggccaacatggtgaaaccccgtctctactaatgtgaaatactaaatgtaaaaatacannaattagctgggtgtggtggtgggcncttgtnntcccagctncttgggaggctgangcaggagaatcacttgaaccccgggagatggaggttgcngtgagcagagattgtgccattgcactccagcctgggcgacagagtgagactccatctcaaaataaataaataaataaaaatt

SEQ ID NO: 179108 - DNA, 434 bp, Homo sapiens
gtgcatctgacctggcctggtgagttgacaagaaccattttcttttctttttttttccagacaaggtctcactccgtcacccaggctagagtgcagtggctcaatctcaggtcactgcaacctctgcctcccaggttcaagtgatgctcctgcctcagcctcccgagtggctgggattacagatgcacactgccatgccagctaatttttgtatttttagtagagacagggttttgctatgttggccagtctggtcttgaactcctgacctcaagtgatggtcccacctcaggcctcccaaagtgctgggattacaggcatgagccactgcgcccagctaagaaccatttcaataagaagataactactttttttttttttaagaactgtgtaaaccatttctaactgtacttaggtagataccattacagaaa

SEQ ID NO: 179109 - DNA, 457 bp, Homo sapiens
taaaaaagtaaacctttatgtattcactatcatgcacttaatacctaacacctacaatagggacaaccagcagttgttgaggatacagtggtaaaccaaatagacatatcctcacagaccttagagtccagtaggggtgatgaataatcactacgaaacatataattacatatttgtgataaattccataacagtaacaacaacatttgatgatactaacatagtgcttaacatatgcctagcattgttatctaagggatttatatattttaattcatttaatccttatcttatgaattaggtactacttttatgttcattttaagacaataattacagaggcacataaagattaagtaacttgcccaagtctgattccagaatccccactcttaacattccagagtcctagctgttttttatatgaaaaacaaaacaaaacaaagtgctgcaagag

SEQ ID NO: 179110 - DNA, 528 bp, Homo sapiens
ctctctactttgagatcatattcttctttttttatatacaattgtaatctgatccgggctgaaaaacgaagtatagcagtttaaatagcaggaagtagtcaacaactcattataaaagcaacagaaaacacggaaatgtgcatcagaaagtcccaccggtttctcccaagtgtttgaccttgagaagatcactgaacttctctgtaaagcaggcaatatgtgtccctgtgtttctcaccagttggttgggaagccctgaacacatatcaagtagggttgctattcatgtagcctgccctcagctgctattgtagtcttgtcctctgggattttctggacttgtaaaacctcaagctgcagttaaaacaccatcctccacatcctaggccagaatgcctgggctcacctgggtgactcagctgagacatggcaaaaaaacactcaaaactttgaatctgagccggcttctttcattcaagtaagggccagtttacagagcccctccaagggagatggtgcttggagtag

SEQ ID NO: 179111 - DNA, 631 bp, Homo sapiens
tagagagaatgttccaacagcatatgctggtagtgggggcttggcgggagcctgacccctcttgggggctgtattttggagcatgagcagtcctgaaccaaagaacaaggcagggaaaggactttcaagtcctagggcctgtggaaaggcactgagaagagagaaaacactctaggtttggggggcctgggtaagtatgactggacaaaggcatgagcaactttgaggggcaggtgggctttaaaccatttcattgctgatctcagtgtgtagaggtcgatactcttagcattatcaggcgtcagcctggactcaccacagcttttccatacaaggacagaatccattttgagagctggagcttaagtaatattttctcaataaacttagtgagatttttgcactgtcagagcagtgtctgtggtgaagagaagcagaaggctacatccaataaatccctgttatttttcagttgtcagacttgacttaaatgtaaatgcctgactagctttccttctcccattctcatagactctatgagtttttcctttttactccaggttcaggatggaaccatgtataagcgagaaaaattccagtgagaagattccaacatggccctgaaaattaa

SEQ ID NO: 179112 - DNA, 487 bp, Homo sapiens
atatctcaattaactgtagaccatctttcctttttttaataatcatatttaaatcagtggtcttcaaaaattaaataagaccacactcctctatcaactgtttactattatttcactccctttacaatccaatgtttgtttcactaaaataatgtagaattggagtctctgtgttaacttccgagagctacttgaagcaaaccttgtagtcataaatatttatttatttattttgagatggagacttgctttgtcacctgagtggagtgcagtagcagtatcttggctcactgaagcctcagcctcctgggttcaagcaattctcctgccttagcttcctgagaggctggggctacaagtgtgtaccctgacaactggcttttttttttttttttttttttttggggttggcagagagggttgttttttcgcggagccccttccccccccggcctcccccgggttcatcgtctctagggcggggaga

SEQ ID NO: 179113 - DNA, 430 bp, Homo sapiens
aagtttaactgaataaacataggccttttagtgttccttaaaccccaacaaagttgggatacatcaatttaatagaagaaggaagtccctaaggcaaggtaactctttgatttctttttggttcttttcatcaaagatcaaatctagagagtgtatgaaaatagcttcagttgaccatcaacatggttacagcaacaaaagaaacaagaatacaacctcaataatgaggatccatatcctgtgggcattttagataaaagaaccccaccttaactgaaaccaaaatgcacagaaagccatgggaaaacccacaaagaaaattaatgtaattatttccatgtgatcaatataactggttgtataacttactatctttagtaataagcagtagcaatttgccttttacatatgagttttatttaactgcctt

SEQ ID NO: 179114 - DNA, 735 bp, Homo sapiens
  misc_feature (662)..(662): n is a, c, g, or t
  misc_feature (684)..(684): n is a, c, g, or t
  misc_feature (692)..(692): n is a, c, g, or t
gcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagctccagcacccgagcgccgaggtccgcgagtgcgcctgcgcagggctggcccggctggtgcagcagcggccggcactcccgggcctggcgcgacgagacgccgtgcgccgcctcgggccgctgctgctagaccccagcctggccgtcagggagactgcagccggcgcgctgagaaatctcagtgcttgtggaggttttgaagtttgtgatgacatggtgactaaggatatcatgacccctctggttgcgctgctaaaagagtgtagtgctggactggattcaaatgagatgtctctgcaggagaacaacagatcagaacagaaattctattgagaacatagccaatgagactgtgaacgtgctgtgggaatatatgtgactgcngtagtagagcacgtgtctattncaccaccngcagggtgtaggagatgtgtacagtattagtacgttccctacc

SEQ ID NO: 179115 - DNA, 485 bp, Homo sapiens
ataaatctgcagtagccaacacagccgtgccagtgtaacatttacggaaacaaagcaagaccatcatcccacgctcaggaaacaatgggccggtaagcatttttctcttaatgcagtcagggctgcgggaatgatgatgcttatttgaaaaatcccatggtaattgagtaaagtcttgagtgcacattagagattaatattttaagagctggcattttacagatagaggcagtctaaggatgacattaaacgtgtgtcacacaaagcagagtcttctgtagattaaaaatgcttctgttcatgcaataaagtcataagaaatccaaagatgtcagctgtagatctggatattaatgtagtgatccaggctaggaaacagccacttcccaagggttggggaaagaagtgcaccgtactgatggcatttcacttgcttggaaggctccctctcaagtggagtcaagatgagaaaagaagtttcacgg

SEQ ID NO: 179116 - DNA, 215 bp, Homo sapiens
ctcctgcacactgtctaggaaggaatgtggcatccttggagtacatgctggtgctcagggataaggttctctggccagattccctaggtttgaatcctgtctttgctcccaggccaactatgtgcccttgagcaagttacttaacttctgagcctatttctgcgcctgtgaagtgaggacagtaagaataataaaacctatcttaagaagatcaa

SEQ ID NO: 179117 - DNA, 206 bp, Homo sapiens
attgcgccattgcattctagcctgggtgacaagagcgaaactctgtttcaacaaagaaaagaaaaagagaaaagaaaatgtggaaggcttacctaggtgtccaggcccccagccctcctcaattcctacagatcctcagagctcaaacaactgattcctcctccccatgtccactgaggtccccttctcccacaaggccctcttcc

SEQ ID NO: 179118 - DNA, 1426 bp, Homo sapiens
tgtctcctaacatttaccattcatttacataattgtactatcccattatacaggtataactgtttcagaattgttgatttttacccttactggaaacaactctatcaactggagtataatgcttatgtatagcttcttttgcatttagtcttacagactccacttattaatggtgagagactggacatactgctcagatcgggaacaatgcaaagatgtcctctctcaccactcctaatacaagaaaaggaaatatagactggaagggaaaaaataaatctttatttgtagattataagattgtctacatagacgtttttagagcatctccagaaacctagaactaacaaatgggagtaagaaggacacaaggtattacagttacttttcattttctgttagttttggcatctcatatttaagtctggttttcaagattgcattcttttcagatggtatttttttctttgtttttgtatacattataatgttgagagtcaaacatataaagtagtagatactgaggtatatatatgtattttctttgcgataagcacacctttccttcatctaggctattagcgtggaggtttttgtgaaattagtcaggagttggtctgggattgaagttttgttgttaccatggttactctctgtgtatcagaaacttcaaaccctataatgataccttgtttttgtgtccttgtttggcgtgggttttcaccttttcactcttctctagagaaggcctgtggttttcagctttcccctgtgcattactttaattttatttgatgtttagtctgtggttggggcgaaaaagaggcatgttctctaatgttctaatttaaactcagtcttaagtaggcactgtgaatctgggtcttgtgggtgtggctgtcataagtctttcttttccagtcaatgcctagtatttattcccattcctcccctatggctaaagctttatgtgttccttacctccttacccagcccctgttgcttccactccagggtgtccctgcaaattgctctaaggtttttgcttcttaggcgagataggagacgggcctctggggaattttggtctgctttatattcccttccactgcttcatgatcttttctgtaaatgaagaactttttttggtggggcgtggtggttcacgcctgtaatcccatcactttgggaggccgaggcgggcggatcacctgaggtcaggagtttgagaccagcctgaccaacatggagaaaccctgtctctacttaaaatacaaaattagctgggtgtggtggtgcatgcctgtaatcccagctactcagaaggctgaggcaggagagtcacttgaacccgggaggtggaggttgcggtgagccgagatcgcgccattgcactccagcctgggcaacaagagcgaaacttttt

SEQ ID NO: 179119 - DNA, 1296 bp, Homo sapiens
tgtagtgtgtgtgtacacacacgtcagggctccatcatgacttttgtgggttgtagtcacttctgcctttgcagcttcctccatagaactattaagaaggttatcttaggactgggttggtcgccagtgaaaagatgcactccagaatgggttttgcacgttttgtttgtgatttgaagagaaatgaagacattttcatgggcttctaaaagtgctgtgggcctggccctgctcctcctgtaacctttcccaggaacgtccggctcggccaggctgggaccaggctggttctgaggacgtttatgctgcactgggcacagagtctggcatgtggtagaagcttagggtctccttcctgagtcattactgagtaactctaggtcctctccctgctttctctgcttagtctctgatcagggtgggttgtgtttgtggtgtttgtggcgtttgtgatggggagccgggcagcccccaggtcatgccttgtttgtctcaccttcacctggaaggctgccaggtgggccacgggctggtggcctgcgacctccgatggttgagccagctctgtcgggctgccagcagagaaagggcgggtatagctctgagagacagtcacagcccacacagggtggccagggagtcagaccccaaacttacagtcctgcagacctcactgtgagaccctcctgctcagggactggcaatgcccaggcagaaatagctctgctgaacacatataacactagttgaaaataatttggaatggtttacgctttgaggacagctatagaaaagcacagggtaaaatatagccttctgcttagatttagaatcttgcagtttctaagagcttcctgtctttttattctaaaaagtcacacttcacattcaaaacattatttcctaaaattatcagctgttggcacttttccagaaaagaggcctagcttgccatctttctatagtctttctacaggcaaaagtcaagcctgcctgacatgcaaagcaccttgacctctgaccccagagctccccagggccacatgcctgcccagagccaaggaccatcttatgactctggtaaaagactgggaaaggcagggaaggtgccaggggctggggaagttgggtcccttctctcctctcccccaggtgactctcagtcccaccctaagtgatactaggggctggggaagttgggccccttctctcctctcccccaggtgactctcagtcccaccctaagtgatactatgggctgtcaccctgggggcgggtggagcagccctgagagct

SEQ ID NO: 179120 - DNA, 536 bp, Homo sapiens
gaatgttagagatttgaagggagaggaggtagtacgagacggtgaaagtaaattaactagaaaagtggaatagggttgctaggcagcactgagaccccattggagggtgtagtcatgaatttggagaacactcagcatgatcgtaatttgtttgtttgtttcctagctcattcagctgcttgggtttggcagagatttagtattgaccaaggttagaagtcttatttgtccagtaaaacccatattgaaaggagcaggagcactgatggtaatataaaggagtggttttcaatgaagtatggagcctagtccagaaaggagggaagtgagcaaatgaaggggacaatatgtagtgagaatgtggcttggaaaacccactagaatgaggaatggttggagtcagactattctgagaaagagccagaagaaaggaatgatgtttgaaattgagatttagagtaatgcagggttactgataaagataggtctcaggtaaggtcataatgttggggaatgaggtcaagtggaggacaaaa

SEQ ID NO: 179121 - DNA, 225 bp, Homo sapiens
ggttaggaggcatagtgggaaccagaaaggataatgccactcccagaaggagatgggccctcctcctggcactgccaacccagcctgggggatctgtgctgacattgtgaggggctgcctgtgctagtttttgtgggaggggaggtgccagctatggggttccagggtgccgggggcctgctgactgccgaccactcatttctccctgccgtatatcaattttga

SEQ ID NO: 179122 - DNA, 577 bp, Homo sapiens
tttcgccatgttcgccaggctgttcttgaactcctgacctcaggtgatccacccacctcggcctcccaaaagattgggattacaggtgtgagccactgcacctggcctcacactgactttctttgctttcttcaaacatgctgagagtcctctggtgactattccctccatctgagaggctttctgcagttaacatacagcccactctcatctccttcatggctttgctccaaggccaccttctcaacaaggattactctgactgccctatttgaaatcacaccccatctccagcccctgcactcccaattcccctctccttgctctgttttttcccataggagctggtaccttcgcttatacaaatgtacttacttattacatttcattgctgtcagctccacgcaagcagggatatttgcctgttgtacacttggacggagagaatgaatagtgcccctctgttgacatcattgcctctagcctacgtctctttccagggctttagatcctgtttctagagacccactggtgtctcacaggcaactcagctcctagatggaaacagcctcctccg

SEQ ID NO: 179123 - DNA, 892 bp, Homo sapiens
tattatatttttaaaaaatagctatcctatgactaggtaggtgtttagtaaaacatgtgacctcaaaccactaagttagctgtgaataactgagttaggtgaagaaggtgtcttcttagtctcattacgagaatttcaattacttctcccatatcaaagggctcaccccttctgcatttacacagtagtaccctgtgaaaacactgttaatggaatgattacatttctttcactctaaagaatgatatttaaataatcttgaatttctgcagatcagataaaaacattcatgtaaactggtcatatttaagtaacattattttataacttacattcaaagttacaaatcaatagtttctcataaaacaataaaaccatttcaaaggtctttataatttattagattacttactcattttcaagatgtctacatttaaactacagaaaaagacttgcatttttttcacattatgtggtttagtgaaacgtctggttcatccaatcaaaacaaatggcataatcttctgctttcaaaagcctagtgacctatttagcaaaaagctgtttcactgttactgacaaatgtacagagatgtatttcacttagaatatattctataagagggtcactgaatacattttattgccgcttgcctcttagctagttcaactaaacctggctcactgcaacctccacctcctgggttcaagtgattctcctgcctcagcttcctgagtagctaggattataggtgcccgtcaccatgcccagctaatttttgtatttttagtagagaccgggtttcaccatgttggccaggctggtcttgaacccctgaccccaggcgatctgctcatcacggcctcccaaagtgctgggattacaggtgtg

SEQ ID NO: 179124 - DNA, 1063 bp, Homo sapiens
gggctaaagataatataggggaaaaatagttcttaaaaaaatgatagaatattggaaagacttctgtctggacataagatgttatatttcaaggaggaatgatgccgtggaattcagttctgctgtgataaaattccatgtttgcaatattgaaaacaacacttccaaagagatgcccatgcatctaaccctgatgggatgtgtattagttcatttacatactgccataaagatacgacctgagactgggtaatttataaagaaaggaggtttaactgacttacagttccacgtggctggggaggcctcaagaaacttataattatgatggaaggcaaaggggaagcaagacaggtctcatatggtggcaggagagagagagcaagcgaagagggaactgccaaatgcttttaaaaccattagctctcatgagaactcactcaccatcatgagaacagcatggggtaaccgcccccgtgatccagtcatctccctgcaggctccctgtcctgacatgtggggattacaacttgagatgagatttgggtggggacacagagccaaaccatatcaggatggctagtgtatctcagggaattacctttggcatcaggaaaaggacagatgatatagtcatataaaatgcacctaagaaataacttggctgataccttttcccactgtcagcaaaactgtgctctatgctgagaccttaagaataaaatattggttaggttgggaaagctccatgtttccactgtcctgcattttgcctgtgagagttactctagtgtggctgttggaggctgcagcttggcctcctggtcagtgtaagttagggactgccccacccattcacccctagatagcccattaggaggccatggaggaatacacctgcacttgcttttaaaatcaaggtcggctaggtgcggtggctcacgcctgtaatcccagcactatgggaggccaaggctggtggatcatgaggtttggagatccagaccattctggctaacacagtgaaaccctgtctctactaaaaatccaaaaaaaaaaaaaa

SEQ ID NO: 179125 - DNA, 281 bp, Homo sapiens
gtacctggatgactgacggtctgggattctggatccaaaggggtagctctgtttctgtgcctttatctcagagacatgataaaaataatgaagatgagagacggccatacctgtggctcaatgtagcaccactcccagcccctcagccacccttttgcctctgtaacttttctcaaggagaaatctctgctacctgaaacaagtagagtgaatctaggcaaagagacaggcagcctctgatagaggaagagatccacagaaagtgcatccttctgcagtag

SEQ ID NO: 179126 - DNA, 523 bp, Homo sapiens
ttcctctgcacctccactgccttcaggcaggccctcatctttgtctaaaccattgtaactacttgctgtctcgtttccttgccccgggtctctctacactttagcacatacatcacggggcactgaagtcatctctcctgaaacctacatggatcacgtcactcctctgctaaaaaccttcacaggctcccataggtaaagtacacatcttcacctactaggaatgaggtggcaactatcacttactatgctaaatatcttggtaggatctttatatatattattcatgtaatcatcacaacaatgcaaatgaaatgaatttaagtatcttagttttatagattagagtcgaatgaggctaatcattaagcactaagggaagtcaaataacttttccacagtctaaatcagtcaaaaactgaaattcacagccacgtttgactttatcctgtatatatgtcagtacagtgaattaatatcttatgtagagaataaactctgaagtcaaagcataagatgaaaa

SEQ ID NO: 179127 - DNA, 748 bp, Homo sapiens
gctcccccaatggcagcagctcgctgtcccccgagcgccaggcaacggggacctgcctccagtgcccagtgcctcggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtacaagatgctcatccacatccgcacacacaccaacgagaagccacaccgctgtccgacctgcagcaagagcttctcccgcctggagaacctgaagatccacaaccggtcgcacacaggtgagaagccctacgtctgcccctacgagggctgcaacaagcgctattccaactccagtgaccgctttaagcacacgcgcacccactacgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactg

SEQ ID NO: 179128 - DNA, 586 bp, Homo sapiens
tggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccac

SEQ ID NO: 179129 - DNA, 474 bp, Homo sapiens
tcgcctactcctccttagggcaagaggaggctttttatctgatcacagaaagacaaatgagcatgtggagaagcacagcctttcttttttccttcctcttaagggtgtgtgttctctgcctccaagggcagccagcaggtggatcctggacctgccagggagacagggcggcggggaaagcatggtcaaggaggcttattctggtccagcattgctagatgggaaagatggtttaatcctgagactatttattttacctttaagtttttttaagagacaaggtctcactatgttgcccaggctgttgctcaaactcctgggctcaagccatcctcccgccccagcctcccaagtgtgccatgacacctggctctgaggttgttttagaaagcatgctgcttgcttgcacatataggccacgttctccattatctattagtaatgtaagtgacattttggtcttgtttgttttat

SEQ ID NO: 179130 - DNA, 438 bp, Homo sapiens
cagttctccagcctcagcctcccaagtaaccgggattataactgtacgccaccacacctggctaatttttgtattttcagtagagacaggattttgccctgttagccaggctgatctcaaacttcagagtctgtccctagaaagtgtgtgccaagggacttggctagtgaatcagtttcccgcagctcctgtaacacagtactgcaaactgggtggcttaaaacaacagagatgcattgtctcacagttctggaggtgaaagaccccggagcaagctgcctgcagggttggttccttctggagactctcagtggagggagaatcctttccatgccccctcccagcttctgggggtgcagcaagtcttggtgttcttggctcatagctgcatcactccagtctctgcctctgtcctgagattgtcttctcctctgggtg

SEQ ID NO: 179131 - DNA, 138 bp, Homo sapiens
gattgggcatgtgatctaagcaggtatagtctgagtgtattctagttggtatggtaagtggatataaggcctctattctgccatatgatttggttaaatataagaagtgtctatggggcacagtgactcgtggaaatg

SEQ ID NO: 179132 - DNA, 447 bp, Homo sapiens
ggcggtggggtggctggaaaggcagtggttgatgaccagtgtggtgggagagtccagacctgagtgagaaggtggggagcagcaagggaagtgagggcctggaggcctgggaaccggggaccgatgctgagtagtcacctggccagcagccacaggcacagcatttgcccctcaggcccatcccggccttggcccaactgagcccaattcctggcccctgcctcaggccagggaaggtgtggctggctgggcaggagccatagtgccagcgtctactttggtcttagttgggttgtttggattttggtcctgacctcgtttctgaatgctgcttatgtgagctggagggagagtggacactgcccccccatcccctctcactgccttgtgatgggatcttaagagaggctgggcctcgaagactcaggtgtggccccactgggtcag

SEQ ID NO: 179133 - DNA, 1792 bp, Homo sapiens
cagaatggtctgaccaactattgtgtaccagcgttctcgtttgtagccatgtcccaggaggttggacatccaacaagatagactctaattcagcctccccagtctctggccacccagctcactcagggattcagctacccttggctacccaagtagtctaaacattttatctttatcaggcacatatacagtctggttctctgtagccaaatttagatacccatgacatttatctaatgatttcaaaccaaacaggttcctaaaaaaacattcagcctacttctagaacttccccattttgcttggctgtgaaaatgtatttgtcccatgcaggcccttgctccagcccagtggaagcattagtacctcttcctagcgggaactcagtccagctacacaccagagccaggccagtggttgtctgggaaatcttcaaaggccgtgaccactcagcaagggtcagtggcacctctccccactgtctcctcaccaggtgcattcatcccatccatccatgcattcactcaccctccgtgttgtccagcactatgtatagtgctgcagaaacaagaagaatatagtgcttgccttcaaagacctcccaaagtggggagatagtctggatgacaggtgctgtaatagaagtgtgccccggatgctataggagcacagaaagagggcaactgatgaacactggggtgagagtggaagaggagaccctggaagactccctaaggaagttgtcttactctggtcaagcaggaggccctgtagagggagtggtgcagacccaccagcatatgcagcttcacaggggcaaaacacctgtaggtccatcacgtgttggggactagcaagtattcagcttggctggagcagaggcaggagtggggaactggggacaggtgagactagaggttggcagaaaccagccatagtagtttttgcctcatttggacaacaaggagccatccaagagagagcggtgaagctgatggtgacacagccatggcgcattgaaatacccccagtggctgtgttgtagggtatattgggttggggagggacaaggtcaggaggcatagactcgacatcatctgatgtgattcaggacagaatggcgagcctgaagtgaagtgtctgtaggataagttggaaaggaaggaaccaatatgagatattaaagaagtgaaagctataggtcccagtgccttaataaaggtaaggagtaagagaagattcgagattgactcccagactctccagtctgctggacatgggagatggaatagaagttgatctcggtgtggtcagaggagagcagttactgtgttgagcatggagagcctgtcgttccccaggagaaggagtacagctggctggaaataggcaaggcagagatggagagatccaccttggagtcactcctaggggcgacccttgaagccctgagtagcaatcccaccagaaagatgcaagggctgaagctgaaacttcagagagcatcggcatttaaggaagaaccttggctgggcgtggtggctcacgcctgtaatcccagcactttgggaggctgaggcgggcggattgcttgagcccaggagtttgagaccagctggccaacgtggtgaaaccccgtctctactaaaaatacataaattagctgggcggtagtggcatgtgcctgtaatcccagctactcgggaggctgagagaggagaatcacttgattctcctgggaggcagaggttgtggtgagctgagatcgtgccactgcactcctgtcttgaaa

SEQ ID NO: 179134 - DNA, 467 bp, Homo sapiens
atcctgggagaaagagcccaagaaagctcagcaagcagccccctacacagggccagttctcaggagcctttaggatcagaggtaaatctgggcaaggccgaagcctggtctggtggtaccctggagccagatcgtttccagaactggaagagtaacatggcattcatccaggggacatgctccttatagttgcttttccttaactgaaaaaggaattcttggctagagagcctaaaagcctaaaggcaaaattatatggataacccagagagtatgtatggacctcagggctccaaggaaaacagtgaggaggcattatgactttgtacttcagcaatgacagcagtggaggatgggccaaatctctgccttcccgataaaccctttgagtagaactgtaacacagcccaccataatcctgactcgcctccttctctagtttcctggacatggagaattgctgccat

SEQ ID NO: 179135 - DNA, 638 bp, Homo sapiens
agattgttgtaatagcccctaaccagacacacttgtcctcttccggtattctgcacagtaatcagagtgaatcttttataagataaaccactttgtttcctgcttacacacttccagtggttcaccattacaaggaaagcaaatacggaatcttcatgtgcttgaaggcctcacatgatctgacctctggcaatttgtccagccctgcatcctgcacccttcctcttgctcccttgctcactcctctccaatgactgttttcagaacccatcagtttgtttcctcggtagatttcatgcctttctccatatcttgctccatcgcttcattcaggtttcagcccagaatgtccagtctacagaggccttccctgacctccacatctagaatagcatgtggggagcatgtagatagaggtgtgcatcatccctacagagtatgactgagctctctggaaggagtgaggaccaaaaaaatgacagtggaagaatggggaagaggaagagaaagggaaggaagtcagaatcaggagaaagagtaaagggaggtatcctgtcttagcaagggatactgagttcagtgactccctgggtcaagatcatctcattcaggatcagaaagttaccatgacagtgccc

SEQ ID NO: 179136 - DNA, 809 bp, Homo sapiens
acacaagactaggacctccctctgccagatgttcctgaccccatctccacctccagcctctagcctcgctgggagttccctgtgacccagcctgttccatagccaaagggagaccaaagtgaacgatcacagtgccccgcacctattctaggggacttggatctcagtagagcttaatccatggcatctgagagcacccaccctgtccctgagggcagctgtgccgggccagggggccgcaagggcatgggtggaatcttggtcactggcagcactcagccacgtgcctgaggagctcttcaccttgttcgtcactgaagcactgcaggcagtgagggcactgaagttccccctggcctctctgggctgcgccaggatgcccgccctctgcagggggttccaaccgcctgggacccagtcccaggcctccagccaccaggcacgataagctccactgcatcggtggccaagtacttggcagttttgctcccagcgtgaatccagccggcgtctggctcttgagaatcctgtctccaggacacctggtgcagcaaagaggtgaccttttcctccagttcctgaatcctaccttgagcctgttcccgatctgccctttctgacatgaagtcatccttgtaagcgagaatctgctattccagtatctgcacccattccagtgcagcatcccgtgccgtcctcgaggctgccagcttctacgtcaattctgcacagtcgtttattttctcttccaactatctgttgagccgggagatctccttcctcatcagctcgggctcatgggggggggg

SEQ ID NO: 179137 - DNA, 247 bp, Homo sapiens
agggcaggatagtcagggattaggaggctatatagggatttggagttttatcctaagagcattgggaagttattaaagaactacaaacaggaaatcaatctgttgttctgtggatgggagagagactactgagtggatagtgcaaccattcatggtcttgaagattaggtgttcagtctgggaaatctttgattcaaagtacctgtgaaacatccatttggaggtattaagtagacaattggctata

SEQ ID NO: 179138 - DNA, 251 bp, Homo sapiens
ggtcctggcttgacttcttggggatgggagtgagcctggtgggagcagggaactgaggcccaggtttagaggtagttaggacgggaagggtgctatgtgccctattgggtcagcatctcccgccccatccaaatggccactccactgccttcttagaccagaggatgttgggcatacttcactgcctggaagtccctcagctagggaaggggagagaagaactggagccctggtaattttttttttttttt

SEQ ID NO: 179139 - DNA, 221 bp, Homo sapiens
atgcaatttactgctcagaggatgtaacctatttgagtctagagagctaattaataacacagtctaaaaagaacgcagagttaatcgccatccatctcctgggctattttaacttgtttttttgacagttgctgttaaacaaaattctaaatattgttatagcagtcagttattagttaccttaacaagatgcaagtttggtgttggtcaaagttaaatcc

SEQ ID NO: 179140 - DNA, 504 bp, Homo sapiens
taatacggtcggctccaagaaaggtcagccacgtgcttggggccagggggccatcttttattcattccctgacacaggctcattaattattctggcccagccggagctgtgctcggacgggacactaatgagaaaaaggagagtggatttgagatccacacgccatccgctgtggggacgtagagggagagatggaagaaacactggtgaggctctgaggcgggatggggcctgcagcctggctccctgacagtgctggttaggtgtgaagaggtgagcggagctgatccgcaggtgtgtggggcactggctgccacatcccagctctcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgcagggccagcggtta

SEQ ID NO: 179141 - DNA, 501 bp, Homo sapiens
tatgagaaaaccgagggccaaggccacacatttaggtggtgccagagctgggctgactctggcgtctgctcttaaccagaattgaccaagcctaagtggtggcctaggtgttcctgtgggtgtcaagcgcatgccccatacaacacaatttgggggcatgaattgtggccacgaggtgcttttgtttggttgcttgcttgtaggatagcagctaggttctggatagttgaggttatcggttaagtgacttccagataagtgagtcacagctacagcaagttacacccaaaagggggttgggggctgatgaatgggaagaaatggatgactttcatggcacagagaagatcctgggtccttcttgagtcttctgagtctatcaagtggcttgctagactttgggccctagagttcggcatccacaggagactcctgcttccatggagcttctctcctgctgccatggtgatgtaagattacacatctgcgtggccagaagga

SEQ ID NO: 179142 - DNA, 463 bp, Homo sapiens
agaatgagcaggagaagccacaggaggcagcttcctgctctgcagaggaaggactttccaagagggagaaaaacagagagcaaccttctgttatgtgatcgtggaaagagctcccaccagaaatgcctgcatttaagtccccggtctatcacttattagcagtgtggctttgagcaagttgttttggctctctgagcctccgtttcctcatctataaaacggggattataatacttttttcctagggtagttgtgtgaatttaataaggtaaagaacatttggggcttagcacagtgcttggtacagaataagcacatataaaggaggctgcttttattgttaaaagagagacttggataagtttctatctctctgagcctcaatttccttacatgtaagatagggttaaaaatgcctttcttttttttttttttttttgagatggggtctcgctctgtcacc

SEQ ID NO: 179143 - DNA, 244 bp, Homo sapiens
ctcctgacctcgtgatctgctggcctcagcttcccaaagtgctgggattacagacatgagccaccgcacctggctggccaatttgatttttaagtatcctatcaattatttaggtctcagatggtacatcacctctcaggaagcattccctaaccatttagcaggtcaggttagttcctcttgcagcataatcccacatcacccaatgcttccccaatatgtagttacttgcttatttaaatgt

SEQ ID NO: 179144 - DNA, 552 bp, Homo sapiens
atcaaaaagtaagtatgaagtttcgtacaatgaagatgatcccattttcctaaatagcacaggagagtttccaatgacagactatacaaatgaaagaacccttagagatcacctatttaacaaatgagaaataaacggaggccaagattagctgactagcttaaggggtggacttagaagtaatgcaagacgccatattagaaattatttgtacaggctgggtgcagttgatcacacttataatcccagcactttgggaagccgaggcgggtggatcacctgaggtcaggagttcaagaccagcctggccaacatggtgaaacctcatctctactaaaaatgtaaaaattagctgggcatgatggtgtgcacctgtagtcccagctacttggcaggctgaggcaggagaactgcttgaacctgggaggcagaggttgcagtgaggcgagatcgcaccactgcactccagcctgggcgacagagcgagactccatctcagaaaacaaataaattatttgtacagctgttaatggtagagctgaaactggaccc

SEQ ID NO: 179145 - DNA, 493 bp, Homo sapiens
ctccctgtgccctggtttctcactttctgggactccctgagctccagcattagacaaagggcacattttcagggaaaataatcccttgtttgtttgttttattcacaaactctcccctctctgccttttcccatccaggacattcctgctttcaaacaggagccactctccaggctggatgatggccaggctcacaccggctcccaggagtcctgtgggctaagcccggagggtttgctgcagccaggaatgccggggctgcctgcaaggagtgggctccacactgtggctgcaggttgccttcctgctggctggcccatggggagtggggaggaacctgagcccagcccaaggatgggcagagatgagtggtgtgaagggtgtggtggccagggggagggacacatacatgcgggtctgtaaaaacctccacacacacacacacacacacacacacacacacacacacacacacacgcagagtgcacagatt

SEQ ID NO: 179146 - DNA, 294 bp, Homo sapiens
cagctctctttaacctgatatccccatccctcctgcaaaactgctcttatgaaggtcgcaaatgactttgagggtgccaaactcaatggaaacatgtctgtcctcatcttgatttacttcttagctacatttgccacaacctaactctccctccttcttaagagaatctctttgctaggccatcctgacagtatattcttctggagttctttttacctctctagccattttttttttttttttggggggcgataaggggtagggggatcccgagcctcgattcggaaactcagg

SEQ ID NO: 179147 - DNA, 138 bp, Homo sapiens
caccatggtccctcggctccgcgcacatccacatgattctttcttgcaagatgaaagaactcgtatcgtgtgtgtgtgtgtgtatgtgtgtgtgtgtgtttcttttttaaagacaagtctcaggctgtcacccaggct

SEQ ID NO: 179148 - DNA, 244 bp, Homo sapiens
taagggcaccaccataatacaccgctaattcctggcaccggaagagatgaaacacactctatcttgcacatacctgccagaggaggccactttcctcttctgtgagatttaaaaagctcccccaaaaggttatcactcccatcaccaatacacagaaaatggaggaaaggctgtttccaattcttggcctttaaacaactctaaatgtcagtactcatagtggcgtattacaaagtaataaaca

SEQ ID NO: 179149 - DNA, 122 bp, Homo sapiens
aaggctagctaagaagggttcccccacaatgtcctggccttgaatttctcctgcctcccccagatggaaacctaacataaaagggtggtcctcaggctacagctccttcctctaacctgatg

SEQ ID NO: 179150 - DNA, 332 bp, Homo sapiens
aagcactgtcagtggtctagggcagaagtgccaaaatgcaatagatcaaaattatcaagactcagaaaacagaacatggaaaattcagttccatatgcagaagagagttcaggaagtcaatatataatgttttaaaacattatttttatgacagtcaaagcccaccaaatgagtactaacactagatataaacaaaagacgttacccataatgtcaggtattataagcagaagttatacatctaagtaggtatttaggctaaataaaactgctgatttatagattaaataatacattattgatctgggcactcacaaaatgacattgccaaa

SEQ ID NO: 179151 - DNA, 566 bp, Homo sapiens
atttatgtcacagtgcaagacctatctagcgtgagtttggacggttatctttcccctcgttgatcagaaattgtagacaaaataagcagttactgcaattcattttgctgcggtaattgtgagttccagcttagcagactttattcatcagtgacagcgcgtaagacaacactttggacctccatggaaagacaaagacatttttcctgatagtagtgtataatgtagagaggaagacaaagtgtagacagctaacaaatagaaggttaagctaggtggaaaaagagcagaggaatagggagagaattcgtacaatacagggtttttagggagggagtttaggcccagaagaatgaaacctaggttgtgtattccttacacagttggtgtttagcgctggtctctcttgaacaaattcctccattgggtttctggtcccacctcacagtctcagtaatggttgtgaggaaaaaggtgtagaaaccctgctaatagtattgctgtactctttcctgttgctcagttacccacgagttagtctcaaaacaatgaatgtattattctca

SEQ ID NO: 179152 - DNA, 475 bp, Homo sapiens
acccagaaattccccaacatacctgatctcagaacacttttggacatatcatgttaaacttaagttcagaaaataattttggaaatcagaaattcaacctgatcttatcattaggaaattgactccaagaaaagatgttaggtccaggaccacagtgggagttaacacagacaggaccagaacccagttgtcctattaaccttaagccatttctttctaggtctacctgggttaggtctacctgccaggtagacctaaccaagctggcccaaggagaatacattgcaccagagaagatagaaaatatctacaacaggagtcaaccagtgttacaaatttttgtacacggggagagcttacggtcatccttagtaggagtggtggttcctgacacagatgtacttccctcatttgcagccaagcttggggtgaagggctcctttgaggactgtgccgaaaccaagttttagtctac

SEQ ID NO: 179153 - DNA, 805 bp, Homo sapiens
atgcaaatggttttccctgctctcaaatcagatgctgaggagaggagagctgaggcttcctggagctccccctgctggcaggcagccgagggtgtctcctgccctcttggcactgttctcccagccaaggaggtggccttttctctcttccaagtggggaggagacattttatttctactctgtcccttctgctagctcctcccacttcctgggaagactaattctagaactgcttgaccttggccagggaagggctggatgtgaagttccacacctggagtgatgggtccttaaagtcccttctttctgttctcaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggtgccagaggccagcggggtgggggagcacagatgcttccagttggcttggctccctgcacttggtcctgaaggggttaatgaggcttgaactgaacagaccgggccctcactcccttccgccccctccccctttggtccccttcctctggacctcacatcctgtgtttaggttccagcccacatacctctctaatctgagaggcctgagagcccgttggctggagctgcctaggttccttccggctgcagctggccacccccggctctccactccgactctgccctgggtcactgccctctggtgtcctgatgttcctgaccccaccc

SEQ ID NO: 179154 - DNA, 501 bp, Homo sapiens
cgttatctgcaggtcgatctagactgatcccgtcagggagttaccagtcgctagttactgtttaaaaataaaaattaacccacatacgaacaattaactgctgattatgtaagagccatgtgttgccagcagggtattatagctgtaagatgctattagttttcccgaaacagttcaccaatgagtgaaaactgctggggaacaggatagttcatgtagtctcaaagattacttaccaattacaatcacaggttacctaatcattatactaggagaaaggtattgtttcaacagagagcaggcggacaccacttgaagcaggtgaccacacttagcaccacgaagtaacaggacaaactgagattgtgagcctgtgctgtgaggcagtgggaagtacctatgacctcaggaagtgccctagccaaaaatattcaacttgaatttaatcacaaggaaacagacagacctagaatgtggaacattctacagccgaagaccagc

SEQ ID NO: 179155 - DNA, 384 bp, Homo sapiens
agtcaaacatttgaggtttccttgggttatatgggtaactagcaggagccaaatgggaagaaagtgccacacttgattgtaagccaggtctgtgcatgggtctcaccagtgatgtgaggctggaggagctgctgccttttcctaggcctgtccaattctactcttagtctggctctaagaaggatgaagaggagagttgcccgttacaggaaggaggagcaggagagatgcttgaagttaatgaatttgtctataagttaataaatttgggttaggtctacctggccaggtagacctaacctacgccaaaatccatttcactatcatatgcatcggcgtaaatctaactttcttcccacaacactttctcggcctatccggaat

SEQ ID NO: 179156 - DNA, 402 bp, Homo sapiens
acttaatttgaactctttgttaataatgtatgttacaaatattttcccttggtttatggctggttttttacaatctttctttcactgacatatcttttgctgaacatatgttcttaattttaatgtagttaagtttatcatattcttttgattagtgatttttgtattttatgtaaaaagccttccttaaccaaaggtcagaaagatattctcctatattttcaacttaatgctgtttttcacattgaatttcttacctacctagatttttaaaaaatattttcctttctggataatgacaatcatactaccatttactgatgagtccctttctctactgacctgcaatacgtatttgtcatatatgaatgtttcataaatattgggtctatcttatattta

SEQ ID NO: 179157 - DNA, 239 bp, Homo sapiens
atgcctagtcaaaataaaattttctcctttaaaaaacagagtcaatagtgtagcatatatgagtatatacaaactgtattttttcttttttcataaaagttgtgcaaaatggcatttatcataattcctgtttttgaagggtccaaacctcctagcagtattataaacagtgagtatggctgtgtatgcagtcacaagttttatgcatcccatctactagactgaactgtgttatcccg

SEQ ID NO: 179158 - DNA, 727 bp, Homo sapiens
  misc_feature (620)..(620): n is a, c, g, or t
  misc_feature (624)..(624): n is a, c, g, or t
  misc_feature (642)..(642): n is a, c, g, or t
  misc_feature (656)..(656): n is a, c, g, or t
ccggagttgaaggggcggaggggaagtgggatgcggaaaaatgagttcggattaaggagactaataccctactggaagacaggcatagtagacatctatcgggctggactgagaactcggtgggaactagaggatgtcagggagggggacccagattttagtaaagaaggtgagtggtctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagnccanctcacataaaggcggatncaatctgctgactntgagtgtgaagaagacccatttgataatctggcagttaaaacctattgatgagaaggacgagctgagacac

SEQ ID NO: 179159 - DNA, 537 bp, Homo sapiens
cggcacgaggggggcccatcccaccgcttctggggagaggaatcggggtgggggcgcccgcagcaggggagagacactacacaggcctgggaccgccaagcacaccagctgcgagctcctgaagggcagacacatggacacacggacactgaaaccacgagcatggcacagccacagggagtggggagttgagggtgagctggggacgtgcggtgtagatttagttctccctgaggcaatgagattggggagaaaaggtggagactagaccagaggtgagtgatctttggggatatctttggccttgtctggtcttctccaggtatgtttatccgccttttttgtttcttgggtggaggcttacctatacagtccacctgggcctcaggaaccgccccagtctttcttgtggaacgtcaggttcatttatttgagctatatcagtgatctttgacctttgttgccaaatgtaattgtttccagactagcgtcttaaaagtatggttgggcataaaaatacgttttatgttaaactga

SEQ ID NO: 179160 - DNA, 533 bp, Homo sapiens
ccggagttgaaggggcggaggggaagtgggatgcggaaaaatgagttcggattaaggagactaataccctactggaagacaggcatagtagacatctatcgggctggactgagaactcggtgggaactagaggatgtcagggagggggacccagattttagtaaagaaggtgagtggtggggagttgagggtgagctggggacgtgcggtgtagatttagttctccctgaggcaatgagattggggagaaaaggtggagactagaccagaggtgagtgatctttggggatatctttggccttgtctggtcttctccaggtatgtttatccgccttttttgtttcttgggtggaggcttacctatacagtccacctgggcctcaggaaccgccccagtctttcttgtggaacgtcaggttcatttatttgagctatatcagtgatctttgacctttgttgccaaatgtaattgtttccagactagcgtcttaaaagtatggttgggcataaaaatacgttttatgttaaactga

SEQ ID NO: 179161 - DNA, 642 bp, Homo sapiens
ccaagtggcttaaaaatcggaagtttatgtcacacagttcttgaggctaaaagtccaagatcaagctatcatcctctctctgcaggtgcaaggaaagggcttatcccaggctctctcctggcttctgagttccttcgcctgtggtggcataactctaatcttcacatggcattctcccagagtgtgtgtctgtttccaaacctcccccttctaaaaggacaccactcatgctggattagagacctgccatactccagtatgatctcatcttaactaaatacatccacaactcaatttccaaataaggtcactttgaggtactggggataaggacttcaacatatgagtttggggggacaccattcaactcataacactgctgatgttttttccttttggagtggtgaaaatgttctaaaatcagattatggcgatggctgcatgactttgtaaatatactaaaacagatgaaattgtatactttaaatgagtgaactatatggtatgtgagttgtatctcagtaaagctgtttggaaaaaaaaaaaaaaagacaagagagcttgggtttaaagagtctgcccaagctcaataatcaactcaatggtgtgtttgggaaaacaggatctctcaacaagggcagt

SEQ ID NO: 179162 - DNA, 189 bp, Homo sapiens
aaacatttccagctgctcaaatagtatcatggcatctgcaaggaggcacttagtcattaatgtctgtccatactggcatccgctaaagcgtggaaatccatctctctttagctaatgtttcccctatgctagaacctgctgagatggcttcaaatacatattttatttgcccaaactacacttcaccta

SEQ ID NO: 179163 - DNA, 475 bp, Homo sapiens
tcgtgctaatgtagtctgaacatactctcctacctaattggaaattttaagtgattaaacatcatacagcaggtgactaaactgggatgctcaagtaaagctacttcgtttctaataaaatccaaggattatataataagctttgacttttcaataattttctattctgtcaaaggcaacagagacaacatccattttacaagaaaacatggagttaataaaatatattttccccccaactaagaattgccttctcttttgtcaatattacaagacattcatctactgacaaagagaaaaaatgaacaattcacttgcctgttaagaaactaaattggaagcattaccagtcataggtttaattaagttgttactagggaagaatatttaaagcaaagggattatttaaagttcactgccagccgctaaatttgggggaaaccgcctgaacgagatagtccctatgtcacttgcc

SEQ ID NO: 179164 - DNA, 505 bp, Homo sapiens
  misc_feature (474)..(474): n is a, c, g, or t
attcagcaagccacgttttgatgatcactttgctcccggtttcctgctacaatgaaaaatgatgtagtaggcaccctagccgatatgtcttcacattctgatgttttacatttcattggccagagggcacatctatttttcattaaatatcaattgccagtttgccttgttaaaaaacgccgtggcactttagatgcccaggacagctcatgagaatgaggcagctcttaattccttatcatgctgcacatatgacacatggaggcccccagctctgccgtgatgagctgcgtctgctgaggagctcctcagcagacgcagctcataaacatctgggctattcaactagcagagagactgggctctggccacggctaagtggctcataccgtaacggcccactcctctgcctcagaactgtacaacactagaaggcagatgtctccagacaccaagcattgccttggctctgangctagacaccactttccgactgtggcagtga

SEQ ID NO: 179165 - DNA, 326 bp, Homo sapiens
tattagtgatattctaagttcatttctacaccaagtacatacagagccgttcaaatacaaaaagtttcgtcttctatctgaaatctcaagaatgaattatttcaagaaagaaaacaaattctagattccagtctccagccttttcaacaaagcttttagtcaacaaactacatgtttcattacagtgcctacagaataaaacttggggccggaggcggtggctcacgtctctaatcccaccactttgggaggctgaagtgggcggatcacctgaggtcagaaattcaataccagcctggccaacatgggtgaaaccccgtctctac

SEQ ID NO: 179166 - DNA, 104 bp, Homo sapiens
aatttgaatgagatttcccaggctgtattctgacttgaattttagcaacttctgcaatttttctaatcttttgggtgcctggaatactcagtatgagcggttaa

SEQ ID NO: 179167 - DNA, 122 bp, Homo sapiens
tgcatcttgtgctactataacagaataccagagactgcataatttataacagaaatttattttctcaagttttaaggggctgggaattccaagatccaagcaccagcatctggtgagagccc

SEQ ID NO: 179168 - DNA, 765 bp, Homo sapiens
ttattcagtgtgatccagtaagtgcttattacacacccaccttactctcagcgttgggctcggtttggcacagagcaagaatttcccgttcgtcttaattattcccagatggcatcagcggattcctgtttctaaccaccaaatcagtgttctggtagaaacactcctgtcttgtgacctctaaattacacactctccatctgcactgatttgagatgtagttaccacttttctgttcctccagagatgcctgcgtcaatgccctctaggtctgaagatggtcctgttgtgcggctatttcacgtgtacaggtgggactgaaagatcagtctgggactgccctctttcccctcagcacacacatgagcagctttgtgtttgcagcagctgcgtgcacgatcagcttccacttggctttgcttctgcccttacaaaccagctgatgatgatgacacagcatgttacactgttgtccccggttttcctagattccacgcacctttgtaatagaaaccgtggttactggatgccactgctgaaactactaaacacccagagatggcagtgattataagaacattaatcgtgggctgggcgcggtggctcatgcctgtaatcccaacactttgggaggctgaggtgggtggatcacctgaggtcaggagttcaagacctgcctggccaacatggtgaaacccagtttcttctaaaaatacaacaattagcccggcgtggtggcatgcgcctgtaatcccagctacttgg

SEQ ID NO: 179169 - DNA, 653 bp, Homo sapiens
  misc_feature (572)..(572): n is a, c, g, or t
gctactttttcccacagtaatcaccactagaacatgtgatttaatgttccagagtttgcctgcattcttctcacatgttgtggcccctgagtagctgggattacaggcatgtgcccctatgcctggataatttttgtatttttaatagagatggggttttatcatgtcgaccaggctggtctccacctcctaacctcaagtgatctgatcacttcagctcaggagtttgaggccagcctggggaacacagtgagactttgtctctacaaaaaaattaaaaaattagttgggcatagtggtgcgcacatgtagtcacagataatcgggaggctgaggagcaggagctacaggtgtaagccatcataaagtggaaaagccagataattttttaatttttggaagagatgggggtctcactatgttgtccaggctggtctcaagcaattcccctaccttggcttccccaggtgttgacattacaggtgtgagtcactgtgcccagctaagctgattgttattaatgacttaatcttccttcccccaaaataagaccagttcgaattgtaaccatncaatggtctctccttgcccactgtcagatagagccaatttatcaaaacaggggaatttcaatagagaaaccgtcgattcga

SEQ ID NO: 179170 - DNA, 167 bp, Homo sapiens
ttctgccactcacctcctcctcccaaaagcatctctggactagaaagggcttaccagccccacagagggttcagtcaggacccatgtgctactttcccctggcctggcagccatgttcggtcactgcccagctgctctctcttgatgcctttgtctccctttgtcct

SEQ ID NO: 179171 - DNA, 280 bp, Homo sapiens
aaggagtggaataggaatgtaatatttatgattggataatattccattgtatgatatatcatgttgtttatccatttattaatggatatttgggttgttttcaccttttggctactgtgaatagtgctgctatgaacattcatgtataactatttaaatatttgctttgacttcttttgggtatatacctgggaatagaataggtgggttatatgacaattttgtgttaactttatctttttcctttttttttttttccttgagatgacgtcttgctccg

SEQ ID NO: 179172 - DNA, 185 bp, Homo sapiens
gataattctcaaatcagtctccctaagaattcagaggctacggtttttaagggcactttggtagacaagggtctagagaatgggaaatactgattggttgcattgaggatgaaatcacagggctgtcagaactgtctttgtgcagctgagttcctgggataaggtcacaggtccaggtggcatca

SEQ ID NO: 179173 - DNA, 1277 bp, Homo sapiens
acctctggggctcaaggaatcttcctacttcagcctcccaagtagctgggactataggtacatgccaccacactcagctaattttatattttttgtagggacaagatcttgctatgctgcccaggctggtctcgaactcctgggctcaagcaatcctcctacctcagcctcccaaagtgagggccaggtttttttgtacataatattctatatattattctgtgcacttgaaaactgcactcaccagcatcatcaatcacgtcctaattgctagcccagtggatgtttggtggttctctggaatatctctgtggtgtgctcctctgcttgccctgtcttctttttcaccctgtcctccctactaggtgctgagtactgcctgatgctagagatagggcagtgaataagacagatacaacccctgccctgccctcacggagcttaaagtctagcgggaaaacagatcagttggcaaacaattttcactcaattgataagagctaccatcagctccttttaacccctccttcctggatttgtccaggtagctttcagccaatccctttcctcgacgaggtacctgtttcacatgtcctgatctttccttgtcctctcttaaggggtcttgtggattcccagtctggatgacagtgacccagactgcgaatatttgctaagaccaggagatctaaggagcccttgaagggagcctataacccagcttggcaggatcaaggaaggcttccaggaggaagggatgactaagcagctgagacctgaagaatgggcaggtgaaggtgggaagaaagaatgatccagacagaagagatgcatttgcagtggcttagagattagaggctggttcaaggcagcagacaggtatggctgggagctgcatgggggaatgtagagagaggagtctggagaattaagcaaaagtcaatcgacttgtgacaactggaaaggctccagtaagaagaagagagccattgatggcctagcacagtgcctcatacctgtaatccctgcactttgggaggttgaggcgggcagatcacttgaggtcaggaattcaagaccagcctggccaacatggtgaaaccctgtctctactaaaattacaaaaattagccaggcatggtagtacatgcctgttatcccagctacttggaaagctgagacaggagaatcgcttgaacctgggaggagaagtttgcagtgagccaaggttgtgccactgcactccagcttggacgacagagggagactcaatctca

SEQ ID NO: 179174 - DNA, 767 bp, Homo sapiens
gataaataaaacaggaaaaaagccctgttcacttgccatagaggatgatgaacaatagacgaatgtgaagatacacaagtgcagcctcaacacatgcatcatcatctcatttaaacccactgtactgaaggagaatgtgtggttcagagatgtcaagtaacaagcaagtgtgggtgctggtgttcccacccaggcctgttgacctatttatggcatcccgactttattataaagccctgaacaaatgcaaagagtgatgctaattgttgccaaaattgagtgaaatgaaatgcaggcaattttatgcggaatttttacttgtcagaaacaccagcctcttggatttgtagttttcttcaaagatgtgtctgaaaagtggaagctatattccttccactgatcatacttccctgagaagtaaattacattttgaaatgattgggtatttttttttaatgattaggaacattaaaatacatcttacatgtacagcttgactttatgtgtatacttatgtaaccacctaaataagatgaaatagttgattttaattaacatctgcttagccttgaaatctgtcgcagcttccaagtggataaaacatcttttggtccccaagaaaaactgatgtttattttcaaaacattttggtttgtgatattgatataaaggtagttgcactttcccaacccttccagcttccttggtggaaggtacttcccatgcttgcccctggaaaggcagccacatcatcacacacatgtcct

SEQ ID NO: 179175 - DNA, 645 bp, Homo sapiens
aggatcacctgagccagggaggttgaggctgcagggaaccatgatcatgccactgccctccaccctgggtgacagagcgagaccttatctcaaaaaaaaaaaaaaaaacaaaaacaacaacaaaacacaatgagatatcactatactcctatcaaaatggcaaaactaaaaaatagtgatagcatcaaatgctgacaaggatgcagaaacactggatcattcattcatggctgctaggaatgtaaaatgatacagtcagtctggaaaataattttgcagaccttttaaaactaaaactaaaactaccatacagcccagcaactgataacccttgggcatttaccagagatataaaaatttatttttgcacaggaaattgtatatgaatattcatagtaattttattcattaacagccaaacacagaaaactacactaatgttcttcagctggtaaatgtttaaacaaatgaaactacattatatgatagaatacttctcagcgcccccctccccgccccttaaaaggaacaaactagtgatatacacagcaacttggatgaaccactggggctagagagagtgggtgaggttatcaaaaagttagcaagagggagtcttgtgggtgacaggacagttaggtatct

SEQ ID NO: 179176 - DNA, 693 bp, Homo sapiens
agttcagtctgtgaagattcattattgatcagatatatacaatctgtaatttggaatattcattcatatttagttgaactttaacaagtcacaagttgttctccatagcaaaccgtaaaagaataaaattaaagttaaagagaggtctgtccgtcagcatattaaggtttgtctgttttgtttgcctcattaatattttgtttcccttttttctgatgtgatcgttttcctccaatttagatacgtctgcaatttattcttcagtctcatttacattcatgacccatgatcctcaaaacctataccttctctaaaaccttatctggaaccatggcctccctccactgtggacgaggcatcattctgtaccatacgccagttcctggttgtttcctctggcatcttcttttgtagctcctttaatccttcagactgcttagatcctatgatctgcccccataacacttactaattttatcttgcatttttttacattggcaagtattcgtttacttactcatgcatatttgccaaaagtctgcatttccattcaacaggaatctcattggtaacagagattacttaaccattaatattgatgatcaactggctggctgtttaaattgccactttcctattgaattttgaagggtgcccatggtgaatcttgtgtgtccctcatgcttggcacac

SEQ ID NO: 179177 - DNA, 398 bp, Homo sapiens
cccagaatctctggctgtactgattgatagggtcttctgaacgagtccaggttgtgactattctaatgcagaaatatcaacacagcatcaaggaaaatgaataaccaggtgaacatgttccagataaaggaacaatataaatcttcagaaacaaaccctaatgaaacatacactttgcctgatacagaattcaaagtagctgtcacaaagatgttcagtcaagtcatgagacaatacataaacaaagtgacaatctcaacaaagagataaaatggtaagaattgccaaacagaaatcatggagctgaagaacacaataattaaactgaaaatttactagaggggttcaaaaccagactagatcaagcaaaagaaaggatcagtaaatccaaagacagg

SEQ ID NO: 179178 - DNA, 235 bp, Homo sapiens
ttccaattctcacaaacaaatatgcaagaaaaaacatgccgttttttcttcacagatactgcaacgattatcttgagacataataatagaagctacatctactgtaggtatcctatgtggtaggcattgtgggtagttgcctatctctgattacaattaccagcaaagtagctcccttgcccatttcacagatgtgtaacttgcctagtgacactatataagggcatatggctag

SEQ ID NO: 179179 - DNA, 537 bp, Homo sapiens
cccacttctgttcaacacagttttggaagtcctagccgagcaattaaactaggtaagaaaaaaaaaggcctccaaatttgaaagaaagaagtaaaattatctctgttcatagatgatacatgattttgtatgtagaaaatcctaaaaattccacacaaaaatctattcgaactccaacatattcagcaaagttgcaggatactacatcaacacaccaaatcaactgcatttctatacagtaacaatgaacaatctgcaaaggaaataaaacaattccatttacaatagcatcaaaaagaataaaatccttagggatagacctaatcaaggaagggaaaaatctgtatactaaaacaataaaacactgctgaaaaaaattaaagaagacaggctgggcgtggtggctcacgcctataatcctataatcccagcactttgggaggccaaggcaggcagatcacttgaggttaggtgttcaagatcagcctgggcaacatggcgaagccctgtctctactaaaaatacaaaaattagctg

SEQ ID NO: 179180 - DNA, 175 bp, Homo sapiens
acgaaatgggacaagaaggccaaaaaccaggtttttcagattcataggagcatttggaaatttggagtcaagaagctgagaaagacaagagattggggatcttgggtagggaggagagtgagcatcagagaatcttcgagttatgtggattgacttttcaagtagtcacccactt

SEQ ID NO: 179181 - DNA, 235 bp, Homo sapiens
ctacctcattctgcaaaaaaaagttcataagggctgttaagaaacatttgtatagagcactaaaagtgcatcaggaaaaggttttatataaatgttaactccaaatatataataaagatcttttatgtctatacattttttaaaagatggtaccctccttgacaaaggatggtatgcaacgtcaagttttacatcctaaaatacgtatcaggttccccatccagtagtacaaagt

SEQ ID NO: 179182 - DNA, 499 bp, Homo sapiens
aaatactatttggacacaatgtataattcttctatttaatagtatgcagttttcctgctaaagaaataattttagggctagaaaagaatatctagtatctttgtagattaaaaaaaaaccactcaacacacagaagagacaaaatgcaaaacaaacaaaaacccttaaggccaataaagcctagatgatttgtttaaggtcacactgcttgttaatggcagagtcaaaaagaaaaaaaaggcaggtctcacaatcccttggttcaactgattgtcggctaagattttacttagtaagtaattttgtaccagtactaatacgcaatatttgacgaacatcttcccctttttttttttttttgagatagagtctcactctatcacccaggctggagtgacatgctgtctcaataaataaatacattcatctgaaaatgatgaggacagacacaaacacaaagaaagccatcaagaagcagaagtcactcaagatacaggtc

SEQ ID NO: 179183 - DNA, 676 bp, Homo sapiens
  misc_feature (674)..(674): n is a, c, g, or t
cttttcccctcaaaatcagtttcctagttttttgtttttgattttttgtttgttgtttttgagacagagtttcgctcttatatgccaggctggagtgcaaatggcgtgatctcggctcaccataacctccacctcccgggttcaagcgattctcccgcctcagcctcccgagtagctgggaccgcaggcatgcaccaccatgcccagctaatcaaaaaaaaattttgtagtgatggggtctcactgtgtttcccaggctggtcgtcaactcctgggctcaggtgatctacccgccttggcctcccagggtgttgggattattgtcatgagccactgtgcctggcccagccatagacttcttacagttgaaatacaatgatgattttttgcatcattagtcatggttaaatgccatgtgagaattatgacatacaacatatttttattaagtacaatgtttgttgtaggttttgtgggtttctcttcaaaacctttgccagttttggggggtttgggttaattattagtggaagggtgggttgtggtattgtattaaaggtcagtggtgcatttataggattaggagtatttttaatttatttgaggggaaagacctgggtacgagctcgaatcgaatatgtctagtgttctgttaatgattccgcaaaaaaggngg

SEQ ID NO: 179184 - DNA, 204 bp, Homo sapiens
tccacttcaacactagttcatttccatgacacttttgtgtcatgacagtttcttttcctcaagttacaagttatgcaataagacaaacactgttgatggaattattaaggaggagttacagacatcaatcaccatttgatgtaatgccagacatccaaaatggagcttctgtccaaggatcaaaaaacataagggagggccatg

SEQ ID NO: 179185 - DNA, 335 bp, Homo sapiens
tggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaa

SEQ ID NO: 179186 - DNA, 715 bp, Homo sapiens
atgaaatgtctagaacaggcaaagccatagagacagaaagtaaatttgtagttgggtagtgggctaagaggtagagggtttctttttggggtaatgagaatgttctggaattaaatgatgattgcacaactcaatatactaaaaaccagtggattatatactaaaaagcgtgaattttttctggcgtttgacttacattgcaataaaactgttataaaaatagtaaaattaggtcactcctaatctcaggcactccctgcttaaaatgtatcagtggtttcctattatatttcatataaaattcagattccttatcatgaccttcaagaccctatgcaaccgacccctgccttcctctgatctctgcttcacccatgtgctccagccacacaaatcttactattcattagagatgccactttggtttggatgttctcattcatgtcttcctttctaaagtgtttcttctcagtacatatatatttactttttccttctcattcactagtatattccataagggtagggatgctgtctcacttactatactcccaacatttatgacagattctggcacatgatatctacttaataaattctttttgaattaattaaaaatactgtagagttttagttatttttagttattggggcgaaaggatcacttgcagccaagagttcaagaccagcctgggcatcatggtgagaccgcatc

SEQ ID NO: 179187 - DNA, 779 bp, Homo sapiens
cctgtggtcccagctactctggaggctgaagtgggagaatcacttgaacccgggagcagcggttgcagtcagctgagatcgtgccactgcactccagcctgggcaatgaagcaaaactctgtctcaaaaaaataatagtaacaattagattctgcgcacagtccataaaactatgccaagtggaatttgggtttccagagccattctatccttactgttttagtccatataaccttatgtattatttgtgttttttgtttttgagatggtcttactctgtcacccagcctggagttctgtggcacagtcatagctcataatagcctcaaacttctgggctcaagcaacccacccacctcagcctcccaaacagcttgaactacaggtgtgagtaaccatgcccagctatttttttcttttttgtagagagtgggactaactatgttgcccaggcttgtccagaactcctggcctcaagcaatcctcctgacttggcctcccccagcagtgggattacaggcatgagcaccacatccagcgcttacctagtcttagacaaaacactaataacaacaatcacaagtcctggactgctcaaaccaagttaggacctaaagataagaagacacaagaccaacgaaaggcctgtaatcagctcagtattaaccatccagtaggcaggacaggaactctcaatataggaaactcttttctggtgctgtatcctttatccactattactggctacacgcttaaagcaagaaactcctgggcaaaca

SEQ ID NO: 179188 - DNA, 714 bp, Homo sapiens
gggctcctctcgaattcgacggtttctcatgaacatcctaccatcgagagggcccttgctgtagctggtgaagacaaaatcttctttttaaaaagctaataaagattttcaaattgggatcttttacagatcagattttacctctaaacaacaagaaaaacagtttaaatcaacaagaacattagagccctaatcagaaccacaagatagggattgactcctgaaactcgcagatgtctctagtaatggaattggtctgtctaatgtgtttccattctatttccttggtgcagaagaaatgctgctttagtgttcttgtaggtttaaaaaattaataaacagagattaagaggaattactggatttgtttgctgtgtctaagcaatatatctaattagacagtacaactaaaggaatatggggagctaggatacaatgtgaattgatttgtagtactaggttaaggcatgatgacatctggaaaagtgctaaatttctttctttctttctttctttctttctttcttttctttctttcttttcttttcttttcttttcttttcttttctagtattatttctgaagagtggtcagctaacttttcttttctttccttttttccaagacgcgatctcgctctatcacctaggctgttgtgcagtggcatgatctcaactcactggaacctttgcctcccaggtttaagcaatcctc

SEQ ID NO: 179189 - DNA, 822 bp, Homo sapiens
tcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggt

SEQ ID NO: 179190 - DNA, 350 bp, Homo sapiens
agatgaccaaggcttttggattgagaaactagaagtatagaattgttataactgagatagtaaagtctgaatatggagcatgttgagcaggaaagatcaaaatatatttagttttcaagatgttatgtcagagatgtgtatcaggcatccaggtggacatactagcctagagttaagaggagagccaggctggagatagagatgggaactcccagcatactgagcccagacgagctaactaagggatagctcaagcgtagatagagaagagcaaagtcccagtgaccatgacctggggcactctaatattaatttggagtaaagaaaagctagcaagagtctgaggagga

SEQ ID NO: 179191 - DNA, 273 bp, Homo sapiens
gaatgactactaagtggtatggggtttcttttctttctggggtgatgacaatgttctaaaattaaatggtcgcagaacttggagttgactaaaaccaccaaatagtatactttaatagagcaaatcgtatagtatgtgagttatgtcttttttttttttttttttttggtgggtttctagacagggtcttgctctgtcatccaggctggagtgcagtggtgcaatgacagttcactgcatcctccacctcctggacccaagcaattctcctac

SEQ ID NO: 179192 - DNA, 338 bp, Homo sapiens
gtttatctcaccaaggcaaaatgctacatatagggcagtttattttttaaagcattttttgctagcctccttgcagaatcagcctgatgtatatgaagccaatttctacagacttgctctggtatatgcagcacaagagccagaaatattttttgtagtctggatctaagtactttctgaaatgtcttcccttgaaagattctaacttagcactattctggaaccacatgaacatctgagcagaactacgtcttttttgagcaacattaacagtgatgaaaaatgcacatcaggcagttagattgcaactaatcaagagcaccacttcagcctagtat

SEQ ID NO: 179193 - DNA, 410 bp, Homo sapiens
gctacaagatatcacttcactcctattaagacaactaaaaccaagaagacagataataacaaatgttgacaagaaatataaacgctcataaactgctaagattgtaaaatgggactgccactttggaaaacagtgtagcagttcctcaaaagattaaacattaagtgaccatatgactcagcaattctactctcaggtatatacccaatagaattagaaatatatgtgcaggccaggcgcagtggctcacgcctgtaatcccagcactttgggaggccaaggcgggcggatcatgaggtcagcagatcgagaccatcctggccaacatagtgaaaccccatctctgctaaaaatacaaaaaaaatagccgggcgtggtggcaggcacctgtagtcccagctacttggaag

SEQ ID NO: 179194 - DNA, 260 bp, Homo sapiens
atgactgcaaagacagtaaactccttgactcatgcatttatttattcctcaaacaggtatcccatcccattgtgttataataatctattaattgtttttcccagtagatactgagattcttaaaaataggaactgtcacctgggtagacctagtgcctagcacagtgctgagcacacgtatggttttattcctaatatgaattcaaggaaggaaggtacaagtgaatttctctttcccattgtcagcatgagtcgcctct

SEQ ID NO: 179195 - DNA, 681 bp, Homo sapiens
ttcactgaaaaggtctagaaataatgaccagcccagtcattgagcatccctagcactcaaagggacccagggatccttgaagaaatagctgtctccagacctgagactggcagtactgcagatgagcctagaatatggtatcaaaccagaaactaaggagggtgtcaaagattactagagtcctgtcaaagagaaaaacaaatctgatcaggcctctagatctacccactaatttaaaagaaatttgggggacagagggacatcttcaagggtaccacagaatcctatgggggagtactactggatgagtgacctggtttcttcaacaaacaatttgcaatgaaaagcaagagatagagagggaaactatgaagtaaaggagactataaagagatgtaacaagttgcacttacatggactttaatagatcccatttcaaatggggggaaattgtttagaatattataagctggaactggagaggtgaatattatggcacatgcaggactttcctgtgtaaactagtttaattttgatgataattaagtgttgtggtgattgagagaagtcttacatttggatataatatttatgtgattgaattttccatggatttcttcatattattttctatatctcttatattattcaaagttaattaagaagtttttaaaaagacgg

SEQ ID NO: 179196 - DNA, 286 bp, Homo sapiens
taaatacaatcatcctttcaaaggactattaggaaagctatttaactttaaagattgataaagattgaaaaagctctttggagaactagactatcagcaaaacaaagaaacttattttacatgctaacagcaacttgatcaactgcattcaagaccaccgataaaacacgtcagtctgcctcaaagtagctacagtaacacctgggttccatttaaagagacccactctctcctttttaaccatcttaaaatctgttccaaaatttgcatgtttcccatataatgt

SEQ ID NO: 179197 - DNA, 373 bp, Homo sapiens
tagctcgggcaggaaggtgggggacaggaggagaaagccgttcaaatgaaatgcaaacaagaacacagaggctggctcagctctttgcggtccggcaaggcggcggtgatgaagcagagtccccggctagcagcaggctgggggctgcagaggagggggcagccccagacaaggccggctccttcgaggggctcaggcgcctaaagcttgcaccccaacccccaattccacaagtaggtgcccgtggcacacgcagcccggacccaggccaccacggccaacctgctgaggggctgaggggtgttagcggcccttgcaggtcctgccctgcctcacatactccagggcacacaggacccatttccactcactg

SEQ ID NO: 179198 - DNA, 234 bp, Homo sapiens
cactcaatggtggacttttaaaggttccatcccgggcccttgtcctctcaaaggcctcccctgtgtatccccctctacagtgcctgtcgtttcccgttactcctcctccagtggatcattccaattacagggcctcggttaggtctacctggccaggtagaactatccagtaaaagcaaaagcccaggaaggggacagaggggcggcccgataagccatggcgcagggggagag

SEQ ID NO: 179199 - DNA, 611 bp, Homo sapiens
cttggtggcatgtgcctgtagcagtcccagctacttgggatgctgaggcacaagaatcgcttgaacctgggaggcagaggttgcagtgagctgagatcgtgccactgcactccagcctgggcaacaagagagaaactccagtctcaaaaaaaagaagaagggggtcgaggcaaagccctggagcagagaaagatcagtcagtggagacaggaagaaaaccaagatcatctcagggatggaggattcacttaactatgctgaatgctacagagaaagataccattacagaaacagacatactgataaaatttggaaataaggtcactggtaacttaaaaaataagagcagtctcagtaacatggtgacaaagaagagtaactaggatgatttacagtagacaattatttgcatgtaattattataataaatattttttaaaataaaattattttaaacattttgtcagttcccccatatgactgatttcccagagggagagaaccatgtcatattcatctctatgttcttagcaaagtgctgacacacagtagatattttaaaaatctgaatgactactctttcaggaaaacatcttctgaggaagaaactc

SEQ ID NO: 179200 - DNA, 335 bp, Homo sapiens
cacagtgtggcatttgcaagtcattgggtgtgtccattttctgggggtggggtgcacagctttcatcatatttccagaggggtcctcagcccctaaaagcaataacattggcatgtgggcagttctgggtttcagggagagccctatccagcagttgtggggctggtggagacagtcaagggtctgctcctgggatccaggcaggactgtgaggtggcactggagcggtgaggactgggtggagggcaaggggaagaggttggcctaggagctgcttcccccatcgccccataaggactcggggactacctcaaacattagcatcccaggggagc

SEQ ID NO: 179201 - DNA, 509 bp, Homo sapiens
tacttgacaacatgataatggagtcctgagagtctaaaatttgttatggaggcagtgagagagtgatatttgaccttgagtctttcttgaacaaagaaaaattcttttatctcctggggatgttaaaagaagaatgcttcagggtctaaaaccaaagcaagaaagtaatttttttaaaaaaagagtgctcaaaagacggaatgtggaaagccacaagagttgcttgatagaaaagtgctaagtgggtatgcgtggtggttcatgcctataatcccagcactttgggaggccaaggcaggtaaatcacttgaagtcagcctggacaacatggtgaaaccccatcgctactaaaaatacaaaaattagacaggcatggtggcgcgctcctatagtcccagctacttgggaggctgaagcacaagaatccttgaacccggtggtggaggttgcagtgagctgagatcgtgccactgcactgcagcctgggtgagagagtgagattccgactc

SEQ ID NO: 179202 - DNA, 394 bp, Homo sapiens
tagatatctcagtatgcatatgcaaatatttaaaaaatctgaaaaaaattcgagacacttatgcttctaagcattttgcataagggatagtcacccggcactacctagagttttctttttcctttgttgtgagccacatgtaatgtgcctcccattccctgctcactgattttctcccctctaattttagtttcagaaacacaacagacctttccataatgcagctagattgtggttggctctccctatatactgtctgcagactacactacgtggaatgtccatggctataatatgtttgttacttgtaacttgtgaatatatcatttttcctttcccccataccaacagatctaccaattccagcatgaaagctattaactttagggcgtaa

SEQ ID NO: 179203 - DNA, 724 bp, Homo sapiens
atatttcttcaaataatctttcctttttctgtatctcttcttcttctggaactcatacaatgtgtatattaggccactcaattatgtcttataaatccctttaggccctgttcactttcttccatttcttttctttttttttctgactcaatgatttcaaatgacctatgttgaaactcactgattcttttttctccctgtttgagtctgctgataaatacctctagtgaatttttcaattcttttattgtatttttagctccagaattttttatatagtttctatctttttgtttatattctcattttgttcataaaatgttttccaggcttcctttagttctttgtttctattttcctttggctttttgaatatatgtaagacagttgttttaaagtttctgtctaataagtctgttgaatgtctcatcagagactgtgtctagaaatttaatttattcatttgaatggccatcttcccctatttctttatattctttgtcatcttttgttggaaatggaacattacaatataacatctatcccagtctttgaagactgctatgaaggcctttactaactagggggttgttgagctttgagatcagtcaggagtcaatgcttaagggcttccctggtcttttgtgggtatgagttctgtctgggcttctgtatgtgtgctgtatttccccccagtttacctgagattattaatatttaaaac

SEQ ID NO: 179204 - DNA, 408 bp, Homo sapiens
tcaatattgtcaagatgtcagttcttcccaacttgatctattaagatcaacgcaatcccaatcaaaatcccagcaatttttaatacacatcaatgaattcaatctaaagtttatatggaggggcaaaagactccgaattggaggactgacactacctaacttcaagacttaccataaagctacagtaataaagacagcatgtatcaacgaaatagacacattgatcaataaaacagaattgaaggcccagaaatagacccatataaatgtattcaattgattttttgaccaaaaaacgaaggcaatacaatggagaaagtcttctcaacaaatggtgctggaacaactggacatttacatgcaaaacaatgaacccagaaacagatctgacatccttcacacacaaaa

SEQ ID NO: 179205 - DNA, 430 bp, Homo sapiens
gaccacctgttctgatttccctcaatcccatgagaactactgtccatgtccacttacgtgaggacagagcttggtccctggttgcatctaagcaaagaaaagaactgaaagcgaacttgggggcatcttcctcaatttcttcattttgcagatgaaaatccagagaagagagtgacttgatcaaggtcacagggcaaataaagggacaatataaacacagtaaagggggtgagtatcaaatacaagagtcttattttctttctctatatgtgttattaacctagaccaatcagagctcatgcagagaaaaggcaagacttgtgagaaaaagatgttgcaaaggaaggaaagaagtccagagaagcttggctgccaacttcagtgctctacaggactgtggaaagaagaactgaggcacgcatcatgtcac

SEQ ID NO: 179206 - DNA, 434 bp, Homo sapiens
tgcacactcctgcctgtgaaaccacaataaaggctcttgcccacattttcctttcactcccactgcctcctgactgactcaggtgcttccccatggggcacccctgcacgccatgccatgcctcatgcatgtttctagggaactgtgagtaaatgtcttcctccatgaaagtgattcctgtgtctgcacgtcttgccacacctgattaaaacaaaccctggctacctttacaacccccaggtccatccagccttctgagccaccaccctgacttgatcgagcatcaggaatctcatttctgggcggggtgcagtggctcacgcctataatccctacactttgggaagccaaggctggcagatcacttgaggtcaggagtttgagactagcccggccaacatagtgaaatcctgtctctactaaaaaaaaaaaaa

SEQ ID NO: 179207 - DNA, 358 bp, Homo sapiens
gagaaatgagtgttccagagagttgttatattgtgctgtgttgtaaagctggaaaaggctaaggtgaaataaccctaccagtaagaagagaataactgagtttgctagtttctgagttaaatgctggccaagtagaaagaagtttttaatgcaccttctggagtgattttcaaatttttttgtgactctcaggccttgactatgaaatacggaaggtgatttcttaaaactaaataaagttggttagtgaggtaaaaaaagaaaagaaaagaaaagaaaattgataaccaaccatattactatgaatgtaaaatatttctgaagcaactgctctatgaacaagagctcaatgcagaga

SEQ ID NO: 179208 - DNA, 420 bp, Homo sapiens
tagggaatattcatttattccagcaccatttgttaaaaagccttcttttccccattgaattgtcttagcgtccttaagaaatagttgtacacatatgtgtctatttcttgacttcctattattctgttccacttatttataagtttatcttttaagcaataccaaactgtcttgatcactgtaactttatagcgttcttgaaatttggtaggatacgttttccatctttgttccctcttaaaattgctttggccagtctagggcctttgcattttgatatgaagtctggaatttatttctacgtattttatgtttttggcattattataaatggaagtatacatttttttatttcactttccagttttttgttgctggagtataagaatactgttgatttttatatattaaccttgtatc

SEQ ID NO: 179209 - DNA, 377 bp, Homo sapiens
agttgtgttgctctgtgactagatggtaagagaaagagagcagccttacagtcggtttgcctgaaaatgataccattgatttaagtgagatgccacaatctacccagtttccagaggaagatctctgtttttgataaaatagaccatgaacaagtcagagcaaaggggctgttcctagatgcaaatgagccctcacaggaggtctctggggtcccaaaacaaacgcagaaccatgctgacagttgggtctgagttctagggcatgttctgtcctctcacagggccatgtgggcagccagccctcatcctttttatagtccgcttgcttttaccggccacagcatacccatacaaccaaaaaatctcctgtgccaaag

SEQ ID NO: 179210 - DNA, 318 bp, Homo sapiens
aggagactgtaacttcccacacatttcctctggctttttcagttagcatagagaaccaaagttcccacctatggccctacaaagaaaggctaagtattaacaaagtaattctatgttaaaacttcttaaggaatggaaatatcgagtatgccaagtctttgtttctgacaaacaaggagatgccgggctgtaggactgctgagaaaacccgataactttcccaagtacacaacaacgcgaaagacgttaatcaagcccaaagttctctagcccaaggttcccaaagcccaaagaactttaactgcacttagcacttat

SEQ ID NO: 179211 - DNA, 376 bp, Homo sapiens
gaggccagtgctgctggagcacagtaaggtagcaggagagaggtctgaagtccgaatgataggctggggtcaaatcacatagatctagtaggatttggtaaggacttcagatatttagtctaaaagtggtggagagctcttggaaggttttgagcagagaagtgacatgatctaatttatgaaagaataactttggctgctatgtgaacaataaatggcaagcagcaagagtggaagttgggagtccagttaggaagtgactacagtagtccagatgaaaaatgatgatggcctggaccagggtggtggttgtggaggagtaggaaatcactgagttacgaatctagtctgaaagcagagctcacagtacatactg

SEQ ID NO: 179212 - DNA, 400 bp, Homo sapiens
aaaaatttttgtctcttctctttgggaatcatactccaagttttttgctaaaatcatttacttttttattctggtgggcttttcttcttatctagttattccaggtggtacaatctgagcaatgggtataaccagaaactaaaaagatgaggacagaatatccccaattaacctcatcttcaaccaactcagtggtattggttgccaagggcttgaaaatgagcccctcagagggaacaggaggactgcggtggagacagtgtccacacattcacacaggcaaccagcaatttgaattaattcctgaaaatgtgatgttgcctggtgtttaaaaagtaaaacaggtgacacctctgtacacctgcatcttttctctttagtggttagttgctcatgatag

SEQ ID NO: 179213 - DNA, 670 bp, Homo sapiens
gcatccccatcaaggagggcacatagcagaggcagggcagccaggccagggaggctgtggaagtgacttctgtcctaggagggagctggatggccactcttagaggtccctttcaacccagaaagtctgaagttttgagatggaccccaggttctgttgctgctttgaagcttctgagattggtctcagtgtgattggctggaaggttccaagattgttctccaggccctgaatttgatgccatggttcagactgtgaccccactactccaaaatagacctcaaaactctgtggctgtcttcagggctttgagattgactccagtgtcgtaaggctctgagcctcttctggagcttctcagtgtgatccaaggttctgagacagacttcagggttctgaaatagacctcagggttctgagattgacctcaaggttcagagatagacctcagggttctgagattgacctcagtgttctgagatagacctcacggttctgagattgacctcagttttctgagatagacctcaaggttctgagatagacctcagggctctgagattgacctcagggttctgagatagacctcaaatttctgaaattgacctcagggttctgagatagacctcaaggtcctgagatagacctcagggttcagagatagacctca

SEQ ID NO: 179214 - DNA, 523 bp, Homo sapiens
tagtggggggtggggcagaagtagggatagttaatgggtacaaaaagaagttagaaagaatgaagacgatctagtacttggtagtgcaacagggtgattatattcaataataatttcatgatacacttaaaaataactgagtataattggattgtttgtaacaaaggacaaatgcttgaggtgatggatatctcatttatctgatgtaattatcacacaatgtatgcctgtatcaaaatacctcatataccccataaacacatatacctactctggacccacaaaaattaaaaattaaaattaaaatgtaccgcatctgagagaaccagatcatctcccccacggcttaacatcctccagattttctagctaaaaaagtagataaggctatgtccatgaccaaatgttcataattcttgctaagatgcagagcccaaatggaaagaaagttattttacattttattggaatcactaatttgcctttcttttgtttgtttgtttttgaaacagaatttcactct

SEQ ID NO: 179215 - DNA, 301 bp, Homo sapiens
gaagcagctttcggagaaaccaaatgtcaggaaactgctggcagctgatcacaggcctgccgaagccaaacgcctccttcccactcttcgcagtgtgtcctcgacgaggccaggggcagaggagctggtacactaacagcctgtcatggtggctcctggactaagaatgccttcctgccctttcatcagactgcatctgatttctttttttgaggtggggccttgctatgttgctgaggctggtcttaaactcctggcatcaagcggtcctctccccttggcctcccctcctctgtgctgt

SEQ ID NO: 179216 - DNA, 541 bp, Homo sapiens
cagtctcattattcattaaaagaagatagtgtcataccaaagccttcctccttcaggaagtctttcccaatcatcagagccaaaaataatagtattctataatatgttttatttgaggtcactatcctatttttgcatatttattttaacatcatcttccttgtagtgtagagttgttataatgctgttttctttgaaaatttaagaaaaaaattcatcaaaatgtgctactcatatagctctctttcccatgacctgagggctggcccatgaaagccaacagagcagccagattccagcattcttggacattgtcatggcaccatattgcaaattctccctgccagaggaggtgctgccatgctagcctgagctgagtgcactctgcagcgtatatggcttattacatcagatctgctatatgccatgtgtttatagacaacagttttaagccataatgactgaaaaaaaaagtctgaaaacgacagtgctgcaaagaaatgcaagagtgccatgctgaatgttaaaaggtaagttttag

SEQ ID NO: 179217 - DNA, 246 bp, Homo sapiens
cactgaaaccaaataaaacagaagagacaaaatcctgcagctcgctctggcccaaacctttgctagggcaggcaatcacaaatgagcaaattataataattctaatgaccacgttcccgcaattgacttggaaatgctggattaaaaaaaaaaaacttcactcctgatccacaccctggggacaatattatctccccagtgtcctacctagcccacaactacttatgtctcatgccagactgagcc

SEQ ID NO: 179218 - DNA, 812 bp, Homo sapiens
tattcacctctccattcacatgtatacttataagaagaaataaaagaaagatttttatgacataaagaaaaattataaaacttaataacattaaaagagatttaaaccaatgggaaggtaaggtataccacgttcataaacagaaagagtccagtagtttaaagctaccaagttctctcttaaaacttaagtcaaaaacttaccaagacttttgtacaacttgacaaattaattctaaaattctaaattgattctaaaatttttgtgaaggaggaagagctaacaacagccaaaacacccctgaaggaatgggaggagaaagcagaaaacatgtcctattggatgtcaagatctttgcataaagcactttagttagaaatgcaattttgacttaaagatagaaaaataaatcaattaaatcagaagagaattagcaaaaacagacccacaaatatatggaaatgatatataataaaacttacagtacaaataattgtgtaaaggaaagacaacttaatgatactagaaaaatagttatttatataaaaaattaaattagatttctctctgtgtataaaaatctattccagttaaagtcttaaatttgaaagtgagtcattttagattttattttaattttagaagacaatataggagaatatctatatgacctttgggtggaagaaaattttataaccaagacacagaagtgctttcataacataaatttgtatctatttaacatttcataaaatatactattttgcatttgctagaatgacaataatttaaaagcctgctgatatcaagtt

SEQ ID NO: 179219 - DNA, 628 bp, Homo sapiens
cctggctaattgtgtatttttagtagagacagggtttcaccatgttggccaggctggtctcaaactcctgacctcaggtgatccgcctgccttggcctcccagagtagctgggattgcaggcatgcaccaccacgcctggcaaattttgtattttcagtagacacagtcaggctggtcttgaactcccgatctcaggtgatccacctgcctcggcctcccaaagtgctgggattacaggtgtgagctactgcgcctggcaacatataagtcctgttaacattcccatggcataaggagacaaggggttggtggcttcattgtctgagaactgtgtcctgtctcctaaggtggattttttttcagctccagagaaggcgagaggaacatagctacacacctccaactccccggcctaggatttaagctgcagtttaggacggtgagactctgttcccaagcaggtgcccagctagcacatcctggcacatccaccagccccaagggactcagctcacgtcagcaggagcccagaggcctggatgggaagaggacactccctggggccctgctgtttctgtttcaagacccgatgtcccctgggctgagggaggacagaggggaggggac

SEQ ID NO: 179220 - DNA, 382 bp, Homo sapiens
ttgtttaacatgtgaaatatcttagtaccctgaatttcctcctagatgatagattttaatggcatcgtttgaactatgatttaactcaaaattaaattgtattttaagatcttctaaagtgacagatttggttaaattatacatcatttagtggtgtacatattcatgaaaaaaactgttaaactagaaagattactttttcttaagtttcttcattaatatgtactgtatttgctatgtattcattcattttgtttggatagaatgacagacaagtggtagtagaatgacagacaagtggtagtaggcaccaaaggtgctttaaaaaaaatttatgggccaacattcatgaactaagtcagcagccattaaaaatgacata

SEQ ID NO: 179221 - DNA, 707 bp, Homo sapiens
ggattacaagtgtgagccactgcgcccggctggaatatgccttttaatcttaaactgcaccacagacccattctgccctgccaccttcaaattaataggattgttgttctcaatcttgcctccttctttgggctttctgtcagccagagtcttcttagctgccacttcacaaaacaggtgccagttctgtgccaaacaagcacacaagctgtaccctattaaatcattttaaaacataacagcaaggggaaagagattgagtggactaacatattttggttaggatgtggggaggggagagagtggaaggattataccatctgaatcttaatgttactgttcgtgtactgtttgatgcatcagacttccttgctggtggtgtagttatgaggaccatagtgaggatgagcaagactgctcagcaggtagaaggtggagccagcacacacttttcttttggagaactgctggaacctgactccagctataactgcatttataaccagttataattaacctactgagcagctatggatggtatctgtgtttcttggacagagcacgtgtggggccagagtggatctcaccagtgagtggctggtttagggataacatagttgtcagtctggcagtaacatgatcattaccttatgaatatttaagatttatttggggctgggcaccgtgtcccacgcctgtaatcccag

SEQ ID NO: 179222 - DNA, 415 bp, Homo sapiens
gtgaattgtgtattgcagattcaacactagaaagcccccatcacacaccacttgggtaaaaaaaacccccaaatttcagaactcctctcagataccaggactattcaccaggtcattaagaagcaacagatgctgaaggggagaaagaggacaaagtgccagcgagtccaccctgctgatcccgctgatctgcttggcttagagaagagctgtttcacgaaagaggagaaagtttgccaaatctactgctggttaagtttttttcccgaagcaaataaggtagagatgaatttcttgaactgccttgtttttcttgaggcggagtttcactctgtccctcaggctggagtgcagtgagctgagaatgcaccattgcactccagtctgggtgacagagcgagactccatctcaaaa

SEQ ID NO: 179223 - DNA, 444 bp, Homo sapiens
cgaggtaggtggttcacctaaggtcaggagttcaagaccagcctggccaacatggtgaaaccccatctctactaaaaatacaaaattagccgggcatggtggcgtgcacctgtagtcccagctacttgggaggctgaggcaggagaatcgcttgaacccaggaggcagaggttacagtgagctgagacccagcctgggtgacaagagtgaaactccgtctcaaaagaaaaaaaaaaaaagaagaagaagatgatgctgactaaatatgtctgagtggatgcacacatgagcaaacaggccaccaagctctcgacagttccacgccctccttgcagacacccagtgttggggaccactgtggcctccccacttcctgctcatggatcagacagatgacctggaggcacagtgatgaccgccacccccacccccacgctggccaca

SEQ ID NO: 179224 - DNA, 412 bp, Homo sapiens
aaattaacgttttcccccattgcccacacatagtaagtctcttatgatgctgctgattagagaagcaaaagttgccgctacaattctcttcctgcattttaatataaacaatcatcagtcttttcttcatagagtgcagtgtgggcactatcatcagaatgtaccagcactgggtgtacaaagtttacaaagattagcaagagcaaaagcgttgagatttttgaaattcatgctgctgcaaagaagtatgtaaaaactcactcactatagaggaccacacagaaactcaggcatgaagttatatggctgtgtgattggtttgggagaaggaacagaaagcacttccaccaacctatatgcctgagcaaattaatgcaaaacctcagaagctacaaaaaagtttatctaccta

SEQ ID NO: 179225 - DNA, 596 bp, Homo sapiens
tgcatattccatggtccaggcagttcctctcataacgaactatcagacagaaatacttgtaaagatacttcatttattttgaaatatttttcctcttctaatgtattcatttattcattcaacacttatttttgagctcctactatgttccaggcactcctctagcaaacaaagcaaattctctcctctttttcaatatttgtggaaaaagcaaggtctccctcttgtagagtttatattctagtattttcataagttatacctgctcactggagaatactgagccatacagaaaaacacagaggaaaatttcacttatatttttccccatgtaaagataaccactcttaacatctagtatatgttcttccaggatttttctatgcacacactgaatctgtatttttatttttaaaatgttatcatattgtatgtacctctttgcagcctgcttttttcagttagttttttttgtttttttgtttttttttttttttttggaaaccaagtcttgctctattccctaggctggagcacatgagccgagatcgcgccactgcactccagcctgggcgacacagcaagactctgtctca

SEQ ID NO: 179226 - DNA, 267 bp, Homo sapiens
cgaccggatcttgtgagacctcactatcatgaggacagcactaaggggagggagctaaatcatccatggaaggtcccaccaggcaccacgtccagtattgcggatcacagttcaacatgagatttgggtggggacagagatccaaactgtatcaagaattattccatttcttctcctcattgagcctttgaatcacaccacttttcctattttcagtcatcattcctgtgactataaagagtcagaaccacacgacagttaactctc

SEQ ID NO: 179227 - DNA, 444 bp, Homo sapiens
tgaccttaggaaaataatgcaacctctctgagtctcactggaaaattgggttgatacaggtacctactgacaagtttatgtgaagattagctgagataatatgtggaaagcgctagtacttatggtgcaatacctgccacttcgtaagcatgcagcgagcggtggctcaccatggggaggggtcttccatatttagccccacccacctcctccatccacaccaaatcattctggcaaagccccagcatatacaagtgtacagatcagagtcaacattcagaaacttaatggctgtgtctatgcttacatttttgtataccatggttttgtttttttaactgatagctacagtccttattacggttactagctcttcaaattttcacctgctaaacccaaaagttaaattatactcatttttattttgtcctcagaaccagtgat

SEQ ID NO: 179228 - DNA, 241 bp, Homo sapiens
aacatgccagtacaatactaggaacaaagcaagtccttaatccatatttatttaactgattgcattatgaaattaaggaccctaattctcctaaatttaaagaatgcttaggtgagctactcttagaaaagtcaccaaaccaattaaaactggtatcacaataagatgagtgactatactacacagtctaaattccacatactactcaactgtatttgcctacagacaagacagaccaagg

SEQ ID NO: 179229 - DNA, 217 bp, Homo sapiens
atcacttctacacaattaagctaaaaataaattgtcttatatggaaaccactgctgagatttttctaaaacataactctagtctttgggtaatattagcttaacattttgtagattttgaaatgtatttactatactaaatgcagaatatctattattaagctttttcccttatacagtttaaccagggtatacatgttattcatatttagttcatc

SEQ ID NO: 179230 - DNA, 707 bp, Homo sapiens
attgtttgcaccttttagctgtttataaacattcattacaagtttttgtatggatatatgttttcatttctcttgggtatatacctagacagatttcctgggtcatgtggtaactctatatttaaccttttaaggaactgccagactgttttccaaagtaactggactattttacattgtcagcagcagtgtatgtaggttccagtttctgcaaatccttgccaacacttggtattatctgtcttttttattatagccgtcatagtgatgtgaagtggtatctcatggttttgatttgcatttctctgatgactgacaatgttgagcatcttttcatctgctaattgctaagctccttaaatggaaaattataggaagcataaagcatgtttgcaaagaagtgattatattcgctaggattaagattttaagtgaatatttaagatgcccatgactagtgtccactctctcgaatcaagttttatttaaaccattgacttttcctcataactggaaatggtcccagtgaaagtctccctcacttgctggaatgtggggccatctctgctgtctgtcaagccttgatgcccaagtggccattttctcctggagtctgcatcagatggtagagtgtgtgtttcctgagtgtgagactggatctgctccacaatgctttgctggttaactccttccaagagtgcaatacc

SEQ ID NO: 179231 - DNA, 277 bp, Homo sapiens
tattattaaatccatatatccttagaaaaaaaatcctttaattatagagtagttatatacagtagtctaatatagtaggctatagttgtattttgccttaattattcttcattgttaatacctctgtaataaacatataaaataacacatgcttaattccttagtttgcaaattaatttaccaattcattcattcattctttctttctcaagaacagaaaaccttatagtaatacaggtcatctaaggtccataaggagtaatttaagatcagaaat

SEQ ID NO: 179232 - DNA, 201 bp, Homo sapiens
ttggcagaaagaagaaactgaagcagacacatggtgaggcagaggttagaaccccacaaatttcttgcagagtagcagcaacatctgcgggtgcaatgcaggaatggcccccggtaagagaatgagagtggaacttcatttgcaggtatttctgttctttttccagggtcccatgaggcctgcctatgcttttgctcacag

SEQ ID NO: 179233 - DNA, 657 bp, Homo sapiens
aatcttactttttttcagagtcagggaatgagaccatgatctttcatcattttgttatcagatacccaaattgtatgaaatcatctttgtgtcctgaatgccttatgtctatttagatgctagcaaatatttgctaatagtagattaaaacacattttatttaatagtcttgcagtgtttttttcatttaatataattgatattgtttgggtaattattggctaaaatatttaaattagagtgggaaaccagatgtttacaatattttataatctactttcagggtcagctgtgcttgtttaactttagttgcactcctggtgtcctctgaaatggctcaagctctgaacttaggggaggcagaggtgctgggacttgggcttcagaggcatcttccatatctctttgtgaggatcatctttaaagggcatgtgcacagacctttcacccagttctaaaagcagagtatttctgtgatttaaaaattgcttgaattggtcataatcctttttggaaaaagatgacaaactcaagctagataaatacagtgcttaattaatttgctcagtgtagatatgatatactaaagctgtcctgccctataaaaataaagtggttataaatgcctcaaatttaaaatttgtgtttatacgtata

SEQ ID NO: 179234 - DNA, 622 bp, Homo sapiens
ctatggctctccattccccacttggacaaaagctggcaggttaggcaaatagaaatcaataattggctttatccattaacatccgagtcaaagcaactctggatacggctttatccataacagatacggctttatccattaatggatatgactttctccattaatatctgagtcaaagcaattctggaattcccagctccatagtgtggagcttggcatcatgaatccaaaccacttcctttcagaccaagatgtctgttcaggcttaatgcgggtagctaactccagatgtggaatgctgatttgtacaatctccaggctaaaagggaccttaaacttcttccaatgaccattttcaacaacattcctcattaagtgcgcaaccagcttctgcttaaacatctccaacatctggagcagttgctggattctgttgagccaaaatctttctcaatttcctaattctgcccattctgaaacacatctgctcctcctgcctctaggacagttctcctcaaatcttctcttctccagaggcccatgcccagccccgaccactgtggcttagagcacgcgattactccctgggtcagctgggagggcaggggctgctgtggattgt

SEQ ID NO: 179235 - DNA, 113 bp, Homo sapiens
ggaatgcagcaatgagcaggacagataggattcccttgtctcatggggtgtacatttcactgagggacagcagctaaaccaaagaagtaaataaataaaccgtcaggtatgtt

SEQ ID NO: 179236 - DNA, 156 bp, Homo sapiens
attaattgcactaatgcctagattgtatataaataaagtacacacacacagagtactcaaaatagagcactaataatgtctgcatggtttatttttatcatttgtgaagtgctctgaaaaaaaggggctaatcaaattggctaggatgagattctg

SEQ ID NO: 179237 - DNA, 321 bp, Homo sapiens
ggacacccacgagccgaatccagattttccttcataagaaacttgagaatgtgcaaatgtgttgctagttcaggtcccaaaattttacaccgtgagagtgacccagttatctcagtctggaaaatttcaaaagatcgtagaaccagatgatctcagttaaacacggaccatgctgtgacacccacatccttggctatctccaggatgtattacggcagaaggaccactgagagtcattggccacatgcagtggtggcataagtggtcaagtgttgggaaagctgccaggattgctggtgtttgggtttcagagtcattatt

SEQ ID NO: 179238 - DNA, 479 bp, Homo sapiens
caactttggaagacaatttggcagtttctttaaaagttaaacataaacctaccaaccatatgacccagccattccactgtaaggtatttacctaagagaaatgaaaacatacatctacgcaaagctgtacatgaagttcataacagccttattcataaaagcaagaaaaccagacacaatccaaatgttcatcaataggtgaatgaataaacaaatcttgttacatccatacaatgtaacactactcagattaccactcagcaataaaaaacaacaaactctgatacaaacaacaataaatgaatcttaaagaatgctgatgaaagaagagtacatcctagatgaggccatttatatgaaattccagaaaaagcaaaactaacctatggtgacagcaaatcagtggttttctggaagtggaggaggatgagaatgaatgcaaacagtgctactgtaactttctgcgagactgaattgtt

SEQ ID NO: 179239 - DNA, 607 bp, Homo sapiens
atttcattaagacagcattacataaagcagctttacaaacctgcaagccttttgggcctggtagaccatgtaaattagtgaaatggcctgggtgtaagacaacggggtaggtgggtaccatggctgaagccaagtgcatgccctatctgcagaagtctggatgggttagattaggccagagcaacaaagaagccaaagaagctcagttgttgaggacaacacaattttcttgcttgttcatactacctgttaaaggtcagctggagactctgttctttgtcattagtgcagccactgtctagaacactactggttactgtggcagagtaaaaagaaagagcacagcttctttggcttagtgaagcagtatttgtttttgttaatttgaaaaacattaggccaggcacggtggctcatgcctataatctcttcactttgggaggccaaggtaggcagatcatttgaggtcaggagttcaagaccagcctggccaacatggtgaaactggtgtattctctactaaaaatacaaaaaaccaaaaaaattagctgggtgtggtggcaggtgcctgtaatcccagctactcaggaggctgaggcaggagaat

SEQ ID NO: 179240 - DNA, 483 bp, Homo sapiens
agtgagtgagtgcctgaaggggagaagtcaggtagtagatcaataaataaaagtggtaactgcagagcctgagcttgttagaagacacaagtagatgatataataaatagtgcccagggaatgttacccacttacctgcagaaagggaaagacaagttgcagacaaagttaggaggcccctgagctgtccctctgaggcactcatcctaaggtatggatgacaaagacactgccatttaggcaggggtgagcagggatcatgaaaccaatgagagctcagtaatcaaagcatgttcccttttcactgtctgctgaatgctctgctctaaaacttttcatatatggtacaggcaacagagaaagtcttcatgtaaataacataacagaagtaaactaaaaggactccaaattaacatacagataaacacagactgaaaggtaaagtcatttgacctctggaattctctttcagcccacagacca

SEQ ID NO: 179241 - DNA, 752 bp, Homo sapiens
gtctctattaaaaaaaaataataataaatattaataacatcattgtttttacctccctgctattagacttactcccctttttcatgttaattaattaattaattaaagctttcctaaagtatttcctgatctttaggaatctctcacataattgctaacatttttttggcacccactttgggcacctttatagtatttgaaatttgacagcaggtggcagaaaactcaaccaaaattagatttttagttgttgttcacattacaagaagtctagggcttgggtagtggccccatggtagcgtcattgttccaaatgcttctttcttcctgccctgcaatcctctgggccataagatgggtttggcttctttggcataacattcatgtctcaggaaggaagacgaaaagaagacagaaaggatggaggccaaggacttcctcctctcaaaggtttaccattccattcaaggaagcaaatcctcgccacagatgttcacccacatctaactggtcgtgattgtgccaaatgactacctctatctggaaaacaagctgggaaatcaagtacttttagttagagagtgttctcacctcaaacagaatcagggtaatgttttgaagaagggagaatgagtattggcaactagccatgtctggtacatgagctcatttaattctattttaaaatgacagtctgtccaagatccagtactatggacttgaatctagaattccataattgaggtaatggg

SEQ ID NO: 179242 - DNA, 445 bp, Homo sapiens
gaggagatcaccatccatggcccttaaatgtctgaaggcatggaatgatgaagtgcaatgtcttttaggatatttggtcaccgctatacatatatagctactaaggaagctgaggtgggcggactgcttgagcctgagaggtcaaggctgcagagacccatgatcataccactccactccagcctgggcaacagagcgagacactgtcccaagaaaaaaaaaaaattattcgatgtagtcctaaaactattatgtagaatactattgtttacatcacatcacgtcagccctttaaatggcttaacgcttatttaggtacaatccgtaaagttttcctggtaattaagtataccgaagaacaattaagtataaaagagttactgccttgacaggaagattgtaaaaattgtaaaaagataaataaataaataagagtcaaaactgt

SEQ ID NO: 179243 - DNA, 587 bp, Homo sapiens
gagactggttcatctcactcatccttgtattctctgtattttgatgcagcagtggaggggcttgacacatctattataaaagaaattattagatcattgaaaatactgcatcttctcattagatcaatatcaacctcctggtgaacaaacagttaggaattgttctattaatacatactaggcggttaacattctaagaatttgcctcacattcattcaatagttcctaagtaccgactatgtgctattcatggagtgggctgacaaataaaaaaaaatgaatgagacatacacatgaaaaccacaagtacattttgttctactagccacttatataaagagggccacaaagtaaagggtggtcaaagttgcctgcaggaataagaaaacgatgagataaatattcactgcctcgaataccaagccaaatattagaccaaaaaatgaaatagataaaagtcggctggacacggtggctcatgcctgtaatcccagcactttggaaagccgaggggggtggatcacgaggtcaggagatggagaccatcctggccaacatggtgaaaccccatctctactaaaatacc

SEQ ID NO: 179244 - DNA, 283 bp, Homo sapiens
aggcaatttccaaaatcaactcgggcatgtaaaatgtcaataaaacccaactctgaagtcacatctaaccgattctgacagagttttacgctgagccaaggccatcctgcccaagcacactaaatgttgactctgaagcacatgtaggggaattaaacagtaaccaaggattggaagggaattttgtcacagtttacacagtcagtagcaccaggatagaaaagcaaaggcacctaggagaattggaaaattctgtcactaccagcacccccaccacccctga

SEQ ID NO: 179245 - DNA, 490 bp, Homo sapiens
ttcacctggatgtctaactgacctcatgaacatatcaaaattcctgtcccccacccctatctatcccactgcagacttccccatttcgtggcaaatccacccttccagttgcttatcccaaaaaccttgaagtcatttatgacttctttttttggtaagggggtgtcggggaggggagacagggttttcttgttctgttgcccagtctggagtgcagtggtgcaattatggctcactgcagccttgacctcttaggctcaagtaatcttctcacctcagcttcttgaatagctgggactacagacatgcaccatcatacctggctaattttttttatttttgtcgaggtggggttttactgtgttgccgagactggtctcgaactcctgggctcaggcaatcctcccgcctttatctcccatagtgctggaattataggtgtgagccactgcgcccagccaacaactacttttttttcttattcctacat

SEQ ID NO: 179246 - DNA, 179 bp, Homo sapiens
caaagaaacgattgaaaacagaatttttccaaacttctttgaccttcctttgcacccagcctgtgtgcctgcccacatgactcttgctttggggaatgcagctctgagcatgtttttgtcatccgaccctgagatgctgaaaaaagaaagactctttaagccattttgctaaccttctg

SEQ ID NO: 179247 - DNA, 217 bp, Homo sapiens
ttacagggagagaaaagtggttaaaaaaatagagctccttaagaatactgttaaggtggggcacatacaattagttttttaatagatgaactttattttttaccttgggaatgaaaagtggggaggtaaaataaggatttggtcaactggctacaaatatctatgaactagtccactgtcaaggcaaacgtctatgcagggcctccctatgtggttg

SEQ ID NO: 179248 - DNA, 524 bp, Homo sapiens
aaaagttattcgtgttgcactgagaaaattgtccattttattcatcagaagaaaaattcaatgacctttactcactgacaacagtgagaatcagaatgaatgaatcagagtgtctgtcctaactactccctctggttctactgcagttcctgctgtctccatatggttcatcagtgtgtgggagatgaatgtggtaaaactgaagtagctgcttgtgcttggagaacaacaacaacacactgaaattcactgcttagaagctgttgaaagagtttggcgataaatacaacctaatattcacaataaagagcaatgatctataagcccattttcacatctattgtaaaggccaaccatgtgtttcagccaaaacaaactgattttattaatacaatgaccagacatatataaagaataatatgagtttattttaccagaggacttggctctcacacttgcattctattgtaggtttttacacttatccaattctaacaagagttggataaactcagggttttcct

SEQ ID NO: 179249 - DNA, 263 bp, Homo sapiens
tttaagtcccatggtcttctcttcaacattttcatccaattagcccacaatcaacttagattccacctgcctctcacactaagtagttctctctacttcttaggcctccattaatatgatggggtaaggtatcagggaaggggaagcattctataattaggtctcagtcttttagtgagactatgcccctggactgtgaactttgcaagtgtttctcagttttttttctctcccatttaggtgaaacagcatggcaagatggg

SEQ ID NO: 179250 - DNA, 163 bp, Homo sapiens
tttaagtcccatggtcttctcttcaacattttcatccaattagcccacaatcaacttagattccacctgcctctcacactaagtagttctctctacttcttaggcctccatttactttcttagtttctctactcccttccgtttctcttgtttcctaccgcaa

SEQ ID NO: 179251 - DNA, 424 bp, Homo sapiens
aaacatctgttccaatagcacatagtgataacatccagcatttgcttgatgtgaacagtcatatacctatgaaactcacctgtgttcttttctcatttgcttagaacagaagttagaaaagtaccaggtgatgacatgcatataaacaaatgcatatcttcttgtatcaccggtgaaatgtaatggagctttcttttgccaacatagaagcactctcaaggctgggaggatggaggaaaactcctcattagctctgacctactgcagtagaacattcttctcataagcatgtgcaacacagttggctaaaattcttaaacaaaagcacgcaaaaatatttccatttaatgggaacaagttattttcaacatgtaatttttcaacccttttttatgctggtttcagaaaaaaatgtttaaaccag

SEQ ID NO: 179252 - DNA, 658 bp, Homo sapiens
gccggtccagttccatgtcactgcagttccatttcacctgcagcatctgttgctagccctaacctggaaggaagggaaagcccccttaaaggtctcttttctctcctcaaattgtctctccagtgccttttactcatcatcaagaaactcttcctgatacctaatttgaatctgtcttgtggtttttagctcctttctttgggataggtaaggtgggatgggtaagggaatccttagggcactttggggattctgcagaggaagtcctgagagatgtccctgccacctgaattgttgaggcatagtagaagcctggggcttccaagaggatgtgttccttgaagctaagccttaaagaactagaaagaattagccacttggagaaggaaaataagcactccaggcaaagaggtcagcctgtgcagaaatgtaggagactatgaggaaatatagaaggattctaatgagtggatcatgggttacatgatccccatgtctctgcctctctgaaaaggctactgttgccccaggcctgtaggattccaaatcaccttttacagcggagctctctctcatacccatatcatccttcatgtgtaactcttggtcctgagagagtgccagtacttatttgctgactttttattttaccaagtgt

SEQ ID NO: 179253 - DNA, 1414 bp, Homo sapiens
tcctagattgtacttacacaacctacatggtatagcctactacacacctgggctgtgtggcatggcctattcctcttaggctacaaacctgtacagcatgttactgtactgaacacaatggtaagtatttgtgtatctaaacatagctaaacatagaaaaggtatggtaaaaatacaattttataatcttatgggactaccatcaatatgtagaccgtcattgaccaaaacatcctgatgtgtgcatgactgtacttttcattaaataacagataaggggctatagaatttggggctctgactgatcaaaacctgtgtatctgtgtcaagttttaagacccctgaaacagctaaaacaggtttccaaagtgtaatcactggatttcaaaaccatgttttagcccttcattaatgaagcctgttgtacagatttagagtcttacaatatgagggaagttggttctgggaaggtaagatgtagccagttttcatctgggcacctctgaaagagaaggagtgcaggagagtaagtctctcaaggacgttcaacaaaggaccagcagcatcttatcaggcgatcctcagaggctccaaggagcattggagagaatgcccctttctgggcttgatgtcttggttttggtttaataccaaatttctcttggtcttggtttaatacccgactcctcccaaattgaacgattatctttgtatgtcactcaaaaataccaggtttcctgaatatgttattaagaatttcagatatccaagcagaattttattatggacaccttgtaatgaattcaaatcgtgtgacagcaaacgggataaatggccccttctcacccagttccgctcagggccatacaggcttgcacatagagtgtgctaaaaatggtaacctcctttgagcattgcagaaagagggttctgtttcaaattgggctgaccgtaaaagcaattttgatgtctttcaaactaccataaagggattttaactgtatttttattcttagaaacaatacacctttaaacagatgtcaagaccaaagatgatgtataataaacagccggtggttatggtgtggtgtgagcaggcccccggatcaccagccctctgctggtggtcataaagcacacacagtttgtacttgcttcctctcgacgcctgccacaacagttttgccagtcaccaaactcagaaaaaactagctgtgtgagcagcaccgtaccctagcggtcttcagacattaagttcacgtcatccactgaaaggaagggtccttgcgttgacagcgtgtggctttggagtccgtttatggaagcactctacaatgaacagttgaattttatgtctattcttttttcctattttaaaagttctagtggtaacacaaactgtaaatttgagtca

SEQ ID NO: 179254 - DNA, 493 bp, Homo sapiens
catcagtgtcattaccaaagctgactgcgcttctccgggtatttagtactgtggtgaggagcattggggaacgcttcagcccaattcgggtcctccgattactgaggcatacgtaacagatattctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcatgctgatgtgggcgctatctccaactgtctttgcacttctgagtaagaatctgatgattgtgcacagtgacctggctgttcacttccctaccattcagtatgctgtgctctacactttgtattctcattgtaccaggtactgtattcacaaa

SEQ ID NO: 179255 - DNA, 563 bp, Homo sapiens
tcgtgcacactgcacacggtgtctgtttatccgtgctgtgcccttcctcaccccctgttggctagcaaccatactatatccttaacacttggttcaggcagcacctgcccaatggggtttgatggttttccctgcctcttctctccgtactttgacctgtttgtaatcctctgtctggctgtctcctattccaaactgagtcagggacattaccttactgtttctctagtaccaatacagagtaggtagttataaatatgtaccaaaaaaaaaaaaaaaaattctgctgagtttggaatgccctaactcagtgagatatgtttaggtttgcttcatctcaactgtttgagtatataaattaaggagactgacacaaaatataatatttagtagccaacagcagtttgatacctgataagtaaaaacagtgtccgcctaccatctaatatgacagaagagaataggacaaagaaaaaaattgttttcccttctttttaaaactggctttatgattctaaggctgtttttgtggctaagcacaaagaaccacagctcatctgaac

SEQ ID NO: 179256 - DNA, 384 bp, Homo sapiens
acttgaacctgggagatggaggttgcaatgagctgagatcatgccactgcacactccagcctgggccacaaagggagactccatctcaaaaaaaaaaaaaaattctgctgagtttggaatgccctaactcagtgagatatgtttaggtttgcttcatctcaactgtttgagtatataaattaaggagactgacacaaaatataatatttagtagccaacagcagtttgatacctgataagtaaaaacagtgtccgcctaccatctaatatgacagaagagaataggacaaagaaaaaaattgttttcccttctttttaaaactggctttatgattctaaggctgtttttgtggctaagcacaaagaaccacagctcatctgaac

SEQ ID NO: 179257 - DNA, 625 bp, Homo sapiens
cttactcttcccagctcggtcaataattctaaagatataattagaacgcattttatctagcctttttagatgttttgtactggaggattgggagaaggcaatctaaactttaattttaaattttaaaggccaaagtcatcttggtcatgttgtacagggtataactttgaggatgctatcaaacacctctttaggtactagaataatccctagagtacttttagagagcagaggtgaaatagttttccagccaggctaccagcctagttatactcttcaatttttacaatagtaaagtatatttattcccttcttcttagaataggatgaggcactggattaaatgctttatacaagttatttcatttaagacacaacaggtaaggttatgccaaagtaacttgcaataaactaatgctcctgatgagaataactagaagccattaaaaaaataccccaaaacttttttgaagacattagagagtttctgagacaacgagggcttgaacataagcagaaactatagagagaactcaaagatctgatggacttccacttctgaacgtgacgaggggctttgaggaagataataataacatataggtcaactaaaaatgcaggaaaa

SEQ ID NO: 179258 - DNA, 531 bp, Homo sapiens
acttgaagtcaagagttccaaaagaaaaaaaaaaaccactgttaaaaatacatctgaaaccactaggtctagtcaaccaaacaccacttaatatattccaggtatacctaaattctagtagtatggggacagtaggggttcttgaacagcacacagcagtatgagaaatcagaagttagatccagcaggcaagggaagtatttagaagttttaaagtgacgattacatatctggaagtatgctttcagaaaataaatctcagggggagggacagcattaggagatatacctaatgtaaatgacgagttaatgggtgcagcacaccaacgtggcacatgtatacatatgtaacaaacctgcacgttgtgcacatgtaccctagaacttaaagtataataaagatatatatatatataaaaagaaaagaaaagaaatctggtagcaatgtgttaaaggaaggagaagtgtcacctttcaattcttatctccttcatccaatttcctttccagggctaacccaatacaccacat

SEQ ID NO: 179259 - DNA, 250 bp, Homo sapiens
tggccaagtgagtggggcccccacaggattgctgaacctcggggtcctaatgggctctttttccagagtctgtctgcctcttcctggtcattgtaaagatgcccggcagcagggtgggcttccccgatcctcggctgccgtcgctcctgctgtggtctggggcaggcgcctctcctggcagacacacctgagggtgccgtggtcagagactcactggggacgcatgtgattcacactggtgcgctggccg

SEQ ID NO: 179260 - DNA, 261 bp, Homo sapiens
ccttggtaagccgctttgtcagagctggaagccaccagtggacctgtacttgccagttttggggtctcaactaatacacccacaaactcagaggcctatctggcagggcggccaaaaagatggtttcttgttatattatcacagtgttcccctcgggagcttgtctgcaccaagagctgcctggaggtgtgtatggaacttaaagaatccgacagtagataggtccttcaggaagagtgtgttcttgaagaatcgtttgca

SEQ ID NO: 179261 - DNA, 396 bp, Homo sapiens
gtcaatttctacactgtgaagctctaggtgtaactgcagggttctgtgatgaatgagcttgcttccagaaaacagtggcttgaagccccctgggctaagcgctagctaccttgaaggctaagggctatagagttgaaagaaagagaaaagcatgtactgctgttctggctatttatatgacatatgctttgtaatcccatgtagcaactcttctatttctccactgacttacatacaatttctaacaaagttcatttgacacatatttaaggacaagcacaaatgaaggtagaaattgtgggcgacaaatgataaggtggcccctatggccactgcctcatggtgttcatgcctttgtgtgaccccctcctttagtatgggcaagacccgtaactg

SEQ ID NO: 179262 - DNA, 574 bp, Homo sapiens
ataccctgctttcttttctctcctctaaagaagtccttgaattagctctgctggtaaatccactggtaaatccaaatttactctgctggtaaatccactggtaaattcactggtaaatccaaatcccagctttgtggctgcatatgatttctagatcttttcccactatggattttaaaacaactactactgggaagaagatgcatgctctggtctttggtgaaacctatagcttgaagaacatttagagattgtttcatatttcctgccatagctataaattgactttaggctcgtcattcaggagtccttagatattcacagtagggtctgtgtgaaggaaaggggaggatatccgtgctgtagatcaaaaactgattccactgactaaggctgatcttaattcccaagctctatgttctgctgaacaagaattacattgtaagaaacagtggagcagcttgatttatagagaggttaatgttttatgaatgctgggctcactttggcttggaggcaatctctgttttgggtaaggcatggataaatgcctatggttttctaagatggggtg

SEQ ID NO: 179263 - DNA, 190 bp, Homo sapiens
  misc_feature (1)..(3): n is a, c, g, or t
  misc_feature (190)..(190): n is a, c, g, or t
nnntgacacagagacctttgttcacgtgtttatctgctgaccttctctccactattatcttatgaccctgacacatccccctctccgagaaacacccaagaatgatgaataaatactaagggaactcagaggccggcgggatcctcgtctgctgaatgccggccccctgggctcccttttttctttctcn

SEQ ID NO: 179264 - DNA, 463 bp, Homo sapiens
actcttggatgttgtgggttagattccattgacctttaagctctgaatcttggcctcttatagtcaagcttgctgcttcactggtccaagcctatgcctccctcatacaaaaaagatgcaggagcttggcagagaagcatcctggaaccatgccaaaccatgaaacaacacattcttggaatcccatataattgcttaaatcttgctctcctgatcttgagctgtctgcactgctttttctgaagagtcagctcaggtatcacttcctccaaggagctctctgtgatttcactcccaggctaagttatcttttgcatctttcccataggctctttgtagtgagcatttgttgaaaatctggattctcaggatcttcgatctcaccatgttgggagaattcactcattcacttaatgcttggcatggtccgactcagggtctgctatgttccaagcactaaaga

SEQ ID NO: 179265 - DNA, 234 bp, Homo sapiens
catgtgctaaagtcataaaagcaggctatattcaatatggaaacaagtgttaaaggtcattcacaaacaataagacttgtagggatatattttaaaacatttatagcaaagtccttggatggtgggacagaaatataaagacagtcaatatttcagaccaatgtgtgtgcattggggaaggatgatgacctgacatggtatatcatgtcagcaaaaccccagaacaccgagaat

SEQ ID NO: 179266 - DNA, 278 bp, Homo sapiens
attagcttgagcttttcccacaaaggtagaattgattcctaaattttaaaggagaagttgcttttacaaataaggctagcgaaagaaatattgtaaacataaatcaagtatgttaacatgccccaataattaagaaataaatgtatatggtaacagctcttgagtccctgcaaacatatatcaactctatttttgaatctgttcaattctgaagctccccttttttttttttttttttttcagtttttgtggttttatttaaacacaaataaaacatg

SEQ ID NO: 179267 - DNA, 187 bp, Homo sapiens
acaaaaaaaaaacaacaacaaaaaaaaaacaaacaaacacaagaaaatcccaagtgaagcagaccacgtaaagcacaccaatggggctcgcactgtgtgaaccagttccttgctcttctcattctcttcagttagttcttcatctctctacccatatctgccaggtgctctttcttttcttttcttt

SEQ ID NO: 179268 - DNA, 249 bp, Homo sapiens
tctagaggatcccggtcaatttctacactaacctcagcctaccttccagctttatcctgtggcgctccatggctttgctaatttttcacctcagccacattagatttttcctacaccccaattatcttcaggtgtcctctcaatcttacaaaaacatttacaaaactgtcctctcaatggcacaagaatacttacaaatctcttattctttctaccgctccttttattcctccaacaccacctgtatct

SEQ ID NO: 179269 - DNA, 245 bp, Homo sapiens
tttaccccagatcgccagacccacagaataagagtgtggatacgctcagtgtactcagagaagttatatagctatgagaagctgctcatgcttaattagttgaagaagaacctgcctctttgtagtttttttttttttttttaagagacagagtcttgctctgtcacccacgctggagtgcagtggtgcaagctcagcttattgcaactgctgcctcctgggttcaagcaattctcctccctcag

SEQ ID NO: 179270 - DNA, 1004 bp, Homo sapiens
aatgaaagaagaaatgattaatgctgactgtgacatttttgttcagaagcaacaaggtgctgtgcaatacatactaatttgggagacagaaaaccaaaattctatttgtctttgccatcaagtaagcaagttattttacttatatgatcttgattgttcatgtgtaaaatgtggatatcatgttatgttttattcaaggtctcagatattctgtgagactctgaaaaaaggtctaaaagtctataagcagctattgtgtagcaggtgcaagttaaaagatgagtaggtgtaaataagaggggacttaaacgtttgtggaacaatgtaattaaatgataaaaactattaactctgtttttcaacataactccatcaagttcaagacccttttgtaagcaatgatagcagtcatttagaccatccctgaagaactgagggccctggcagtttaaccgtgtcagtgctgtcttttttacattaactgaagaaaaatgggccccctctaaaatttaagattaggaaatgaagtcagaaggagccaaatcaggactgaaaggtggatgcctaatgatttcccattgaaactttgcaaaggtgcccttgtttgatgagaggaatgagcaggagtattgtggttaaggactctctggtgaagctttcccaggcatttttctgctaaagctttcccaggcatttttctgctaaagctttagctttccttctcaaaacactctcataataagcagatgttactgttctttatcccttccaaacaactgttgccatgacctttgctcttgactggtcctcttttgctttgagtggatcccttccacttcttggtagctagtgctttgattgtgatttgtcttctggatcatactggtaaagccatgtgcagttctttgaagaaatgcttcagaatcttgatcccacttgtttaaactttccattgaaagctctatttttgtctgcagatgatgtgggcacacattgagtggaaa

SEQ ID NO: 179271 - DNA, 993 bp, Homo sapiens
aatgaaagaagaaatgattaatgctgactgtgacatttttgttcagaagcaacaaggtgctgtgcaatacatactaatttgggagacagaaaaccaaaattctatttgtctttgccatcaagtaagcaagttattttacttatatgatcttgattgttcatgtgtaaaatgtggatatcatgttatgttttattcaaggtctcagatattctgtgagactctgaaaaaaggtctaaaagtctataagcagctattgtgtagcaggtgcaagttaaaagatgagtaggtgtaaataagaggggacttaaacgtttgtggaacaatgtaattaaatgataaaaactattaactctgtttttcaacataactccatcaagttcaagacccttttgtaagcaatgatagcagtcatttagaccatccctgaagaactgagggccctggcagtttaaccgtgtcagtgctgtcttttttacattaactgaagaaaaatgggccccctctaaaatttaagattaggaaatgaagtcagaaggagccaaatcaggactgaaaggtggatgcctaatgatttcccattgaaactttgcaaaggtgcccttgtttgatgagaggaatgagcaggagtattgtggttaaggactctctggtgaagctttcccaggcatttttctgctaaagctttcccaggcatttttctgctaaagctttagctttccttctcaaaacactctcataataagcagatgttactgttctttatcccttccaaacaactgttgccatgacctttgctcttgactggtctcgaactcctgacctcaggtgatccaccgccttggcctcccaaagtgctgggattacaggcgtgagcctgtgcgcctggccagtgataggttttttaaaaataatgcttttcaaatattaaaatatgaaatattcaatactaaggcacatagatcattcttagttttattgtcaagtttaacccgc

SEQ ID NO: 179272 - DNA, 687 bp, Homo sapiens
gataaaacagacgttaagtcaaaaatagtaataaaagacaaagaaggtctttttataatcataaaaggatcaatgcagcaagaggatataacagttctgaatatgtatgtatccaacattggagcactcagattcataaagcaagtattactacttctaaagaaagagataaactacaatacagtaaaagtgggggacttcaacaccccactctcagcattagatcatcaagacagaaaatgaacaaataaacattgaccttaaactggcctttagatcatgtggacctaacacagaacattctatccagctactgcagaatatacattcctttcatcagcacaaggaccattctccaggatagaccatatgttaggccacaaaaaaaactcaaaaaaattttaagaaatgaaatcatatcaagtatcttctcagaccacaatggaataaaattagaaatcaataccaagaggaactctggaaactatacaaatacgtggaaattaaacaatatgctcctgaatgaccatcatgaaaatgaataaattaagatggaaattttaaaaagatttgaaacaaaagaaaatggaaaagcaacaaatcaaaacttgtaggatacagcaaaagcagcaccaagagggaattttatagaaataaatgcctacatcaaaaagtagaatgattaaa

SEQ ID NO: 179273 - DNA, 280 bp, Homo sapiens
tctaatgctctgtaaatagaagtcagtgcttccatcagactgaactctctgacaagatgtggatgaaattctttaagtaaaattgtttactttgtcatacatttacagatcaaatgttagctcccaaagcaatcatatggcaaagataggtatatcatagtttgcctattagctgctttgtattgctattattataaatagacttcacagttttagacttgcttaggtgaaattgcaattctttttactttcagtcttagataacaagtcttcaattata

SEQ ID NO: 179274 - DNA, 470 bp, Homo sapiens
tctagaggatcccttattcgtgttgcacgacccatcaaatgaaatcactgtaaagaatataaaaattatagttaaataacatttcaaatatgaagctatttaaatgtcaactgtgcaggcaatttttaaatatttctagtcaatcataatcactgctttctcagtctttctattcttcctataagcatttgattaaagttgataacacagaattctcttttaatatgcattctgttggggataccaattaagatttctttaacttgtttattttagaaattgtttataacgccaggcaacagttgtaaagaggataacattcccagtagatggttttgaaaacttctataatatctaattatgtatagatccagactgtttatgtttggcatacaaataattgctgggagttagaatggtttgatcaatacatgcaattaagtgcaacacgaataagtgcaacacgaata

SEQ ID NO: 179275 - DNA, 155 bp, Homo sapiens
taaattcctacacaacttgccacagaacataagtgttaaatatgtgtcagactaaaccatatatccatacatgacaacaaaatactgccaagctggaggatgggactagaagtgtcattcagcaaaaataagaccaactaaaaacaaagacactg

SEQ ID NO: 179276 - DNA, 491 bp, Homo sapiens
atttctggcagtagccaccagagggtgctaaagaacctccttgaaacggctgcagagccctgtgaggttaccagactgtttccacaagacctgtcctgggctggtcttggggtttgtggggaggacagtttgttcaggagtggatgaggaacagaagggccccgagaccacaggttgtgtcagagacagagctgaggccctcgctgggactaccactcagagataagcacaagaatcaggccaaggaggcatcatttgggatcctcattcctcttgcccccctttgagggcaaagggtgttagtatacttaaggatgttgtccacttaatagagagaaagggctagatcagggattttcccctggggcttccagccccactcaagttaagggatatattgagatatttatttgatctttagatttcaaagggagaggctgttatccagatttaaaaaaaaaatgcttgaaaataaaattgattgcctgcca

SEQ ID NO: 179277 - DNA, 416 bp, Homo sapiens
ggaaacaccagatgaagatgattcttgtcttcacctgaccctttagccacaaggccagaaatttggattgtatagagcaaaggtctacaaactttttctgtaaagggcaggattttaggctttgtgtctgtatattccctgttgtgattactcagctctgccattgtagtgttgaagcagcagtagacaataggtagaggaatggacatggctgtgtcacagtaatctttttttaacaaaaacagatagtggaacagatttggtccgtgagctatagcttgcagatccctagtgtagaaaagaggccagcagcaagacctagaattctggaaaatcctcacgttatctctatctaaatctcccttcccctaagctctgaaatgtctcgtgagagtcaagtaagaatttggcaggca

SEQ ID NO: 179278 - DNA, 760 bp, Homo sapiens
gtaatatgaggagtttttgaatctattttatgcccatacacacattaactaattcaaaaaactctataaatagtcatatataaatatccatgcacattaactgtatcttcacttcatccttaaaacataggtggaaattttccaaatcacagaaatatttcacttttctcatgtgataatgattacttgatttaaatggattttaaagaatgaaatggctacttccatcctgtcaagtctaacttatttttacttcaggataagcaaagtaagcacttttagatttaaaactattacagaagagtttgttaattggaaggagtgtctatggttgaacatattcaagggatattacttagtgttttagcgaagaacataattcaaatgttctggacatcatttatgctgatttccaaataaacagcccttcctctttactgtccattctgtgattgggtgggactgtgtgaccaattccgcacaatgaactgtgaacaatgagccttcctcccaagcagaagcatgtgtgtgcccatgtagaccctccacagctattattactttctggcacagtaacccatgatgatggagatactggctactcaactagccttgtttccttactgacagtgatcagtggagcctcctgctgacacacaagaagaaaccttcatgacttttatttacagagaatttggaagtgtttactaacatagcatacttagcttccttagtctatcacaactcctcactataatca

SEQ ID NO: 179279 - DNA, 613 bp, Homo sapiens
  misc_feature (9)..(9): n is a, c, g, or t
tggatcccncgggctgcaggaaaaattaattccagatgcattaaagatctaaacatttaaaataagaaaagctacatgtgtattagaggaaaatggagtgcatgtttaaaatcatgcaatgaagaaaggcttcctaagaaagccaggaatcccccaaatcataaaggaaatgaataggttagaataaatttttaaaagacagtttctgtattacaatgaggcacctaaacaaaatgaaaactcaagccacatacttgactacaatatttgcaatatataatagacaaagtattcctgtgaagaatatataaagagttccagaaaaattaacaagaaaaagaacccgaccggacacggtggctcacgtctgtaatcctagcactttgggaggccaaggcaggcagatcacctgaggtcgagagtttgaggctagcctgaccaacatggagaaactccgtctctactaaaaatacaaaattagccaggcgtggtggcacatgcctgtaattccggctgctctggaggctgaggcaggggaatcgcttgaacctgggaggcgggggttgtggtgagctgaaattgtgccattgcactccagcctgggcaacaagat

SEQ ID NO: 179280 - DNA, 849 bp, Homo sapiens
tggtcaacttggcaaaggctcacagcagctctaacacattcggaaggatcctcaaatgcagcttcccttccctcctgaatcagatggcctccgatcactgttgcctcagggacgcactcagctccatccatccaggcctgcaggtccccaggaacatgtgggctggttcttactgaggctcaaacctatcgccggcaccctgccatgctccactttaggctcacaagggtcaacaagcaatacctcacatcatgacaaaaattaattccagatgcattaaagatctaaacatttaaaataagaaaagctacatgtgtattagaggaaaatggagtgcatgtttaaaatcatgcaatgaagaaaggcttcctaagaaagccaggaatcccccaaatcataaaggaaatgaataggttagaataaatttttaaaagacagtttctgtattacaatgaggcacctaaacaaaatgaaaactcaagccacatacttgactacaatatttgcaatatataatagacaaagtattcctgtgaagaatatataaagagttccagaaaaattaacaagaaaaagaacccgaccggacacggtggctcacgtctgtaatcctagcactttgggaggccaaggcaggcagatcacctgaggtcgagagtttgaggctagcctgaccaacatggagaaactccgtctctactaaaaatacaaaattagccaggcgtggtggcacatgcctgtaattccggctgctctggaggctgaggcaggggaatcgcttgaacctgggaggcgggggttgtggtgagctgaaattgtgccattgcactccagcctgggcaacaagat

SEQ ID NO: 179281 - DNA, 455 bp, Homo sapiens
gtccagattcaagaggagggaactacacaaaggcctgaatatgaggaggtgtggttcattggggatcactaaggtagtagattacccgtataactcaagagcttccactacagcaaatgatcaggttgactttatttaattaactagctgaaggtgaagatgtacacgtattaaatacagctaacttcactgaccatggagaaaagcactaatcttcagccttatccttagtccagaaggcaaatccccacctcgaaataaacttgtgaaatgatactgagttactgaatgttgattcctcccttatctcggttaagccttcacaccttgttggtggattgtttccattacttcctaagtggcctgccccattccagcatttctttgttgtaatctgtcctctaccctgcttccaggctaatctttctagaatggtacttttattgtgtcattct

SEQ ID NO: 179282 - DNA, 117 bp, Homo sapiens
agaccccactatatcaatcgtaacattagatgtgaatggagtgaacaacccaatcaaaagcagacacagacccaactatatcaatcgtaccattagatgtgaatggagtgaacaacc

SEQ ID NO: 179283 - DNA, 702 bp, Homo sapiens
ctagggagaatgctatggattctgactaaacagactggtttgaaagttgtatatcagaatcacttggaatgcatatgctaatttatatagatttgtatacactaaattttgctgctgttaataattacgaagaattagatgcctgcataagcaagagacaaaactaaatataagctgacaaaattttaaaagtcaattaaccttcatattaaatggcaccaggctagattttaaatggtctcaataatcaagtggaatagtttttttactgattagtttcaccttaataatttagactcagataaagtgaaaaactaggattagctcaaatagtgacatggcacttaaacaacaggttaggtgaagccattctgcagagtagttaagaatgagtacagacagacctcagttaagagtctagattctaccactaactagctacataaccatgcccagattacttcacagtactccttgtaaggatcaagtgagctattacagataaaattcttaggctagtatggggcatagagaaagcacttagtaaatattagacactgttaggaaccatgtaaaagcctttgggtttctcctaaagaaagtaatttttctctattgaagagaaaaggaagcatggaaagggtgaagcaatcctaacgtgtgctgtaaatagagatatctatattcacatgtatagatata

SEQ ID NO: 179284 - DNA, 456 bp, Homo sapiens
aggtgggtcttcaggggacatgttttgttgggtctttggagaaggttcagtttgcttcaaataaaatatttataaaaactgcactatgtaccaggcactcaatatcttgattagcaaattagaaaatgttgtgcctaatacattaaaaaaaatcaaaagtttcataattcacatgagttataatggacagtaagtggtcctttgaagagggaaataggatggagacaaccaagaataaaaagaagaagcaggcagggttaaccgtaggcaaaaatgggaaactaacaaattatatctcagtattctcagtcacccttcagtaaccatcctcttctcagcttcttagagaattctttcttaccctcttcaaggattcggtatctttttattgtgaccttcaaaattaagacactgccattgccctggttggaatggattcctggtcccacctaacaa

SEQ ID NO: 179285 - DNA, 1205 bp, Homo sapiens
tcgaatcgacggtttctcacggtcatcttaggctggaatgcagtggtgtgatcacagatccctgtagcttcaacctcaacctcctgagcttaagcgattctcctgcctcatcctcctgagtagctgggactacaggtgcgtgctatcacgcctggctagtttttgtatttttagtgagatggtgtttcactatgatggccaggctggtctcgaactcctgacctcgtgatctgccctcggcctcctaaagtgctgggattacaggcatgtgccaccacacccagctaattttgtaattttagtagagacggggtttctccatgttggtcaggctggtctcgaactcccaacctcggatcatctgtgcactttgggaggccgaggcggatggatcacctgaagtcaggatatatatacacacacacacatacacatacacatacacaaaagccaaacattttgttgatccattcatccatccatggaaaccttaagttgcttctaccttctggctattgtgaataatattgttatgaacatttatatattaatactccagttactgctttcagttcttttggatgtatacccataagtggaatcactggattatatagtaactctgtgttttttgtgtgtgtttttgtctgtgtgtgtttttgttttttgttttttttttgagggactgccatactgtttcccatagagttttcaccattttacattcccacaagtagtgcacaagagttccatttctccacaacctggctaacaattaccattttttttatggtagccattctaatggatatgaagtgataggtcattgtggttccaatttgcatttccctaatgattagtggtgttgagcatctttttatgtgtttattgacactttatatatcttctttggagaaacgtctgttcacatcccttgtcgattttttaaccaggttttttttttttgttattgagttgtaggagttctttatgtattatggatattaagccctcaccagataaatgatttggaaatattttctcctgcaacacagaagtttttttgttttaagtagtggggtcttgctgtgttgcccaagctggcatcgaactcttgggctcaggtgatcctcccacctcagcctcccaagtagctgggactacaggtgtgtgccaccacaccagcttcacaggagtgtttattt

SEQ ID NO: 179286 - DNA, 575 bp, Homo sapiens
tgacccagtcactgtgtgtccctcagcacagctcacggtggcactttttgcctgtgacatgtcaccaggcttcctatctgacttgcagccactctggtctctgagcctcctgctactcagtgtgtcctgtggagcaggagctccagcatcacctgggagcttgtgagaaatgcagcctgggcctctccccagacccgctgcctgggaatctgcattggaacaagatcccctagtgattcctatgcgttcttaagttggagaggcactgaattcttgttaatgcctcagctaaataaaggcttgaggagtgagaacttgaaggaggcagcatgaagccgcggaaagaggtgttggcatctgatagaactgaaatcacatcttgccttttcccctcatccgctgcaagtacttgctgtgtgatcaattactcaacctctctgaacttcattttctctcagtagaaataatatgagctttggtcctcctccaagttgccatatctcagaaggaccagcacagggcaggattcagagcagctgctgtaagtgctgtttgccctccctctgcatacccgg

SEQ ID NO: 179287 - DNA, 553 bp, Homo sapiens
ccacttcctcccagtgcatgtttgcacctcctttctgtgacagggagaatctatctctcatcgtccctcgtatttatactcacttggtcagtctccccatgtatgaccaatctcatttctgctgccacactctctcccttgcacatatgctctccttgcccactcagatgtcattgtccccactcctggatgccctgaatgtccctgctgggccaactctgcctatgaatgtccccctcatctagcttgggctttggccccacacctctacctgcatgccctcctccccttgcctgggctctaaccatttggagtgcagtcagccgccaggactccctggcaccaggctcctggcttgcattgccacacctagtgactctgggactggactgttgaggagtgggagggctggggaagggggagtcatgactttgaatacacttggtaaagcctgctattttcagtgctctttgctatttatttattattgtttttggagatggagtctcactctgtcgccaggctggagtgcggtggcgtaatcttggctcag

SEQ ID NO: 179288 - DNA, 374 bp, Homo sapiens
atgtcctacgacggagtcctgatagtgtggcatgttctggaaatggtacagtatgttcattatggttggaacacacattctaggagaggaagagggactaaattgcactggccctggggaaattgagctaaatggataaaagtaggcattgagagctgttggtgatttatagcccatcagcaccatgatcacactcttcccgcttctcctgctcaccacctttgcaaccaactttcctctcactgtgctgattgtctctggtacagatttatgatttccagcctcagctcagtgctcaggatgacttttctttcccttttttattctttcagacttatttctaatcagctgctttcttcattattagtagtgac

SEQ ID NO: 179289 - DNA, 280 bp, Homo sapiens
cttgttctgcaaataccacaggccccttgagaatccttagatttggttggtaacttaaattctggcaacttcccttgcaacagaactgttctatctgaaatgggcattagcaacagaaaactatgtaaccatatcacattctcctttgtactttttatgaaattcaaatgagttcacatttcaaaattgaagtaaggtagcatttacaacaaatccaagcagacccatgtgccatcatttctgtaactttggagtgtgcaccacattgtctgtaaagctg

SEQ ID NO: 179290 - DNA, 553 bp, Homo sapiens
accgcagggggtttccacacccctgtgatactcttcctaatatccacagggagagaggatgatatgactcccaatatcgcaggtggggtacaaaaccctgtgatattgttcctaatatccagagcgaaagaggatgatatgactctcaatatcgcagagggtgtacacccctcctataatattgttctgaataccctgggagagagaggataaggttacgttgaatatcgcagggaatgtacaccaacccctctgatacccttcctaatgtgcaggggaagagaggaaaatttcactcccaatatcacagaggcagtacaccccacttgtgatgttgttcccaatatgcaagggggagtacaccccacttgtgatgttgttcccaatatgcaagggggagaggatgatactactctcaatatcgcagggctgttcacatccccagtgacattttttcctaatatctaggggagagacaattatatgacagcaaaggtcgcagggtctgtacatcccttcctgatattgttcctaatatccagggggaaagagg

SEQ ID NO: 179291 - DNA, 338 bp, Homo sapiens
ccaacaatgccctattcatggcactaacactgagtgaagggaagaagaaaggtgattatttcccatactgaaaactgaaaagtttgctcttgaaaataacctggcctaaatgacaagacgtgttcattcttagaagtcaggctgtgctctgaacgagtgttacgtgtgggtaagtttttcagtgaaagaaagcctcaacgagtcaataataaacattaaacaattctgctccaagcaggaacttgcaaactcctggtgcaagagcatcaagaagcaatgagatctcgtctcgggcagagtaaatggctgaaatggaacttgctgggtccacaccagtt

SEQ ID NO: 179292 - DNA, 720 bp, Homo sapiens
gccaggagtttgagaccagcctgttcaacatggcaaaaccccgtgtctactaagaatacaaaaattagctggtgcaatggtactcacttataatcccagctacaagggaggctgaggcacatgaacctgggaagcgaagttgcagtgagccgagatggcaccactgcactccagcctagtcaacatagcaagactcttgtctaaaaatacaaaaaaatcccaggcataaaactaaaactagttctctgaaaaaatatctccagcagatctaaagtgtagtccatggatgtatttgtcagaaatgaaacttagagaatttataaggtaaatgtatttcatcaattcatagatgaggggtagatggaagtctctttggagaactggaaatagagatgtggggtggtggtaatgaaaacctgtgcatttgacgtacagagcatgctcagatcgaggctcatcctgctttcacagtcaactgtagtggtagggtgggtaacatcaggacttttctcatagagtagttctggatctacttgggttcacaccgcagagcaggaaggtaacaatctttctcgcgagcatcgctagaaagatctggtcaccaccatctcacaacaggcgttagtataaaataagcacacttaactgctgctgccacagtacctatctagagaaggagacagctccagtaagaaaaagtgagactgacggtatgcccca

SEQ ID NO: 179293 - DNA, 234 bp, Homo sapiens
agaaggtagattcatgggctggacttctgaaatagaaccaccctcttttcttccttggttctccttcacagctcttaccacaattttaaatgcttatttgtatagctgtgtgtttactgtgtgcctcctctgtgagactgcagtgaagacagatggtgtctatcttattcagtgttgtgttcccccagcttagcagtagatttcaaatgtttgttgtcacttaaatacttgaat

SEQ ID NO: 179294 - DNA, 261 bp, Homo sapiens
attaggacttcacagctgggtgtggagaggccggagccacctgcactggtccgtcagctccctcatccctctctctgcagagagggccacatttccaagatgcacgtaagaacatatgagtgcttcaaatcccagagctctagttgcaggaaaaaacattgagggggaaaatgggcagaacccagcatgccaggcaaggcttagtggctgcctgtttaaatcaacgtttagagacccgtgggtttgttcttaattggggcg

SEQ ID NO: 179295 - DNA, 159 bp, Homo sapiens
tttgtgggagtaatgaagaattcaggggattattcccatagttattagaaatatggatttggggcctacaggaaattctttgggatgttgaaactgaggaagcatcactggtagacttctcaagttgattagcaatttcacctttgatctgaaatatgt

SEQ ID NO: 179296 - DNA, 446 bp, Homo sapiens
ggggaaacacagaagggaggatcatgtgcaatgaggatggtggtgagaatgaccccctcctggctcaggtgcaggtgagtccctcttccctcagatgcttcacagcccttcagattggactcaagttctctcctcctggaagcctccactccagctttgatttttcccttctcaagttggctctgactttctagaagatcctaagtaggcttcctgttagggttccagaaccctaattgccaatactattcaaataggcacttattatacactttatcacttatgtgtttcctgtacaaattcttttgactttttagaaaaaaatatcgcataaattctttaggcatggagaatgcctaccctaagatttgctgtgttgttttgttttgtacccttgccctgtgagccttactcagttctacaaataaatggcatttcgatctgca

SEQ ID NO: 179297 - DNA, 121 bp, Homo sapiens
acctcgtaactgtggcagaggtgaaggtctcagcaccttctgtgtgccctcttgcatgtgtgtttgccagcatgcttggggctttcttcaggtgtttctggcctgaggaagtgtcttaccc

SEQ ID NO: 179298 - DNA, 572 bp, Homo sapiens
actagatcatattgggagcaggggccaggaaaatactctcagaagaggtaattctagagtatggtcctgaaagaagagcactgaagcaggagagggagcagcataaatgaaaacaaagagccatccagggggaaatacatctgaggaatcaaagaagtttcatatggctggagcgaaggttgcatatggcaagaacatgcttgctagtgctctctccttcccccatatacaaaatacacagataagacacaataaaaattaaggaaaaacaaaatgtgccaaaggaatgttgaagtttgatttctgccatgctagagtatctgcaaaacctgcattatctttttagaccaatattttgtggaaaaagcacaacctgaaaaataattcaaccttacccccaaacaagcagatgatcagtgttcactgctctgcacaacaggtaaagaaagaatctgcttattctgcttataaagagatggattcctatacaactaataatgcatttattgagtccttatgtgccagcacctttccaaatgcctgtgttttatctcatttcatcctcacaataa

SEQ ID NO: 179299 - DNA, 446 bp, Homo sapiens
ccgtgttcactaagcccctcaaagatgggaaatggatggtcccttcttaatagggtttggatccccgagggctcatatgggtggagtgggtttgggaggagacagaccatccggaatgtggagatgagaagggtagatctggctcttccctccttaatgtctgatgtctggtgttactatagctggattggtggtgcttctgctcagctcaccttagagtaatcatcactgacggaggagactggggaggtcccatccttcccctgggctcagctgggtccccagacctacacctgaaccccacgcctgtctggtgtttacggattgaagctgccaccctttgggacctatcctgttttcatttctgctctcagctctctggtctctgtggacctcacttacaggtttgtacgtgcctgtcacccacggtgcagccccatgaggct

SEQ ID NO: 179300 - DNA, 574 bp, Homo sapiens
acatgcacaattgtcttcagagaaaagctgaagaaagtaccccctcacctccatgccccaatgctccttttctctgacttcaagtgggcctctgatgctgcccacatttccctcaccaggtttctttcctttccaaaacatctgtaaaactttctgcacctttttccttctcccaccactaccagtggatgaccttatagatttctgctccatgagaaacagaagccatttgacagcaccctcagcaagagctaacattttagctcctaacaagagctagtgggcaactgatccaagcagtttacatatgtttatcatgtcatttcgtgttcaacacaatcctattagttataacttgataactaaggtttcataactggcctatggttgcacagcttgcaaaaggcagagtcagaactcagacccagtactgtctaatgtttgagctcttcaacactccatcactgcctgtcatcttccttctaatatatccacaaattcacctgcatctgcacatacagcttttcttcccatcatcttcgcataatggaacaaataaacctcctatccatag

SEQ ID NO: 179301 - DNA, 149 bp, Homo sapiens
atcttggctgcaagaagcagcaacaagttaggctcaaggtggaattgtgaggtcctgagaagagcttgctcttctgggacagaactgtatttttcttctaaactgcccatgttctggggagtcttcccgccttttggcttcagcaggac

SEQ ID NO: 179302 - DNA, 210 bp, Homo sapiens
ttggcctcccaaaatgctgggattataggcgtgagtcaccgcatccggcctgaaaattcacttttaacatttattggattcaagccaataaaatgtaaaattcaatgtttcattctcaatttcccacaactactttatttttctagctaagaatcatcaaatgaggccctcccccactttttgagacacagtctcgctgttgcccaggct

SEQ ID NO: 179303 - DNA, 295 bp, Homo sapiens
tggctgccactgtggctaattggaaaggaagttattgtggtcatcagaaatactgaaggagaaggggatgaaagtacaagtggctgtggcgacttagctatgttactgatagacttggctgttgtgacgaggtgcagaggctccagatgtcatctcataagatttgatcaaatgctttttttcttcctgtcttctggagggtggctcaccttgattgctttctcactttgtgcattttagattgaatcactccatctcactcttgcactcattttatatgaaatataacctaatt

SEQ ID NO: 179304 - DNA, 306 bp, Homo sapiens
cttctgtgagtttaaaatattttgagaggtagatgcaaggatggaaaataagagatcagtaaggaaattacaatagtccaagtaaaagatgatgtttttggtcagatggaagcagtggagaaggaaatacatggataaattagagatgtatgtgagagaggctggggttacacctgtaatcccagcactttgggaggcccaggcgggtggatcatgaggtcaggagtttgagaccagcctggccaagatggtgaaaccctgtctctactaaaattagccggatatggtggccctcctgtagcatgt

SEQ ID NO: 179305 - DNA, 220 bp, Homo sapiens
aggtgcttggacaagtctcaggtgtgtctgcctgtggctgcacaggctctctaatccgaaacctcactttcagagagatgtgggtcctttgtctccaggatccacaccctagattcttaacactgcattctccacatctcctcgaggttttgtggaaaaggagtgcatttctggttaactggaatatgaggttggtgaggttgaggtaggtctaggttaa

SEQ ID NO: 179306 - DNA, 484 bp, Homo sapiens
ccagtggcccaaacccaggagagagctttctaccgacagattctcctcacgctgagctgtttacggaaaccacaagttgaaatccaaaagtataaatgtaaagtccagttttcagttaaaaaaagaaactcattgtgtgagccccaaaggggagcctgcccagaccacagggaagttcactcttggcatatttcacaatacatatgttcaacacataggttgcattaatagaggcaggaggtccagagcaagggaggtgacagtccagcttatgtcttgccgtcacaccacactctctggactgcatgcctagtttgaggtctggtgtaggggcccctccaagggtgctgtggtgcaggttgaggccctgcagtggccagtgtctgaggtgtccggccagggctttctcaggcctggccccacagggctgtggctctgcagacagactcatgctgtctctcctctgtgctgggataacacgcag

SEQ ID NO: 179307 - DNA, 405 bp, Homo sapiens
tccctcggtagatttgatacaaataaaactatactgtgaatttttaacaatttgaggcaaaaatagactaataagagcagacacataagttagcaaatgcccattcagtaagtacaaaaaataacttaatacttcacaataaagtttaaaaaaaaggtaaaactaaaatggaaaaccaaggttaaattcaagtttaaaatcagaaatagagaattaaatagaataactaaaatgaataattggcaaaaagatctgcttctattcctaaatgcttggcctcccaaagtgctgggattacaggcatgagccaccatgcccggccaaaaactccaacttttagaggcctatttacagcacttgtcccatatttgttcacactttttctgtatgtgtgtcgtgaattat

SEQ ID NO: 179308 - DNA, 618 bp, Homo sapiens
atcacttgtctaaggtccccaggagaggaatggatggaataaaaaccaaacccggctgtatgacttcatatccgctgctctgaacatctgggagggctctcatttgggcattactcttcccatccaccctaaagattggcgagaatgattgcagtttagtgatagacattctgcgaagggtgggacctttctgcccatcaaagaatcattctgcccaaatgccaccaatgcccctccttgagaaacagctcaaaactctatgtgtaaacagcatctggcgtagtacttggctgcatcccatgacttgggcaagtgcctggcaagtgtaggggcttaataattgattgaatgagtgactgagtgaaagtcgcagacaagagatttggtcccctcatttgccaagtgaaggtagtaatgttacctcttttatgggtggcggtggtaaagattaaatgagaagttagatgtgaaaatgcattgggaatggatgtaaacctatgtaacaaaactgcatgtcctgcacatgtatcctggaacttaaaattaaataaaattaaattttaagaaaagaaaaaatgaatgtaaaagcagtataaacatgttgttgttatgataaat

SEQ ID NO: 179309 - DNA, 148 bp, Homo sapiens
cgtcacactaaatatatactcaatagaccatttttacagtttagaagacagtagtcaaaatcctctttattttctttatttacatcagccgtttataaaatattgactgataggccgagtgtggtgtctcatgcctataatcccagca

SEQ ID NO: 179310 - DNA, 329 bp, Homo sapiens
caaagcttttggattctatgatgtgataagggtaaaaagaatacccaaggatggaaacaggaagccagatatatcagaaacctcatatttctgaacttaaaaaagaagtgtctttcataagactctaattttcaaagtactttcacagctttcagacaacttttgaggaagaggatgaaagagaagtggcagctccactccgtgtggcaattgaggaaagggaagaagagaaagtggtgccgagtgttggttggggtccagcagccctctccccagcaacaatactcctctaggagtcttcaaagtggtttcctacacgttgcctcctt

SEQ ID NO: 179311 - DNA, 827 bp, Homo sapiens
ctgttcttaacacacccacctttcctattatactctgagttcctcaagggcagggatcatgttttattcatctttttttcccctagtacttggaatactgtctggcatataagaggcaaccagcaaatttttgctaaatgaacaaatgtagaaagtttatttgggtggtagaacactggagatgtttttgaataaaggtagaaccgccattacacaaaatatgtgaattaagcaagtctttaaattcaaatcttggcttagttattcagcacaataatatgtttcagccattcttatttctggccagtcatatctgagtaagactgtggaaaggataaggggaggaaatcatatgaatactactcagtgctccttggagtacactaaaaataaaataaatacctgtttcttaaataattacctttacaaaaataatgctctagtaactctccattctggatttgacaagtatgaaatgatttgtactagatgctttgtatttcctgctggaaatctccaagtttaataaaaatctaaataaaagacattagttttcaattttacatatatatttattgaagaaacatcattgagcactcacgtgtatgttaaatactacacagtttaaactgagttctccttaaaataaacttttgcactgtgaaaaatattgtagtatatggctgatatgggagcatttttctagcatcaaaaaagtaaaaaggccggggttgagtaatgacttaaaagcagccatggcatgtgagaaagaggctgatatcatctcttaagattcagggtcaaggaagatgagcagcaagcatttg

SEQ ID NO: 179312 - DNA, 344 bp, Homo sapiens
cagtaggtgggaagatgaaaatgacaaagaatggtagaggatagtattgctagagggtataagccttaaataagccaaaggtatttacataaaaagggttgagtaatgacttaaaagcagccatggcatgtgagaaagaggctgatatcatctcttaagattcagggtcaaggaagatgagcagcaagcatttgatagggctgcagaggaaacaaattttctgtggaggcccaggtttcaagacagacctaaagcatgtacagttccaacaacatggggccagaatgactcggcttccatgtgaattctcatgaagtttctggggtggtggaaggactatgagc

SEQ ID NO: 179313 - DNA, 522 bp, Homo sapiens
cggctagaagacacgtgccatgcgccgccggctcaacaagcacgaggagaacctgaagaccaagaagcaggaagcggcagaagcaggaagccttcctgcttctgcccctgcttctgctaaccctgactcgtacacacaagtactggtgaaggggtggagcaaaggaaactagtccactctcatcagggccaactcacgcacctggcaatctctactcatactgaacacaagtatgccctatagcccagcaatgccattctggacatacacgtccaaaagaaaagcaggtgcacagacacaagagacacgcgtgaagtgcttcatagcagtggggtttgcggcgtgccactaggatgtgagggtggaacactacacagcagaggaggcaaacacatcacaacgtaagtcaatctcacaaataatgttgaggaaccctgtctctacgaaaagtttaaaaattagccgggcactgtggtgcatgctggcggtctcagctaccagggaggctaaggcaggaggatc

SEQ ID NO: 179314 - DNA, 650 bp, Homo sapiens
ggtagtgaaaccttagcagttatacctatacctacaaaatatgtaggtaataacaaaaataagataggtgacttcttgtttttgctattactggctctctagtatacatggatgtggtattaggacatggctgaacttttataccctatcagaatatcctgaatggagtttcctctggagtacaatgaagtccctcctatcatatctttctggcttaaagattattgaaatcgtatttataaacttgttagcggctgagcgcggtgctttatgcctgtaattcccagcactttgggagccggagtcagtcggatcacctgagttcaggagttcgagaccagcctgcccaacatggcgaaaccctgtctctactaaaaataccaaaaattacccggggcgtgttggcagacgcctataatcccagctacaccaggaggttgaggcaggagaacggcttgaacccgggagacagggtttgcagtgagccgagatcacgccactgcactccagcctgggtgacacagcgagaaatatcaatgttcaatgtgtcttcaaaatgtttatattctttcaaggctcaactcatttacataaccttacctaatcaaagaattccatcccagctcctgtagcacttaaacatgtacccc

SEQ ID NO: 179315 - DNA, 562 bp, Homo sapiens
aaggatcccgatgtgagccacacacccagctactttagtctgttaggtgtgtaaaatgagagatgtgcggccgggcacagtggctcatgcctgtgatcccagcactttggaaggccgaggtgggtgatcacttgaggtcaggagtacgagactagcctggccaacatggtgaaaccccatccctactaaaatacaaaaattagccagacatggtggcagatgcctggaatcccagccccctctcccctgggcagctgggaccacaggcaagtgccaccactctttatttctttctcttgtctgattgctctagctatggcttccagtactatgtttaataacagtggtgatagtgggcatctttgttgtgttccagatctagaggaaagactttcagtttttcccccatcagtatgatactatctgtggttgtcatatatggcttttattatgttgaggtatgcctcttctctccctagttttttgagggttttttttgtcatggtgagacattgaattttgtcaaatgctttttcagcatcagttgaaatgatcttgttgt

SEQ ID NO: 179316 - DNA, 443 bp, Homo sapiens
gacaaggattataatagaatatataaataatctttgtcaaagaccaaccacagcaggaaattatttagagtattttgtgccatttgccctctctacaccttgatcagctgcaggaactgtgaagatcacagggtgcatgcaagattctgaaagcacatgcactactgcaagcaaagttcaccctttggtcctcacccttgccattcttcactgactgttcaagtgctagtgaaaatttagaccaaagatgatcatccaaactctttggctatgtcgtataagtgggacaatttaagaattcttcaattaattcaaaaagaaaagctaatgtaataaagagaaattcttgtaagtgtggtctaaacatattttctaatcattaccagaagtactatgtttcaacataagattactcacaaatccttccttatactcagaggcaa

SEQ ID NO: 179317 - DNA, 433 bp, Homo sapiens
gagtttaatcatgtcacaggtcctctaggcgtcagtttcctcactgtaaagtaacaagagttagattgaggacttcaaaggtcccttacgtctctaacgctcacatatccacgaaacccacacccagggaagcagtgaaccccagaaagtgggaggttaaggttaggttggcattttgcttctgtctgtgaggtggtgctatgtatacctagggtggggggaacagttttagattggagtggggaagcaggctatggaaccatatacctcagtctggccatcaccagaggcttcattatctgaagagtacttcattatttgttgagtatttccaaaactgaaattccaagtataaacatgaaaagattctagaagcaactgtacatgatttggagattatctacccgaaggctctagttccaaaacatcacag

SEQ ID NO: 179318 - DNA, 598 bp, Homo sapiens
gctctcctccaaatccaggggctccccgctttgctctcccttgctggatcctccctctcttcctgttacatggtgaagcaccccaggtttagtcctcaatttttcttctatacttatatccaatttcttgatgatacatccagtctcatggctcaaaaagcttttgatctaatgacaattcttaattctacataattctaggttccactttctcacctaattcctgttataaccaaatgcccattcaacatttgctatcaacttttatactttcaaatccaattttttgactttcctcccaaacctgctcttgtaaaagtgtaaataaatgacaactccaattgcttgaagttatcacatatcatatcacaccaagtctgtcaaaattcctagcagttttaccttcaaaaaaatccatgatcttactacttctcagcaccttcaacactactccaaatcactttaatctctaacttgaactgcaaagacttccttattggaatctctgctttccccactgccctcaaagtctattctcaggccagcagctggaatgatcctttgaaatacaaattacactttgtccctcctttcctca

SEQ ID NO: 179319 - DNA, 440 bp, Homo sapiens
aagattgcacagagagaaagtgagcatccgagagaaaatcaccacaagtgaggcagagggaggccggtctcagcagagttttggaggtcgtgagaagaagaggtaggagataggagagtggttccgagtacttgcctgctgatgttaccttctccacccccaccaggttttccagtgcctggagtcttgggcaggaatgggccactgtaagaaagagctttatcactagggcctcagccaacttttctgtgggatatccctccaaaataattaagagttcagaatgcttcagattttgaagtgaaactggtacatatattaagtgttacttaataacccgatagtttctagggcagctcaccataatcccaagtattagccaccaccctcacccccttcagagtaaaatgtgtttcctgaaggaagttgggaaaatgaag

SEQ ID NO: 179320 - DNA, 649 bp, Homo sapiens
tgagatagagtttcgctctagttgcctagctggagtgcaaggcaagatctcggccactgcactccaacctgggcaacagagtgagactccatctcaaaaaacaaaaataaaaataaaaaaataaaaaataaaaaataaaaattaaaaaaaaaaagaattattttcggtcaggcacatgaatttatttttacaatgtcctttagttaaagttgagatccaagttgggcctagactgaagcatgtccctcaagaagaacagattattgcaacacaccatgaatactatgaaaagagagacatacaagatacagtgggtttccagaagacaaaagtatctgctatatcaagaaagacttcacggaggaagtgacaggaacactgagtccttaagatttaatgagttccaagcagagtatcagttataagaaggtatggggcacactgcatctgactgaagcccagaacgataagagttcataaaagcaaggtctggattacaaaaggattctggcaaaatactgaggcatttttatttttgtctgggagttgttttttgtttgtttgtttttattatactttcagttttagggtacatgtgcacaatgtgcaggtttttacataggtatacacgtgccatgttggtttgctg

SEQ ID NO: 179321 - DNA, 704 bp, Homo sapiens
tgccaaccgaggtggccacaaaaatgagattagtcctaagtttcttttcatctattgtattcaataattctagttataaaagtagctctctaaaaatatgctttaaattcaaattggctcttcttttactatctgggttacctaaaaccatctcttctgtttgtttgttccttaacaaactccacccagttgtttctccaaaaactaagtttttagtctccaagccagattatatgtcactacctgttatgcatcctgcaactccctcaaacattctaggttatgctggcccctgatttttcatggtcctattactacaaaagctttgaccacactacattatgatttgttgaatatatttctgactcactcagctgtgtgcttttgaagacagaaataatgccctttccatattctcagccccagcattaactcagtacttgttttctagtgtgggctttacaaatgctaggtgactaaatggattatcactccttttatttcagtgaaatgacaaaggttatcaatatcaagtccctatatttgttcattctcatctcaacaaaattttgcatctactcctgttatattggactaagtacaaatagaatccagcagcatgttacaagactgtattaatccattcttgcattgctataaagaaatacctgagaatgggtaatttgtaaagaggtttaattggc

SEQ ID NO: 179322 - DNA, 512 bp, Homo sapiens
acaggatcagtgctggggccatctgtgcactgaccaaagcctctgctggcctcaccagaccaaggccagtgagtgcttcagggagccttggatcctccaggctgccaacagaaacaccggccctctcggcagcagccccatccttccacccctgcactgggtcctgaaaagcccattttggggccgttgctatttagccaacctgccctcccttgctctcctgtgatttctcactattccggctgcagctcgctgggagaaacacttgagagtcttttgtgctccacacccatgtacttaaaataccaggcctataggtcatttcaatgagggaatttggctcataacacgtgtgccccgaggcacagatcctacttctgcagatgctggccaagaagggctgtgtcccagccgccatggggtggggccacagagagggcagggccacgtggagggcagagcatgtggctcctgtcaggtgcgcccgttgctgactgcagcccagtatcaag

SEQ ID NO: 179323 - DNA, 190 bp, Homo sapiens
aaaggtgagaggaagggggtcatattacatggctgggcacccaccatgtgccaggcacttccgaaggtgttccacgtgcattgtcttaatcatgacctcaggaagtaggaggcgttatccccctaagataaataaggaaagtgaggttcagggagcttcactttcaataatgtgtctgaggccacgtagc

SEQ ID NO: 179324 - DNA, 218 bp, Homo sapiens
ttaaatttctcaacaaagatctcttcatacaggttatccatcaagtttctaaaaacaatgaaaataaattttgattatttcaaataaggtgtagaattttgctaagtatttagattataaccaacagagtacctggacagaggtttctctttgctctaacgcaagtgccacttcagcatctaaccagaagcaggaatagagaaagcagtcctgatttt

SEQ ID NO: 179325 - DNA, 221 bp, Homo sapiens
ttgccattcactggctttggttgggtcatttgctcatccctgaaccaatcactgtggccaaggacaggggatactctaattggtgaggcctgagtcatgtgcccagtctagcccctgggtggtaaattcagcatggctgaaagtgaggaaggtgtagctccctaaagcaaagccaggtactcttactagaaaaagggagaatacagttctgggtgacataa

SEQ ID NO: 179326 - DNA, 534 bp, Homo sapiens
atcactcgatttggccactgttcctactttttcatcactccttgccattgctgcagttatgtccttgtatgtgccgttatgcatatgtgcaaatatttttataggatacatgtgtgaaagtagacttgctaaatctaaaaatgaacactttaaattgtgcccctcgctttctggcattcaacttgtatcttcatccatggcgcatgacaggggccttttgtgccttttcctttctcatctctgggctgtatctttttaaggaaggcttttcataactcaacacaataaaattattatcttacttttatcctgaatgcatctgcagttttgtttacttttctcgctttttaatctacctgaatttggttttgcatatggtgtatgcgaaggagatggttttcaatgcaagattaaggaagcatacctttactctgtgatcagacaccacaacgcctgtgctgacacacgctcacactgagagtagagctacctctagtctcctaggcccttttctccagtaatgttccatttcta

SEQ ID NO: 179327 - DNA, 197 bp, Homo sapiens
ttattactagcttcatggacttgaaaaattacttatccttaatttgtagagataaaattggctgctttttctgttttcatgtagataaataggatcaaatgagagaaagggatgaaagcatttgtgtttgtttttaaactttttattatgaattttttttttttttggacccgggccaacaaggggagatcccttct

SEQ ID NO: 179328 - DNA, 333 bp, Homo sapiens
tgtgctgtagctatcttgtggtttggatttgtgtttccctaatggctaatgatgttgcgcatcttttcatgtgcttgttggcactcttacttttaacagttttgttaagtcactcggaagaggaaagagtacatagggaagtgcatttactcccaagttgctaaagaccaaaaaacttctagaaccccacctgcactaacgaagactctaaccccccaccagaactgtctaccctccaccgtggcaccatggtgtgcccgggaatgcggctggcgtggccaggcctcactcgcttcatgattctagccgcatccatctttgagtatccctctc

SEQ ID NO: 179329 - DNA, 119 bp, Homo sapiens
cgtcttccttgggcatgttagagacttgagaaatacttgctgtgtgattaggttatttcgtctcttaaaatagggcgaggtggtttacagccctttctgtaatattttgaatctcttgg

SEQ ID NO: 179330 - DNA, 176 bp, Homo sapiens
gaaacctttaacccaatacccagaaaaacagacatttggaggaagagggatcttccagattattcttccattctgccccatcctctacagagaaggaaactaagacacttttcaagaatcacaagataagttaatgatagaaagcagagtagaatcttgagtggaggagtgaaaat

SEQ ID NO: 179331 - DNA, 767 bp, Homo sapiens
gcaataaccctggaagtagatgactccacattctgcagatgaataatttggggcttagcaacactgggtgatttaaatgcccagtgacagtcgtgatgaaatctgaatccagatgtgtcaaaaatctctctccaccacagtgtactttattattttttcagtagtgaagcgcttcttaaaaataagtatgtaaaaaaattagtgaagtacttttaaaagataagatacacctactaaatagatattttacataagtgattactaattcagtttctgctttacattgctaaaatgtaagccagatgagcttatcatagagcctatgtataagaggaggactgaatataaattgcatgctgtaggctaaagaattattttccagtaatatatctatatcaaatcttttgtgctttgtttcttggtaggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatgtaaggattgacctcaaattagctgggcatggtggcgcatgcctgtaatggtagttactccagaggctgaggtgggaggattgcgtgaacctgggaggtggaggttgcagtgagccaagattgtgacagtgtattccaccctgggtgacagagtgagactctatctcaaaaaaaaaaa

SEQ ID NO: 179332 - DNA, 1607 bp, Homo sapiens
tgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaacggaaacttgtctacacttgattagagaacaactatattttacttcccataggaacgacagaagcttttacaaggagttagagaacaaaacacatcaatataattagtagcacttttgtttaattaggtgtgatggttaactttatttatatgtcagcttgactggctaagggatgctcagatgattgatagctggtaaaacattatttctgggtt

SEQ ID NO: 179333 - DNA, 768 bp, Homo sapiens
tgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggtaagtttttgaatttgaggtttgtggagttaaattgaattaccatacaataatcttcataggcccaagttaaattttttaaaaatctaaatatgatgggtttggttgctgtccaaaaattatagttaaccctgtgctgattaatattgtgggccttggggtcaagagtccctggatttgaacctacctgtatagctattatgaactctgtgacctttggcaagttactgaacctcttagaatttcactttccttgtgggtaaaatgggaataataataaaatgtgttgctgtatcac

SEQ ID NO: 179334 - DNA, 1562 bp, Homo sapiens
gcaataaccctggaagtagatgactccacattctgcagatgaataatttggggcttagcaacactgggtgatttaaatgcccagtgacagtcgtgatgaaatctgaatccagatgtgtcaaaaatctctctccaccacagtgtactttattattttttcagtagtgaagcgcttcttaaaaataagtatgtaaaaaaattagtgaagtacttttaaaagataagatacacctactaaatagatattttacataagtgattactaattcagtttctgctttacattgctaaaatgtaagccagatgagcttatcatagagcctatgtataagaggaggactgaatataaattgcatgctgtaggctaaagaattattttccagtaatatatctatatcaaatcttttgtgctttgtttcttggtaggctgttataatggattagtttatgttctgaaaagtaatagtggagaaaaatactggatgtttactactgaagatgctgtcaaaagctcggcaaccatggatccaaccacaggactcatttacattggatctcatgaccagcacgcatatgctttagatatttatagaaagaagtgtgtttggaagtcaaaatgtggaggaactgtcttttcctctccgtgtttgaacctgattccacatcatttgtattttgctacattgggaggacttttactggctgtaaatcctgctactgggaacgttatttggaaacattcctgtggaaaaccactcttctcttccccacaatgttgctcacagtatatttgtattggctgtgtagatgggaatttactctgctttactcactttggagaacaggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaacggaaacttgtctacacttgattagagaacaactatattttacttcccataggaacgacagaagcttttacaaggagttagagaacaaaacacatcaatataattagtagcacttttgtttaattaggtgtgatggttaactttatttatatgtcagcttgactggctaagggatgctcagatgattgatagctggtaaaacattatttctgggtt

SEQ ID NO: 179335 - DNA, 364 bp, Homo sapiens
gatggtgctggtcagtgcatgtggaagaaatacttaagataattgtattttaaaactggaggggatacagagatctaaatggaggtaaggtctctacacctcactggaagtggtaaaacattgacaccagtaagctgtgataagttacctatgtgtatggcaatacttagaacaacccctaaggaaactgtgtacaaagcagtgtactcagaaacattataagtaaatcaaaatgcaactctaagaaatgttcaaggccagttgcagtgactcatgcctgtaatcccagtgctctgggaggccaaggcaaaagcattgcttgaggccagatgtgtgaggatgtagtgagctatgatcatgccac

SEQ ID NO: 179336 - DNA, 526 bp, Homo sapiens
gttgtgaactgtgttgaaatgacaaggaatgagaacattatataaacttagttgatacagcagtggcagcatttgagaggactgactgcgatgctgaaaggaggtccactgggatacaggtgggagccacggtgcccagcctgtaaacataacttccatatgcactgggaaaccacgaaatttgtgtgactcgctttattgccgtatctctaccgtagtggtctggaaccacggctgcaggtcctctgaggtgcgcctgtggagaggcccagctgtgctctggaaatgtgcaccagctgctaagagtgaccttcgagggaagcagggcgcatgggaccctgggtgctcagacgctgctttttctggcactattgtaaccttttcaccacacgtacgtggtcactttttaaaccgtcaatagtggagtgagatttgggggcattttggttcttcttaaaactcttgcctggaaataaatagctgtttgtagtttttatagtggaagataaatacacaccttaagaaa

SEQ ID NO: 179337 - DNA, 484 bp, Homo sapiens
aatataaaaaaaaataattataaatataatataaaaataaaaataaaaaaataaataaaaaaaaaaaatagatacaggtgggagccacggtgcccagcctgtaaacataacttccatatgcactgggaaaccacgaaatttgtgtgactcgctttattgccgtatctctaccgtagtggtctggaaccacggctgcaggtcctctgaggtgcgcctgtggagaggcccagctgtgctctggaaatgtgcaccagctgctaagagtgaccttcgagggaagcagggcgcatgggaccctgggtgctcagacgctgctttttctggcactattgtaaccttttcaccacacgtacgtggtcactttttaaaccgtcaatagtggagtgagatttgggggcattttggttcttcttaaaactcttgcctggaaataaatagctgtttgtagtttttatagtggaagataaatacacaccttaagaaa

SEQ ID NO: 179338 - DNA, 490 bp, Homo sapiens
ggatcacttctctgtctcatccagccctcttcaggatactggcctgggcagcagggttggtttttgttgaagcccaaagcacagctaggcaacttcatcatgcagaaaaatgtatgaaaagggcttttgatgtgggtgacagcatgtgtaaagagacggtatccaagtgtgtggactttggagtcagactacctagactctaattcacctccaccacatacagctccctgaccttggcaggttacctgctctctttaagcctcacttcctcaccagtaaaatggggttaaatgtgaggattatgtgagttaattgatggatggaaagggtttagcaagtagtagtgccacgtttactggcacattgtaaatgcccaataaatgtgagctcctcttctgtacatccacacagctatggggcagggtgaagacatgacttctgagtcctaattgcattcattggctgcagaagtctggtgcccttgaactag

SEQ ID NO: 179339 - DNA, 260 bp, Homo sapiens
cttcatactttttaattttgctatggtgttactagcttcttgctagcaaacatatcctttgatttagcaagaaaattctacaaatagcatcataaccaaaagggataattctaaaggtaggaatttggggttattagtcattgaataagggtgataatttcatgtatgtgccaaaatttttcaactctacgttagagcaaacaaatggcttctagaaggattgctggggtgcctatgtgaatcacatacatgagatgtct

SEQ ID NO: 179340 - DNA, 251 bp, Homo sapiens
gataagtgaattatatctcaataaggctgtactggaaaagacagaagagttcaagaaaaatgtttgaaaaacagcccaggtggtatacacatatcaagaaaatcccgaagtgatacaagaatgactggagtttggagtttaaacacggagctcatgcattagctttacctaggttcaaatcccagctccaccacctcctagccgactgaccatgggctaatgacttaagctctctccacctcactttcctc

SEQ ID NO: 179341 - DNA, 775 bp, Homo sapiens
ggtggtggctcatggctgtaatcccagcactttgggagcccaagaagggcgaatcatgaggtcaggagttcgagaccagcctgaccaacgtggtgaaaccccatctctactaaaaatacaaatattagccaggcgtgatggcacgtgcctgtaatcccagctactcaggaggctaaggcaggagaatcacttgaacctgggaggcagaggttgcagtgagccaagatcatgccactgcactccagcctgggtgacagagtgagactctgtctcaaaaaaaaaaatgaaaataaaaaaataaactacaaattcaatatgatttcaaagaaacaccaacaaatacattatagttgttgttgttataattagagttgaaaagacatttttaggctgaaaaaaacaggaaaattctgacaaatgtagtaatgactaatttactaaatattctactaatctacaaaaatacattaaaaacttacagttaaagaaaactaaatttatattggcctgaaacagacaagcatattacaaaatagaataatggaatgaggtaatgatttataaactttacaggcagaatatataatatcttagtttaaaattgaacagcatacataatctaatttacctcaaaataactgatcaaaaggaaaaaattaattctatggatccaagatagaattacttactccaaaagactctaaagaattccacaggagaaaaaaaaaactccttacaactatactccagctaaacatctgttctctaattaata

SEQ ID NO: 179342 - DNA, 253 bp, Homo sapiens
ctcctgggttcacgccattctcctgcctcagactcccgagtagctgggactgcagcaacccgccacaacacccggctaattttttgtatttttactagtgaggctgattttaaaaatcaaaatgtatttaccagtttgtagtttatattttgtgaataaatctgttcacgtcctttgccaaattttctaatggggatgtgtttctttaattgatttctaagatctccttatacagcagcaatattgaccccgt

SEQ ID NO: 179343 - DNA, 523 bp, Homo sapiens
tggtgcgcgcttccagctactcaggaggctgagatgggaggatcgcttaagcccaggagttccaggctgcggtgagctgatgacgccactgcatgatgaatctttagttgttcaaacaacaggaaggatggtgttgcagtcaacagatgaggaaggctgagggtgaagcaggtttaaggggaaagagcaggagtttggttttggacctgttaaactgaaacatgccagcttggcgtccaggtggagagagatgtgtaagtctccaggcaggctgacctctggtgggtggtttaagtttgggagatgtccgggtgtgaattgtaagattgttggagctctaagcctggacacatctcatacgtacatggagtgaggcctgggcctgggcccccactgctaggaggttaggggaaagaggaggaagccacagagactgaggagagaccagtgggtttgcagcaaagggcatgtgttcccaacgtggtggggtcctattctgtgccaggtgtcggcatggggaggg

SEQ ID NO: 179344 - DNA, 252 bp, Homo sapiens
agggagaagtgaagggtaagcttggaatgtgaggttacactgagggcaaatgccaatgtcgatgttgcatttgatctgaagactaagcctggagttactcatagagagaaggggacgaatctgagttttgctttaagcttagatcttaaaggtggctaggatttttacattagttcttcctctgacttctggcataattaaacacaaatttgtctgtagaaaagtactccaaattttacctccaagatattg

SEQ ID NO: 179345 - DNA, 288 bp, Homo sapiens
caccccagagagtttctgagtcagtaggtctggggtggagcctgagaatttgcatttctgacaggttcgcaaggtgatgctgttcttgctggtctagggaccacactttcagagccactgctataaagtatcctagaaattagctaccaggactacttccaaaaatgcagtctctctctgtggaatctggccaataagatacaagcaggatgaaaaagttgtttgctcagcacttaattctgaatgatgctataatagctcttctacaaagggtattaaataaatctg

SEQ ID NO: 179346 - DNA, 471 bp, Homo sapiens
atctctttacagaacattatgtaaaccatccattagacatattgccctcgcatgtcccatgttctggactatgtttcccatcatcttctctgcgcgttcattctgggtacttccttctgacctgttttctggttcactgattttcacttcactgtatatatttcgttattaaacctgtacacactgaattattcttattattattgagagagggtcttgttctgtcacccaggctgggagtgcacttgcacaaagatggcttgacctcctgggctcgagtgatcttcccacctcagcctcccgagtagctgggactacaggtgcccaccaccatgcccggctaattttttgtatttttagtagagacggggtttcaccatgttagccaggatggtcttgatctcctgacctcgtgatccgcccatctcggcctcccaaagtgctgggattacaggcatgagccaccacgcc

SEQ ID NO: 179347 - DNA, 495 bp, Homo sapiens
tatgtcctaagcaatgtcctaggtgttcatgtaaccttcacagcagccctaggaagaaggcattattatacccaatttgtagttgagaaactgaaaggaaggtgagtaaatgatttcttaaatgtcaccaagcttaaatggcttacctggaatttgacctcatatttcctttgcagtaaggtactctgatgtcaagagactaggtaatatgtcatcagcaaagagcagcctctggcagtagaatgcaatattcaaatactggctctgccgagtactacttttctgaccttatccagggagtcattgaattgctctgtgcctaattttccacagctataagttgtttaccctctctggccttttgtctccacatatgataaatgcgatgattttagtctcttactgggatgctgtgaagtttaaatgagatattatgcatataatgtttgaagcacttgacacgtatgaaacaatgaagacatgcccatcattgtt

SEQ ID NO: 179348 - DNA, 157 bp, Homo sapiens
agtgaggcgaggtcgtgccactgcactccagcctgggcgacagagcaagactgtctccaaaaaaaagaaaaatgtatatatattccattccatcaagaagatattttatggacatgttatgattcaacaacatagcttcaaactacttaaaacagga

SEQ ID NO: 179349 - DNA, 241 bp, Homo sapiens
acggtcaggatgagcttttcacgacagcaggtggtggaggccaagtcccccaggattaaacagggaagtatggaagcacaggccctcctgccccagttgtaatcaagaggagggctccttcaagcaatgatgctgctctgaagcagatatatgggaatgcctccttttaataaactgaaattcactttcttgatgtaggtgccaaattcattcaaaaatatataaaactaacctaaacaca

SEQ ID NO: 179350 - DNA, 247 bp, Homo sapiens
cgcttcttatcttcaatcgttacaggtaattctttctaatgtagtgtcatcttctgaaacggttcctctggtagcctctgatctacagatgtggagttaaatcatttagattaaacgaaattagagatttcctatctctaagacaaagatagaggtaaacataaatttagtttttgacatttttgccttgtaacttaactgaccttagttggagataattgttaattaagcttgtggatttgggtct

SEQ ID NO: 179351 - DNA, 250 bp, Homo sapiens
aatgggcagctaatgcattcagttatttccaatgaaataatttccagtgaaacttgtgctaagttgaatatttccaactgtaagtggagtttgtaaatataatttgtcttgtggaattgattcccaaaagttaatttttgaaagctcaattgagaaacttaggaagcaaatacccagggctttgggaacatgcattaactatatgaactgtaatgcagtgttatgagaacaccttttcctctattagcct

SEQ ID NO: 179352 - DNA, 314 bp, Homo sapiens
taaaatagcttcttactctgttttgttgtttatacattgtatgtttggcttcttgaggtctctggctcctcagtttttccttggctcataacatagtatcctcattgatccaagcatgaccctgttttgcttatttttattttacttatactaataatataatgaatatccacaaattcagtgcccaatgaggcaggagaatcgctcgaacccagtaggcagaggctgtggtgagccaagatcacgctactgcattccagcctgggcaacagtgcgagattctgtctcaaaaaaaaaaaaaaaatatatatata

SEQ ID NO: 179353 - DNA, 230 bp, Homo sapiens
tctagaggatcccgccacggtagattgcctcaaatatccaaacttcaccccacagagaccctcccctaggcacccacatcctggcatgttcagacaccctcctcgtgaacatgcacagcccccaaggcaccagatagacattgatttccatctagaagtgtccgtcaaaccctcagcgatatatctctgccgcccaggctagagtgcagtggcacagtctcagctcactg

SEQ ID NO: 179354 - DNA, 543 bp, Homo sapiens
atataaagcagtggcttagacatgtatatccctcctgtgcctgaccaaatggcgtgaactttgagaatgaaagtacttaataaatgcttgcaaattcgagatggagccgcatagcataatggatgaaaacgctgacactagagctaaactaactacattcaatcctggtttggccacttatcatctatgtggtcttggactagtcatgaaacttttttgtgcctcagcatattcatctgtaaactgtcgtctatactagctgggcacggtggctcacgcctgtaatcccagcactttgggaggccaaggagggcagatcacaaggtcaggagatcgagaccgtcctggctaacacagtgaaaccacatctctagtaaaaatacaaaaaaattagccgggcgtggtggcgggcgcctgtagtcccagctactcgggaggctgaggcaggagaatggcgtgaacctgggaggcggagctttgcagtgagccgagatcccaccactgcactccagcctgggagacagagcgagactccgtctcaaa

SEQ ID NO: 179355 - DNA, 337 bp, Homo sapiens
attttattccccatacttatagtgcttgacatctggtaggcactcaatttgaataaataggtgaggggatatacaaactaaaactatcacttctctcctccacctgtcatttcagtttttcttctcgattaatggctttattgttacatttgactggtttaaaatgttggggtcatctctggcttctttgtattactgtgcacactcaggtagagcctgtatgttcatttccctttgacatgttcttctagtctattcctcctccgacttctctaattgagtctcctttgtcagactactgtgataacttcttaatggggttcactggcccccacct

SEQ ID NO: 179356 - DNA, 730 bp, Homo sapiens
aagaccaacctggccaacatagtgaaaccatgtctccattaaaaatataaaaattagccaggcatgatggcccatgcctgtaatcccagctacttgagaggctgaggcacaagaatcacttgaacctgggaggcggaggttgcagtaagccaagattgtgctgctgcactccaacctagggggcaaagcaagactctcaaaaaaacaaaaaaacagggagagttttcctgttgatagtcacctgggctgtttcctgtttggagctttatgaataaggcttctgtgaacattcttgtgcaagtctttttataggcataggtttttatttcatttggatgaatatctaaaggcagaatggctgggtcatatggcatgtgaatgtttaactttataagaacctactgggctcggcgcggtggctcgcgcctgtaatcccagcactttgggaggccgaggcaggcagatcacgagtgtcaggcctctgagcccaagccaagccatcgcatcccctgtgacttgcacgtatacatccagatggcctgaagtaactgaagatccacaaaagaagtaaaaatagccttaactgatgacattccaccattgtgatttgtttctgccccaccctcactgatcaatgtactttgtaatctccaccacccttaagaagattctttataatttcccccacccttaagaaggttctttgtaattctcccaacccttgagaatg

SEQ ID NO: 179357 - DNA, 718 bp, Homo sapiens
ttttcactaaccgccaactggaatttggcatttccttcccttacgagcagacgtgggaaaccacagtggcagtagctggacggtggctttgtcaatcagaaatcctttgtccatgtctctttacagtgtcatagaaagagcattcgtcctcttcctgatttcaaaattaccatagttggctgggcatggtggcttgcgcctgtaatcccagcactttgggaggctgaggagtttgaggccagcctgggcaacatggtgaaccctgtctctaccaaaaatacaaaaaattatctgggtgtggtggtgtgggcctctggtcccagctactcagggagctgaggtgggaggattgcttgggcctgggtggtggaggctgcagtgagccataatcattccactgcactccagcctgggcaacagagtaagtgcctgtttcaaaaataaataaataaacaaaaaccaaaaagcacagctgtcaccatatcaaacattcagctattaaatattttaatgactttagtttaatataatgttttactttaatgctatacaatttcatttataaaggtaaatctaaggctgggcgtggtggctcatgcctataatcccagcactttgggaggctgaggtgggcggatcacgaggtcaggagtttgagactagcctggccaacatggtgaaactccatctctactaaaatttagccaggcatggtggt

SEQ ID NO: 179358 - DNA, 2365 bp, Homo sapiens
aaaaaaacaaaacaaaacaaaaaactctgacagagatgtctggtttgagccatgtctgcgtcttgaaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgatggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagagaagggaattcaggaggcaaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggaatatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcacttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaagtgttgtacatatttatggggtacagtgtgatatttaaatatatgtatatgatgtataatgatcaaatcagtgtaattagcacatttatcacctcaattatctcttttttgtgttgagaaaattaaaaattcattgttccagcagtttgaaaataaattgttgtcgatgatagtcacctttagtgctgcagaacagcagaacttcttcctcttatctacctgtacttttgcatccattagccaacctttggccatcccacctatcccttacccttccctgcctctagagccactgttctcactacttctaagaaatcagctttttaagcttccccatgtgattgaggacagtttgaagttagtgtttcagccatagctcagcataccccagtggtcgtgggactgtcagagcagagaatgctgcagggtttctaacagaagtttgacaattagttattattcaggagacaggtcttagtataagagtttgttcacacactttcaaaacactaatgatgaacatgtcaaaattgatgaccactagaatgtcagccacatgtgtctttgtatttttgctgcatccttacattgcttgagtctggaagattgaggctgcactgacctatggtagtgctactgcactccagccagggcaacagagtgagaccctgtctcca

SEQ ID NO: 179359 - DNA, 2139 bp, Homo sapiens
attggctggtcgctcctctctggcgagagcaggctctgttatgcacgccccacagcagtgtccaagcatgttacaacccatgctgtttcagctctgccatctggggatggccaagtgccaatcagctcagtggagcatcagggtagcagcccctgccctcttggcacctgggttcttgtccagcatccaggaagaaccaggtcacatgaactgtgtgaaaggtgatgaacgcagaagactttattgagtggtgaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggaatatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcacttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaagtgttgtacatatttatggggtacagtgtgatatttaaatatatgtatatgatgtataatgatcaaatcagtgtaattagcacatttatcacctcaattatctcttttttgtgttgagaaaattaaaaattcattgttccagcagtttgaaaataaattgttgtcgatgatagtcacctttagtgctgcagaacagcagaacttcttcctcttatctacctgtacttttgcatccattagccaacctttggccatcccacctatcccttacccttccctgcctctagagccactgttctcactacttctaagaaatcagctttttaagcttccccatgtgattgaggacagtttgaagttagtgtttcagccatagctcagcataccccagtggtcgtgggactgtcagagcagagaatgctgcagggtttctaacagaagtttgacaattagttattattcaggagacaggtcttagtataagagtttgttcacacactttcaaaacactaatgatgaacatgtcaaaattgatgaccactagaatgtcagccacatgtgtctttgtatttttgctgcatccttacattgcttgagtctggaagattgaggctgcactgacctatggtagtgctactgcactccagccagggcaacagagtgagaccctgtctcca

SEQ ID NO: 179360 - DNA, 2385 bp, Homo sapiens
agcgggcagagaggacacttccggtctcctagtctgaggttcctgctttaatgaccggggtagtttgagccatgtctgcgtcttgaaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgatggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagagaagggaattcaggaggcaaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggaatatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcacttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaagtgttgtacatatttatggggtacagtgtgatatttaaatatatgtatatgatgtataatgatcaaatcagtgtaattagcacatttatcacctcaattatctcttttttgtgttgagaaaattaaaaattcattgttccagcagtttgaaaataaattgttgtcgatgatagtcacctttagtgctgcagaacagcagaacttcttcctcttatctacctgtacttttgcatccattagccaacctttggccatcccacctatcccttacccttccctgcctctagagccactgttctcactacttctaagaaatcagctttttaagcttccccatgtgattgaggacagtttgaagttagtgtttcagccatagctcagcataccccagtggtcgtgggactgtcagagcagagaatgctgcagggtttctaacagaagtttgacaattagttattattcaggagacaggtcttagtataagagtttgttcacacactttcaaaacactaatgatgaacatgtcaaaattgatgaccactagaatgtcagccacatgtgtctttgtatttttgctgcatccttacattgcttgagtctggaagattgaggctgcactgacctatggtagtgctactgcactccagccagggcaacagagtgagaccctgtctcca

SEQ ID NO: 179361 - DNA, 485 bp, Homo sapiens
tggacatatatcctactgaatcacctgagattgtcccaatttcaaatattctgtcctactgccgcataaaccaacaaatgccagagttgataaccccgtggtaaccagctcacatctgctcagggcctctgccaggccagaggtgttggctgtctctggggtgtgaagagcaccacctaccctgtgctgagcacccctccctgctgagtcctcaagtctgagacttccaggaatacaagcttgcgtttccacactaagaaacctgggtgcaagtcccagtctacacttatagatggccttgggcaagtcacacaaagcctgttttctcacctggaagtggggacagccctcttcctcagagaacagtagtaaggattccatgtctcagtatgtgaagggccagcactaagccaggttccttagggaacattagatctcatccctttttctagctctcctgcctccttccttccatgcccagggat

SEQ ID NO: 179362 - DNA, 250 bp, Homo sapiens
ttaaaaactcaccaatatacataccaatttttctgcctatctctcaattttcaccatcctttctttcaagctagactctcagctccttcaaattaaaattttccatttggcaatgcaagtttatcttttcttaaagacggaatgaccagccttttgatggaagattttatgactctggtgtcttccaatgacgtgaccagtgatgaggtttgcatctgtgtaaaacctacagattggaattctgctttct

SEQ ID NO: 179363 - DNA, 223 bp, Homo sapiens
tagctgctgtcattatccccatttcatagacaaggaaaccgagatacagagaagttgaattaacttgctcagtgtcacatagctagtaagtggtgctgttgcattcctgtccaggtcattggactccagatttcatgcccttaatcactgtggtattttgtttctcttttaaaaaactgcccaatctgtttatttctaaagaaggaaagaaatgtcagtgata

SEQ ID NO: 179364 - DNA, 220 bp, Homo sapiens
aatcagtttaacaaggagaaacaggtagaaccaggttctcactgcgggagaaagaaggtgaaaaatagttaactcttgaactcttgacctcaggtgatccacctgtctcggcctcccaaggtgttgggattataggtgcctagcccatggtgcctagccctaacctacatttataaactatcacttgctgctgtgtggagactatattgtgagattaaca

SEQ ID NO: 179365 - DNA, 292 bp, Homo sapiens
aaaagaaagcttaaatacaggtaatctgatttttcagcttactgatctactaaggaaaactgcacatcttttcataactaaagcgtttctgaaactgcagcatacattaagcatttcatatgccgcccattaaataactaatatattctatttcacaaacaggaaaagaggttgaacaccattatgtaagtagtaacataggatagtacccctgttctcttatgacacattcttaacagtactggtttttaaggcgagggagaaaagaaccaggaagtggaccagtgggaga

SEQ ID NO: 179366 - DNA, 343 bp, Homo sapiens
cctcttctctccacctccctccccaagtggtgtggttgttccatgaatgctgctgacttgcgcatggaatacgtgacagctctctctcctcttcatgcctttccatttccctcccaatcctgacttttcctttgatcaactcaagtgtggaaacactttctactctacattttcctttcaataactgtttttaaaccttgaaaatttccttttattcttctgttttccacgtgccaagaaataacgcaaagaatgcaaacaaacaatgggaaaacagaaaccattcagttgtcaggaacacacatcctattttatggaatgaaatgttgaccccaattccaga

SEQ ID NO: 179367 - DNA, 222 bp, Homo sapiens
gtcaaagcaaaaaaacagatctaggataaagaactaaagaacaagtggtagcatttgagaaggctaaaatattgattgctcaggcacaagctctagttccccgcttctgggataccagtgtcttttgatatgactgtaaaccctgaagggacaaaacaggtcctctggcacgttcagcatgggaaagcagttcttctaagattctggtcacagctatggaaa

SEQ ID NO: 179368 - DNA, 411 bp, Homo sapiens
ttcatacagattgagtatgtcttatgtgtaaggcttaggactaaaagtgttttggatttctgactgtttttgagttttgaatatttgcaatatacttaccagtttagcaccccaaatctgaaaatacggaatccaaagtgctccagtgagcctttcttttttcttttcttttctttctttttcttttttttgagatggagtctcgctctgttgccaggctggagtgcagtggcacgatctcagctcactgcaacctccacctcccgggttcaagcgattctcctgcctcagcctccaaagtagctgagactgtaggtgcatgccaccacgcccagctaatttttgtatttttagtagagacggggtttcaccatgttggccaggatggtcttgatctcttgactttgtgat

SEQ ID NO: 179369 - DNA, 494 bp, Homo sapiens
  misc_feature (1)..(1): n is a, c, g, or t
nacgagctgtttggtggtctcttcacacagacacgtgtgaaatttggtgccgtgactcggatcgggggacctcccttgggagatcaatccgcgccgtcctcctgctctttgctccatgagaaagatccacctacgacctcaggtcctcagaccgaccagcccaagaaacatctcaccaatttcaaatcagcaccccaaatctgaaaatacggaatccaaagtgctccagtgagcctttcttttttcttttcttttctttctttttcttttttttgagatggagtctcgctctgttgccaggctggagtgcagtggcacgatctcagctcactgcaacctccacctcccgggttcaagcgattctcctgcctcagcctccaaagtagctgagactgtaggtgcatgccaccacgcccagctaatttttgtatttttagtagagacggggtttcaccatgttggccaggatggtcttgatctcttgactttgtgat

SEQ ID NO: 179370 - DNA, 370 bp, Homo sapiens
gtgtgtttgaagaggaaacattggatcataaaatgtgcattggcttacagtataagtgtagctttcatactatagaccattctgcgttgagtgaagctaagtccccaagggcaaaggatcttggtcaagttaatactgaaataaaatgcctgggccagtggttctttcactccacagcactagctgtatttttataatagattagcatgtagaatactgaggcagggtttggaggattactctaagaggatcttttgggccagtggttctttcactccacagcactagctgtatttttataatagattagcatgcagaatactgaggcagggtttggaggattactctaagaggatctttaaggggccag

SEQ ID NO: 179371 - DNA, 723 bp, Homo sapiens
actttttgtgacacattattccttgatgtctgagattctttctagaaatcaatctaataatacctgctgttcgttgctcaggacttctgaagtaatgtctgcagactatgtgagaagaaaaaggttctatcacacaaagtatttttccactcttgatatcagctcattccttgtttatatgattaagtttgaagtagtctgacatttggcaaactctttttttttcccaccagaaactaaaattcatgattaactcactgctcgctatgaatttgtcacaacttcacttaacctaataaatatcccagaaagagcagacttggctggagttgaatcagtacagctttactgatttggccactaagttaagcccatactttttaatctggattgagctaagggggaatgttcagaaatcaaggtctgggtgcattctcccagaaatcactggagctcagctggctttattagcctggtgagaggagggggaggtataaataaatgcatagcagacaccactttttcctctggtatgtgtatagacctttggcggtagtagtagaggggttataataaacaattaatggatgatcaatcttaagtatgatataggagaatttaaagtattctgagttcttaaagactattcactatataatatgtgataacttatattcttttattctgttagattttgctttctaaatgaataatcatatactg

SEQ ID NO: 179372 - DNA, 263 bp, Homo sapiens
agaagacataccagtcaatgggttcttgaaatagtcaaggaatgtggcaattcacgctggatgtggaaggtggaaggaaagacaagtgttagcaaatgcagacctgtctgctgtggaacttgaagaccttgctagtagtcaggctgcttcctggcattccaggcctgagaggcttctattttgactcaaagcaaaaacaaatgctatgttaatgtcttcctatgtgtccccttcataagattttggtgaaatcatattaaaag

SEQ ID NO: 179373 - DNA, 417 bp, Homo sapiens
gtgtgtttgacggtgatggtgggagtagggaatatattgccctattctttcctgagttctggtcaccaattgttgtagttaaattttctgcctgtggatttattttgaactttttgtgtgaatttcagtcactatactttttctcgttagagtgtactctttctagttattaaaaagaaaagttaactgtaaaacagcctcaggcaggtccttccggagctatccagaagaagccattgttatcataggagatgacagctccatgggtgttattgcccctgaagaccttccagtgggacaagatgtggaggtggaagacagtgacactgatgatcctcaccctgtgtaagcttaggctactgtgtgtatttgtgtcttagtttttaacaaaaaggtttaaaaataaaaataaaattt

SEQ ID NO: 179374 - DNA, 411 bp, Homo sapiens
taagttaatacttttaacagggtaaagaaggcgtcagtcatagctcagatgttgcagttccacataggatccgtagagtggaaatggtgaagaaaattcctatttctgtaagagcagtgaagtcctacgtatccccagaaaatctgtatagaaggaaaattgttaaatccaatcccaaatagtgaaaacattttgctgcaactttccctcctcattcagctgtaattttagaggaaataccgtttcctttcaattacaagccaaataaatgttagagtgttatgtaacttaattcattacccaagagcttcacatggcataactttttaaaataaaaacaagaacagggaaaagtgattgttttaataacactgaaactcagtaacaaacaaaaaaactgcccctgcttga

SEQ ID NO: 179375 - DNA, 562 bp, Homo sapiens
taagttaatacttttaacagggtaaagaaggcgtcagtcatagctcagatgttgcagttccacataggatccgtagagtggaaatggtgaagaaaattcctatttctgtaagagcagtgaagtcctacgtatccccagaaaatctgtatagaaggaaaattgttaaatccaatcccaaatagtgaaaacattttgctgcaactttccctcctcattcagctgtaattttagaggaaataccgtttcctttcaattacaagccaaataaatgttagagtgttatgtaacttaattcattacccaagagcttcacatggcataactttttaaaataaaaacaagaacagggaaaagtgattgttttaataacactgaaactcagtttaaattgaatgtaagttccaaaataccccctttcaagcaggggcagttttttgtttgttactgagtgacaatctgctattctttttcttggtgtccatgctctacctaatgctaacctttctccccccaccagaatttttctcaaagtagatttggtgggatgcttctctttgcatat

SEQ ID NO: 179376 - DNA, 381 bp, Homo sapiens
gcaagggtactagtatctctaatacacgaattgtaaaaacagacatgaaaaggcccaacaatgctatgaacagcgttcacagaacaaaaaaaggcaaacggctcttaaacatatgaaacagatgctaaactcactcataaaagaaatgcaggcatatgtaaaaatgctcaaaatcactaatcatcaaagaaatgtaagttgaaatcacaagatagcatctcacatctattaaaatgggtgcagcaaaaaaaacaacaggaagtgttagagaagatatggagaaaagggaacttttgtacactgttgctgggaaggtaaattagtatagccagtatggaaactagtatggagattcctcaaaagttaaaaataggccaggct

SEQ ID NO: 179377 - DNA, 361 bp, Homo sapiens
tcacactcttacacagccccacacatccctctggttgattaaagaagtgagttcaagaacaaataccccttcatgacatgagagttaaaaggagaaatctcaaaatcaatttgccctaatcagaaggaagataaaatgagtagagcaactccagtattatgggacaacaaagcatcccaagtaagtatatttaacagggacctggaatctaccgtaacccaagtgccaatctttattttaaccaatttgtatggaaaaatctatttcacatataccaaaacacaagaataaagggcagggcttgggcatctggcaggcatgagtgtggttctgccatttgtgagctgcgtgaccctagaac

SEQ ID NO: 179378 - DNA, 666 bp, Homo sapiens
tgagacagggtctcactttgtcatccaggctggagtgcagtggtgcaatcttggctcactgtagcctcgacctcccaggtttaaacaatcctcccacctcagcccccccaagtagctgggactacaagcacatgccagcacacccggctaattttttaattttttgtagagatggggttttgccatgttagccaggctggtctcaaactcctgagctcaagcaatccacctgcctcagcctcccaaagtgctaggattacaggcgtgagccactgcacctggccactcatgagtacctcttaatggaaaattccaatcagaatcctgtgcggaggggcgttctggcaaatactgttctgggtttctcttgtatgatgtagaggagatgatagacaagcacactggtgggaagaactgaaaacaaacaattggtatagcctggagccccagaaatgcaggaccacagtgcaaacctggctacagagccctcaaaagtgagtattcacatatgtgtacatgcacatatgtgtatagggagtactgacaggtatgggacagacaggtctcaaggagaaactggggcacagtctgggcattacttacaactggaaaatggcagatttctcaaacttcctccctcatcctttcctacacaatctgagccac

SEQ ID NO: 179379 - DNA, 177 bp, Homo sapiens
taacatctccagcccaactttggaaccagtcaggaggactatacagcagtgttcacaacggtcacaacagcagcagtggcacagggagaagccctgtgtgtctgcaacctaagaggcgaccagcaggagaaaggctttaacaagagacaaaccctggagatgttgaggttcaccagg

SEQ ID NO: 179380 - DNA, 378 bp, Homo sapiens
ccttgacctcctgggctcaatgcaatcctcccacctcaccctcccaagtagctgggagcacagatgcacgccaccatgcctaatttttgtatttttgtagagaagggatttcaccatgttgtcctggctggtctaaaactcctgagctcaagcgatctacctgcctcagcctcccaaaatgctgggattacatgcatgagccattgtgcccagcgtgaaatattgtatacttatccagccagttccttcccagggattgctgtttttctccctgcccattcaatgaatgcaacttgtcaatatttttgtcatcattcctcagattttacaccatggtcccagagccatagccaatagaaggatattttaaaataaata

SEQ ID NO: 179381 - DNA, 153 bp, Homo sapiens
gccactgtgcccggcctagtggtgactcactttgttactttcacttcggtggtttattgagtttgaatctgtaagtaaatgtttcgtcattaaattttggaagattttattcctatttcttcagatgtttcttttctgtgccttttttttttt

SEQ ID NO: 179382 - DNA, 576 bp, Homo sapiens
gatggaatcaggacaagggtgttggaaggactgattgtttaataaggtacagatagcctaatacactcatgtccacaatggggacagtaacagcaacaggactgtacacctgacgaccaggagctaaggacttccttcctccagtctaaatcccataatgaaatcaggtcaactttttgctcagaattattatatatccctcacatatagtggtccttagtgcttgctgaatgagtgatgtgatgggtagcaccattttggcccatagtctttttcctatttttccatagctgaacgatttccattctgccaacagggttgcagttaagttttttttgtgtgtgtgacagtctcactctgtcatccaggatggagtgcagtggcacaatgatggctcactgcagccttgactttctgggctcaagcgatcctcccacctcagcctcctgggtagctgggactacagacatgcgccactgtgcccggctaatttgtttttattgtttttgtagagacaagcgtttcgccacgttgcccaggctggtcttgaactcctgagttcaagcaatctgccca

SEQ ID NO: 179383 - DNA, 212 bp, Homo sapiens
ggaaacaactggcattgtggaaaatgtctgtgcaccctggctaagcaactcactattgcttggattatattaatatacacaccataaagctaaggaagaacttaaatttgagcctctgcatttctgtgctgagtaagctgtagttctttcgacttatcgccttcatacttgcctgtccaaacaaaaagatctcaagaattccactgaaatag

SEQ ID NO: 179384 - DNA, 255 bp, Homo sapiens
agaatagtcaaacataggacatagtaagaataactacttgaggtaggaaagctcatgacgtgtttaggaacagtgagtagttgggcatggatggcatagaggctgcactctgagagatggaacagacaagtgggaagcagtattgcaagatgctgaaaggcacagaatctagagcctggatctgaatcccagctgagccacttactagctgttgtgaccttggcaagtcacttaacctcccctctatagctttgt

SEQ ID NO: 179385 - DNA, 339 bp, Homo sapiens
ctgagatcctgcagtgcactccagccttggcgacagagtgaaaccctgtctcacacacacacacaaaaagaatatggtaggttctctagtcccaaagtcagagtggagggtagtacttactttctaagcttgtgtattttttcattagttcctctctttctctgtcaattggtcaagaaagattgctgagcaagttctctgaagtcagattgaagtagggctctgatcagttgatcacatgatacacactcctcttcatctgtttacttttcctctaagattaagcccatttctttagcctaccaactaaaatgataagatctgcactgcagccaccat

SEQ ID NO: 179386 - DNA, 155 bp, Homo sapiens
gttcttcaagatagttcccccatgtgacaaaaaacatcaaaatatcaacctaaaatatggaaacaaaaatacttaaactggtttggccacatttaaggaaccattaatgatacttcacttgagaagcatcaataccctattgaaaaaaattggaa

SEQ ID NO: 179387 - DNA, 496 bp, Homo sapiens
aacaaaatgtaaggtggctataaagtataaaagaacattcacacacttaaagagaacataattaacagcaagctagtcagacaaacaaacacaaatattttcacattttctatgtttgtttttaactttgcttcatgaagccacttataattgaggcttctttcaagtacaggatttctaatatgaaaaatagtattttctacatagctctataaagaaatgaaaagccacaagctgcattgtttgccataaattcatacaccaaagagtaaaacacaatccaactaaatttatacatgtttccctcttctccaacaactgcttcagatgtttttctatgtactttcaaaatatttttattaaagtcagttcaaattcatttatgcagattaggaaaaaatgatccatagtgaattatttttaaaattaccttctgtatacttctatccctccaccaaaccaaccaccaaatctattgctaaagtgaactataatg

SEQ ID NO: 179388 - DNA, 741 bp, Homo sapiens
tctggtctcgaacacctgagctcatgatccgcctgcctcggcctcccaaagggctggaattataggcacgagccaccgcgcctggctggaactaacagattcagatgatgtcactcctattttgagaattaaaatgtattttcttaggtcaggcgtggtagctcacacttgcagtctcagcactttgggaggctgaggcgagtggattgcttgagcccaggagttcgagcctggcctgggctgaagcaaaccccgccaacccccaacaaaaaatacaaaaattagctcagcatggtggtgcgtgcctgtagtcccagctattctggaggctgaggcggtaggattgcctgaacctgggaggcagaggttgcagtgagccgagatcatgccactgcactccagcctgggtgacagagccagaccctgtctcaaagaaacagaagtattttctttaatgatggtgataatagatcgtaggtatgttctccatgcccttagggagcgtaaatttaaagctgcaactctttatgggaacctggctttcacttgttttctggctttgtttttctgtcaaatccagaaatctggaaccactggttaaaaagaagtctgagagccaaaatacacacagccagctgtgagttactacctgccttacccaggaaaaggacatgagctgcccaagcacacacctctttgccatctatgccagcatttttaccttcaaggccgatgttctca

SEQ ID NO: 179389 - DNA, 669 bp, Homo sapiens
aggaaatggggcagccaggagtgctcgagaacagatggggccaggcaccatggcccacacttgtaatcccagcactttgggaggccaaggcaggcagatcacttgagcctccccagggatatgaggcggcttgtgaggtcctctggagtcagaagatgccaccaccccagaggatgtgagcccacctgtggaggtcttgatccccaccactaggatggggcagccccaaggtgggtgactacatgaactccctgtggtgaggggtgagtagaagcccatggaagcctccccactgccatgcaaccccatcgcatctccactgaactccgagcagaaaacggctgcctgatgggaactgtcatttaggttcccaggctactttggtggatctgagaataaatccctcaagacaaggtccttgctctgcccttctccagggtgggacccagagttactggcccctccatcccatggagccgattctgcaaccctcacttcctaagcacagaaatctggaaccactggttaaaaagaagtctgagagccaaaatacacacagccagctgtgagttactacctgccttacccaggaaaaggacatgagctgcccaagcacacacctctttgccatctatgccagcatttttaccttcaaggccgatgttctca

SEQ ID NO: 179390 - DNA, 600 bp, Homo sapiens
acacaggatccaactgaaaagagttcccaatggccaaatccagaaagataaaaagaacaacaaaataaaacaaaagctggagtaataaaataaataatataatatcagatcccaatggccaaatctggaacaataaataaaaaggagagcaaaataaaataaaagctggaataataaaataaataatgtaatatcagattctaacccaaagtataaaataagtatgtatgagtctatgctgatgtagataaatgattgcataaataaataagtggggagactaaacaaatctcccacacagaaaaattccaggtaacttatgtagatactacacccatagtgtgagccacgcatagtgacttctttccaaagagtacaatatagatgaggggaatagtaacttcggagtggagaaccctgatgaagaccacctgagccaggtgatcaaggtcaacatcaacagtgattagtcatgttgataatatttacccttgatgtgatatgaagagaatggcactccccatctgtgaccttcccaaaacccaggaacccggtgtcatcatgagaaaaacatcggaaaaatcccagttgacaaacatt

SEQ ID NO: 179391 - DNA, 507 bp, Homo sapiens
gcaatgattgtcttctgtaaaaatatgtagatttccccatagtagatattctttatgggaaaataactcaaattgatggcttcagagtgactggaattcatcaagcattgtttatgcgcagttagaaaagaaattgcttgcattcaatgatgtgattttgaatattatgtcccactttattgtctataaataccgacaataaagggagataaagtaattttaagaataaatggatgaggagtgtggggcaaaggaaaaatgctagtagaaagaggatatcaaaccaataatgaatataacaaggatgatgcacaaaatgtgtatcataagattctgtgaatttcttgaagtaggccacaacttctggctctaagcttgtaatagccaatgtagaaaggaacactgcattaaccgtgaaatttgcagtgcccattaggcaacagaaaccagttgtaaatgagaagcaccatgatttctggttctagagccagaaagaaaattcaccag

SEQ ID NO: 179392 - DNA, 367 bp, Homo sapiens
tgttggttggttttttttccccattttaataaatattttcttagaatagttttaagatatctacatattagatatttgaatattagaacagttttagcacagaattcctacatacccggcatccagtttacccatttagcaatatgtttggttttaaagaaattctcctttggggaaaaagtgtcctcttttaattttattcccttttccccattattaacatgttacattactatactacatttgtcacaactaaggaaatgtcctgctactattaactacgctccacactttatttggatttcactagtttttccctcatgtgccttttctgatccaggacaccacgtcacagttagtcatcatg

SEQ ID NO: 179393 - DNA, 343 bp, Homo sapiens
tctaacacctcttgcatttaagcaagtccacatgattagttctggccaacaggcttagaaaaaaggtaacgtgtcatttctgggccgaaatagcaaaaacctcatatccttctctgcagctgcacctctactatgacagcaaccaaagagggtgcagtttttaaaagcgaaaactcaaaaagcctaggaccctgaataactctgtgaagcagcgatgtcccctgaccaatccataaaatatgaataagaaataaattgtaattgtgttaaaaccactggaactttgtcatcaatttgttactgtaatacaacctagccaaacctaattaatatttgttaagcg

SEQ ID NO: 179394 - DNA, 192 bp, Homo sapiens
ttccctttctagacgcgatcatgaatcatggagctacagctatgggaatctttgttgaggcgtggatgtcagctgtgatttaaaataggtaggaatcggcaggcagaatgaagcttcattttcatagaaaacatatattatggcatcctgaatcgaggcactgagaaagggtggctgatgtccaagcaggtg

SEQ ID NO: 179395 - DNA, 166 bp, Homo sapiens
tccaggtgattttgatgagcatgcaagtttgagaagcccgttatagggtgtttgtggcagatagtggcagaaaagacttgggacttactacaaatgcactaatgcactagtctcatgggaagataagacagacacaataaagggctatagcaaagtggtgccccgg

SEQ ID NO: 179396 - DNA, 473 bp, Homo sapiens
gaatttgtcagtttctttagctttgtacaagttactttgataatattagcaaattagaacagtaggcaattgatcagtgtgttaaattagccaggttacagaaaggactagcagttgtcaacactatttcctggaggaagaaatggaacatttttataggataacctcaaccacagatacttcttcaagatacggttttatgaggggagttgtttgagtttaacacaaaggtgttcaggttagagtgacttttaaaggctttgcggagttttctgtgatctctggacttcaaattccacatggttatgttgaaggcttaccacgttccacatttatgtgaggacagtttacatcactgtttcttagtgggaaagggggagaagatggcagtctgttgcccctcatttgagaatccccagtacagggagccactgttactgacagtgtattgtatccttcaggtgtgtgggcag

SEQ ID NO: 179397 - DNA, 642 bp, Homo sapiens
attaaagacggtaatatggtttggctgtgcccctaccccaaatctcatcttgaactgtaactcccacaattcccacctgctgtgggaatgacctggtgggaggtaactgaatcatgggggcaggtctttcccaggctattctcataatagtgaatatgtctcacgagatctgatggtttcaaaaaggggagtttccccgcacaagctctcgtcttgtctgctgccatgtgagatgtgcctttcaccttccaccatgattgtgaggcctccccagccacgtggaactctaagtctaataaacctctttcttttgtaaattgcccagtctcggttatgtctttatcagcagcatgaaaacagactaatacaggcggctagagaaaaccaagcacataaatccatttcttccattctcagaagtattctctgtatttggcaattagataatttataatactttcttaaaacttcaaggactaactttgattgtgaaacaatgtctcatcgaaacgaagtttagttaaggaataaagtcaagccccctccatgtctctctttgcttccacagcagtacagaaacatgtagaacatgccacacacagcacaagtccccattctccactgaatggcattgagggtctt

SEQ ID NO: 179398 - DNA, 463 bp, Homo sapiens
aatagctagtacgagccggtgttaatcggccgaggtgcatttaagcttagctaccatatgtaaattgctactgctgcatccagcaatttgttgtccattgttgacagtactgccatggtaaagaaacaggaactatagaaagaattagattcctcctcccacctcccagctctcaccacagtaggaagctgtttggggagcagagaggaaatacgggggatttgagagttacacccagtgtgtgggcatttggggaggaaataggaaaagagattttttaaattattttattttttgaaacaaggtcttgctctgtcagccagactggagtgcagtggcacgatcatggctcactgcagcctcaaatttctggactcaagcaatcttcctacctcagcatccaaattagggctacaggcgtgcactgccatgcctgtctgattttttttttttttttttttgt

SEQ ID NO: 179399 - DNA, 687 bp, Homo sapiens
  misc_feature (3)..(3): n is a, c, g, or t
  misc_feature (10)..(10): n is a, c, g, or t
  misc_feature (12)..(12): n is a, c, g, or t
  misc_feature (14)..(16): n is a, c, g, or t
  misc_feature (23)..(23): n is a, c, g, or t
  misc_feature (73)..(73): n is a, c, g, or t
  misc_feature (105)..(105): n is a, c, g, or t
  misc_feature (675)..(676): n is a, c, g, or t
  misc_feature (678)..(678): n is a, c, g, or t
  misc_feature (681)..(681): n is a, c, g, or t
  misc_feature (684)..(685): n is a, c, g, or t
ttnaccctcncnannngctgggnatacaggcatccaccaccacgcccggttaatttcgtatttttaatagagntggggtttctccatgttggtcaggctggtctngaactcccgacctcagctgatttgcccgccttggcctcccaaagtgctggaattacaggcgtgagccaccacacccagccccccaagttttcttttctttgtagagatgggggtctcgctgtgttgcccaggtaggtctcaaactcctggcctcaagtaatcctcctgccttggcctcccaaagtgttgagattacaggcatgagccaccatgcccagcctccctgttttcaattcccctgttttaccattatgagctaaagaactctgactgcctgggtaaaacaaggacaatagtgtctactacataggatagtcatgaagatagaatgcactaaagctataaagcatgtcgcatacagtaggtgctaaattaatgctattttctctcacctcttccactaaaacccagagagttaatgacttagtgcttaactagtagaacttccggcaacagccaacttctctgctttgcacagacattacgaatgtctcagcatttagacacttactggcttaaagaaaaagcacctcagaggaattgaaacccagctgccggccatccccagtnngnganggnnaa

SEQ ID NO: 179400 - DNA, 246 bp, Homo sapiens
ggattaagacctgtctacctcacactcattcctataggtctccacaatttggccctgctcagcaagggcgcagctttagcacactttagcctcaaatctgaggaggcaaaataggccagactcttatgagtagaaaaaagggaatatagcagggaacctagttttggacagagccaccctgccaagccctcccagggtaacttgcagcaagtcccttcgcccgtctgcaccacagcttcctctttg

SEQ ID NO: 179401 - DNA, 252 bp, Homo sapiens
gggtttcaccatgttggccaggctggtctcgaactcctgacctcgagtgatctgcccacctcaggctcccaaagtggtgggattacaagcatgagccattgtgcctggccgggtctgtactcttaacccgcacactctacctgcgcatttttttcctcgagtctcatctattaaatggaaataaaaacgcaagcatggaagaagactgctgctgttccgtctgcccttcccccactgtctagggaacccccc

SEQ ID NO: 179402 - DNA, 347 bp, Homo sapiens
gacacatgcatgtaatgcccctgacctccaggacccccatctatggacagcaaggagctctttttgcaatcaaaagagagggaccaaaacagatcattatgtattgcgccataatgaggcaaatttatttctcttatttgtaagttcctatgggaatgactcccccattagatcacagtattgacgataagcatgaataagctaatttgggtagaaaagtcacttcatgtagtagaatgtaatgttgactgttaagatatctcatacatcatgaaattaaataagatttcccttttatttcatttgttcagccactcagtaaatattgaagacctattaagtataaa

SEQ ID NO: 179403 - DNA, 389 bp, Homo sapiens
taaactaatgtaaaacaccctaacaacatcagtttaaagtctaagaaaaacctctcatgctttccttaaaatgtaatctatctgcagccttctccatctgtttttgggaattctatcctttcagttgcttggaatacaaatcttggagtcatcctctatctcctttttctctcataccctacttccaactgttaagcaaatggagagatacagaatctacttactttttaccatcttcattgttaactccctggcccataaagctatcatcatttcacatatatggattactgcatcacctgcttaatatcccctgcttctaccatcattccctacaggccattctctacagagagctagaatgttggctccttgaatagacatgtaca

SEQ ID NO: 179404 - DNA, 452 bp, Homo sapiens
tcagcagagaagggagttaatcagcaaacagcttaaggaaggataactctctgcccctgctgagggccacctgtgcccctcctctgtgtgccatggctcgatgggccagcaaaccctattgaaacaaacagcaaagaaacaagccgaagcaatctggggtgccatgtttggtcccagtgtaagacgccaggaacagggggttacctggagatttcaaagcgaggcagacagtctgagaaggaccaatggaagggcttgtgttgggttcctctgtttagtcaaagcaagaaataggttgtgtgatacagcacttaatggtagaccctgagatcaggcctgaatttacattctagcctgcctggcctgaggaccagtgaaaaccagaatatatgacagaccgttttgctgctatttcatttgttctgacctgataataaaaatcagaatcatta

SEQ ID NO: 179405 - DNA, 406 bp, Homo sapiens
gttcttaaaaaatgtcaggataataaattctgtgatggcagcatgtaaaatgtcaccacttgggcaatgctcatcaatggatggtaaagctacacaagttcaaagcatcctcttctagatgacgtattaatatcaaaaggaaaatggccttctgagaccttgtgggcaccatgttagctaagggatcaaccaatcacctgtaggaccacctgctgttatgcctcctggggagaagcaagaattcatcagcctgaatccaccacaagcaaacagacaaggccagagtttgatacattctacaagatactggcctggactcttcaaaaattcaaaataataatacaaagggcagctttcatagctgcttggaagctctatgcacatactggggcttctcatctgggag

SEQ ID NO: 179406 - DNA, 354 bp, Homo sapiens
gtctctgagcctgccagggcagagcagaagcaaatgcatgaaggcccctcccccaggggctgctcttagccagtgactgatgaaaatgggtgtataaacagcttagccacatgaccccacacaggtgggacaaccatgggtttccacattctgtactgcctcccagaggtccccaccaggtttaagctcaattgcccacactggtaactggtaacttccttgataacactcacttcttttttcattcttttggtgtttttttagatggagttttgctcttgtcacccaagctggagtgcagtggtgcgatctcagctcactgcaacctctgcctcccaggttcaaggattctcc

SEQ ID NO: 179407 - DNA, 700 bp, Homo sapiens
gattattacacattgcatgctgtatcaaaatatctcatgtaacccataaatatatacacctactctgttggcacaaaaattaaaaatgaaaaaaagaaagaaagaggcctgacttatttggagtcgtaggatttttgaaatagaaagaaggtcttagacatcatcttttgtaacccattgccctgtaacctgagacccaggagttccagagtggttggagtgagatggtcaagatcacaaaataaagaagtgacaaaaatagggctggatctcaagtcaccgttcccaagaccagacccttgtctctatgcagtgccatttcagcctgttctctgcttttgttctcacccctctggatcttatgaggtttgtcttcttgattgatttagaaaaacactatctatttgactatctatttgacttctcttagccatcttttgtggtacctgagtccagccagctttcgctaatcctctagaaagcaggacaactctcttttctggattatcttactaaaagagaaccagaaatcctgtagttaggccagagctgattaattggaaatgcatgagcctggactaaaaataaatggattttaaactaaccagatttagattatccagtattttttatggaaggagaataggccatcatgtcaactgaaaaatagcagctgtttcaaattatgagatactttgaa

SEQ ID NO: 179408 - DNA, 171 bp, Homo sapiens
ctgatggatttttaaaactatgaatgctatgctaaaataaactgtagggaagaagacgtaagaagcctgctcttgatacgagagcagtgagataagagggaaatctctcttctgcccattcgtcttgcacacaccacttcaaactttggttgatatccgctctgagatttg

SEQ ID NO: 179409 - DNA, 669 bp, Homo sapiens
gattgtttgtttctataacaaaatctagccaatcctgtctagtacacacagtttaagtgacaaaacctaagtttctttgatttctaagccttgggcacagaagaaagatagtggcatagagtaggcactccataaacatatgttgaaggaaggaatgtatggtggttgcccagcattgaacacaatacttcagatgtgatccgatccacataagagttattaggagtacaaacactctttttacactgaacatctgttaatgaaggcttagagtgcattagcttttttgtcaactgtacttatttctttaacaaaaaaattattgtctacctaacatgtacaaggcacagagtgaggtgtcatggctgatacaaaaacaaaacataaaaatgattgtcttccagctgttcataatttcatgagtgagagtcgcacattcacaaccagctgtgtcacaaggcaatgaatagagttggacagtgtgttttgttgactgtagattgagtatggaacgaggcagtcatgagtttcagtcattcattccacaaaaacacattgagcatcaacaatgagttgagtgctatgttcactcctgcagatacaggttaaaaaaaaaaaatacagtcccggtctcaaaggtctcacaagctagtgtgagagacagattag

SEQ ID NO: 179410 - DNA, 1046 bp, Homo sapiens
ttatacttctcaacgctttatacttctcaacgctttatacttcattagctctagaggtccatgcatacttaatattatacttgaattcaatacggaagtataaagcgttgagctcaacgctttatacttcaatgtaatacatgtgtgaaagtcttaaggaaattttcaaattcaaatagacttaggagaagacatactggagagaaacctttcaaatgtaaagaatgtggccaattctttcacaggttctcacacctaagacaacatcagataattcatactgaagagaaaccctaccaatgtgaagaatatggcaaagattttaagcagtcttcaggtcttactatacatgggagaattcatactaaagagagaccctacaaatgtgaagaatgtgacaaagcctttaaacaatcttcaagactgaataaacataagaaaatttatactggagatacaacctacaaatgtgaagaaatagtcttcaaacctgactatacataagattattcatatgggagagaaaccctacaaatgtgatgaatgtggcaaagcctttagaaaatcctcaaaactgaaagaacataaaagaattcatacttgagagaaaccctataaatgtgaagaatgtggcaaagctttttactattcctcaggccttactcaacataacatagttcatactggagacaaaccctacaaatgtaaagattgtggcaaaatttttaagtggtcttcgaaccttactatacatcagatcattcatagtggagagaaaccctacaaatgtgaagaatgtggcaaagcctttaaacaatcctcaaaactgaatgaacatatgagagctcatgctggagagaaattctacaaatgtgaagaatgtggcaaagcttttaagcaaccttcaggccttactctacataagagaattcatactggagagaacccttacaaattcgaagaatatggtaaagccttttattggtttttaagctttactaaacatatgataattcataggggagagaaaccctacaaatgtcaag

SEQ ID NO: 179411 - DNA, 373 bp, Homo sapiens
atctatatctatatatcccacctctgcatcagcagtctcagccaccaacacagctgcgttttagtaagagtggtcaaatttaagatatttgttgaaaacactgattggtttctattccttatgagataaacatttttaacccaaaggagtctgaatagtggaacttcaggcaagtgcttgtgccatcaggtcaggcagcctatgagggaggtactggggcaacaggcctgcctcctgggcatgaaagagaccattccctctagcagatcagatttctcatggctgatgctttttttcccagagcagcattttggtgtctcccttaggtttaagctacatttcttggaacccaggagtaacggaatagggagca

SEQ ID NO: 179412 - DNA, 542 bp, Homo sapiens
atctatatctatatatcccacctctgcatcagcagtctcagccaccaacacagctgcgttttagtaagagtggtcaaatttaagatatttgttgaaaacactgattggtttctattccttatgagataaacatttttaacccaaaggagtctgaatagtggaacttcaggcaagtgcttgtgccatcaggtcaggcagcctatgagggaggtactggggcaacaggcctgcctcctgggcatgaaagagaccattccctctagcagatcagatttctcatggctgatgctttttttcaaggttgttaaccaggggttcctggcttctgtttatgtggaggacaaggggtagagattggtctttgttggaagatgctgattgtatttaagatcctaactaaatgtgactttataagttggaggctgcttatatattgccattctttatacaacatcataataaccatggacacatgtaatcagaatctataaagcagatgcttctgaaacttccacctcttgaaataagtgcatctaccttag

SEQ ID NO: 179413 - DNA, 231 bp, Homo sapiens
gaggatcccgtgtaaaggttagacattttacttttaccataaagcagacctttcaggcagaattctaccaccctgaaatgtaaccaccctccccttcctaagcgccactctctatctccttcttttgaaggcaacactgatagagcaatctccagggcaaaactggatccccaagctctcaacagaatttgttcttgttaatgtcactactgccttcctaactaccaagtc

SEQ ID NO: 179414 - DNA, 258 bp, Homo sapiens
tgtaggagggacctggtgggagatacttgattcatgggggcagtttcccccatagtgttcatgtggtagtgaataagtgtggtagtgaattcatgtggtagtgaataagtctcatgagatccaacgattttataaggggaaaccccttttgcctcacttctctcttgcctgccaccatgtaagatatgcctttcaccttctcccatgattgtgaggcttccccagccacgtgtaactgtgagtccattaaacctcttt

SEQ ID NO: 179415 - DNA, 356 bp, Homo sapiens
gaccctgtctcaaagaaaaagaaaaaagaaaaagaaaaatgagtctgcattaccctttcccaatcctattccctgacagtgatgggtttgaacagatgtgcatttgtggacttatatatagtcataggagggtatgtggcggttttttggttgttgtcttaaaaatgttttttaggcccggtggctcatgcctataatcccagcactttgggaggccgaggaaggtggatcacttgaggtcaggagttcaaaaccagcctgggccaagatagtgaaatcctgtctctactaaaaatacaaaaattaggtgtggtggtgtgtgcctgtagtcccagctactcaggaggctgaggcag

SEQ ID NO: 179416 - DNA, 178 bp, Homo sapiens
ctgggaagactcaaaggcagggggtgacttgacagctagggctggaatcctcaagaggcatcttcactcccatgctggtagttgatgtggaacacctctacctggtgtctctgtgggctagttggcactttctacacatgtggtatctagattctgggcatgatcatcctgagagagg

SEQ ID NO: 179417 - DNA, 596 bp, Homo sapiens
attatgaatgatgttgctgtgaacactcaggtgtacatttttgtgtggacaagtgttttcatttatcttaggtatagacctgggggaggaatggctgggtcatacggtaactctaggtttaacttttcgaggaagtgccagactatcttcccaagtggctgcaccagtgtctccacgttcctcaccaacacttgccacgaccgtccaagagcacgtgcggtgggggctcaagggtgatctgcatttccctaaaaagtaatgacattaggcatcttttcatgtatttactggccatttttatattttctggagaaatgtctatttagagtcttagcccatttttattttttacttattttatttttcagacgaggtcttgttctgttatccaggctagagtggagtgacgtgataacggctcactgcaacctcaaactcctgggctcaagaggtcctcccacctcagcctcccaggtagctgggactacaggtgtgccccactgtgcccagctaatttttaaaagtttttgtagaggtggggtctcactatgttgatcaggcaggtcttgagatgctggcctcaagtgatcctcctg

SEQ ID NO: 179418 - DNA, 756 bp, Homo sapiens
  misc_feature (674)..(674): n is a, c, g, or t
  misc_feature (721)..(721): n is a, c, g, or t
gaggaaattgaagctcacagaaagtgtgactcctcaaagagcacaccactgatagtagaacagggagaagaaagactaagctatgcattttagatacagcatctcagttactgcatctctgacaggcaaagatgcccagcctctcccttctgagatccaggtggatttctgattaggtagaacttttaccctggaaaactatttttccacaaagctttaaaattataaacagtgattgccatggcctgaatgtttgtacccccaaaatacccagtttccaatgtgatggttaggaggtggggctgtcaggaggtaattaggtcataatggtggggccctagagactggattagtgcccttaaaagagaggccccatagagttgcctgaccctttctaccatgtgaggatacaggaagaagttggcagtctgacactcagaaaatgcaccctcccagacaatgaatctgctggtgccatgaatttggacttcccagcctcaagaactgtgagaaacaaacaattgttgtttgtaagctgctcaggtattttgttatagcagtctaaacaatgtttttttttttgcttttattcaaatcaagttttaacatatatacagtaaaacaaatcttaaatatacaacttaaagaatttttacgggccaggcatggtggcnatcgcacgcctgtaatcccagcattttgggaggccaaggcaggcagnatcacctgaggtcaagaccaggctggtttgagacc

SEQ ID NO: 179419 - DNA, 177 bp, Homo sapiens
cacaagaaaataaagtctttatttacatcaggaaaataaatgacaaaatcactgtgaaagagtatacagactactatctaaatatgttgcagcaaggctgttcagattgtatttcctgcacttgtatctaacctacaatttctcacatttcccactgacctcactatctggaagcct

SEQ ID NO: 179420 - DNA, 146 bp, Homo sapiens
atataccacattcttatccactcatctgttcatgggcattagaattgtttctactttttggctactgtgaacagagctgctacaagcatttgtgtactattcacttgtttttaattctttttttctagacagagtcttgctcttgt

SEQ ID NO: 179421 - DNA, 183 bp, Homo sapiens
tggaaacccccacaaaggcctttccagtgcagttacaatgccgtgcttcatgacttcctgggccttatttgaaggtctctttggcttcccgtgtgcccatagctgcctcctctgaactttgttgttcaccactgcacctgtctcacaagccaaggactcagtttcccttaattcactacacct

SEQ ID NO: 179422 - DNA, 248 bp, Homo sapiens
atgagaacgacaaaactgaagtgcacttcaacatcctgcagccaaaggggtaaaaaggagaaagaagcgcagaccagtcacataaatgccacagtgacatgcacaaaaacgtgaggggcacactccagggacagagtctgacaacatgacaagctacatggcatcaaactctttcatgtgacaggcagcttttcacatgtgcatcttaagactggaacttgctatagataaaccttaagtagttaata

SEQ ID NO: 179423 - DNA, 102 bp, Homo sapiens
gctgtgcctcagtttcttcttctgtaaagcctacttaactcatagggtcattagagaattgagtgagttattaaatgaaatgatgtacttaaaactggacct

SEQ ID NO: 179424 - DNA, 137 bp, Homo sapiens
ctgtaaaatgggaataagctcaaatgggagtaaatatcaatatttatcaataatagatattgataaagtctaaaggtattctgaaggaggtaacatgtttgtaacaatggttcttaaaagagaaactaaagctctgg

SEQ ID NO: 179425 - DNA, 372 bp, Homo sapiens
agcctggtgacctgccctatctgtcatgctccttacgtagaagaggacctactaatccagtgccgccactgtgaacggtggatgcatgcaggctgtgagagcctcttcacagaggacgatgtggagcaggcagccgatgaaggctttgactgtgtctcctgccagccctacgtggtaaagcctgtggcgcctgttgcacctccagagctggtgcccatgaaggtgaaagagccagagccccagtactttcgcttcgaaggtgtgtggctgacagatacatggcatggccctgctgcgtaacctgaccatgtcaccatctgcacaagcggcgccaacaggcgaggacggcttggcctcaccagtgcgatggtc

SEQ ID NO: 179426 - DNA, 218 bp, Homo sapiens
agcctggtgacctgccctatctgtcatgctccttacgtagaagaggacctactaatccagtgccgccactgtgaacggtggatgcatgcaggctgtgagagcctcttcacagaggacgatgtggagcaggcagccgatgaaggctttgactgtgtctcctgccagccctacgtggtaaagcctgtgggtgagtaccagctgctgggtagggggaggag

SEQ ID NO: 179427 - DNA, 527 bp, Homo sapiens
ttcaaactctgctccacagagtctcctcatggctggtggaggaggaggaagaaggtgagtaccctattttcttcccttcaatcagagtaactctggtgaaatatcatttgaatatcatctcaaacaagatgtgatgttccaacttgtttgaaaatcaccggaccagcagcctctcaggcctcatccatttgcagagtccctagagtctccaatctaccatcagttcctcacgaaggggcacacttattggcaccaccgattagctctctctgaaacagctctcaacaaaatgccagagctgaagggaacgtcagggttcatgtagttcaagtgccttaatctgaatttgcagaggagagggaaacaaagagaggttaagccatgaggtcaaggttcacagccagttaaaatctttaaggttaatatcctcagcttaatatgcaactgttctactcatacagaggccttccaattttgaaagtgatttcacagtgtgttcctgtgtcttgcttggtgggcatagtgaa

SEQ ID NO: 179428 - DNA, 314 bp, Homo sapiens
ttgatttctccaactagaagtcacacctttctttagaaccatggttagaacaggacttagcttattgtgtataaaatttaacaagtactgctttctcttccagtaggaattacctcccttccttgaaggaagggactgtatcctctgtaactttgtgcttcttagtatggcataatacatttatgtattaaatatttgatagcactactcactgtatattaaagtagaagcccagtgtaacaaaatgccaacctctcccctctctgtgacccatgatctccctgcggtgttctctcctcattccaggtctctca

SEQ ID NO: 179429 - DNA, 435 bp, Homo sapiens
tcagtccagcctgagagggactgtcaggcttagtccacattcatcatgatggtgcctgaaattccaccattattgcttcacttctttggcttaagacttcatcctggttaaaatacagagagcccagaaaagggtcacccatccagtcttctgtcatttatccctagtgtaaaggagtttgttagctgtttttctgagagcaggtatgggaagggcaagcatgccctccctccaggccctcccctcctctgcttagaccctcaggacttctgctgcctgctgaggggagtcccggctccccagcctggcctgcagcccatatggggtctggtcccccacgtgcctcttgtgcgcattctcaacaggcacacttgctcccatggccagcctagatttctccttcccactcatttgggctttctggccctggtgcct

SEQ ID NO: 179430 - DNA, 309 bp, Homo sapiens
cttctggctatgactgagagcctgtggcagaccagagatccctcagagaaacaactccaacagccagagaaaattaaaaaaaaaaaaattttttttttcaaagtctgaagactttggagaactgtggaagctactatgacttgaagagacacaatccggaagggtaaaccctttaggagcaagccaatatgccacaactgctttgcccctcagggaatctgccaatgctaggtgccaggaaggaggctgaggaaacagaaaagcagcctgggaacatgaccagagccactattcacaggcagagaaacc

SEQ ID NO: 179431 - DNA, 434 bp, Homo sapiens
atatcctctcaacgtccagccgcttgtgtcttcttctgccggtgtgttcctcttgatgtccagccacttgtgtgttcctgcactgatgtgctcctcttcacatccagccacctgtgtgtctgcctgctagggtgttggggatttttataggcacaggatgggggtgtggcaggccagggtgttcttgggaaatgcaccatttggacaggaaaacaaaaatgcctgttctcacctaggtccatgggcacaagcccagggatggagccctagccagggaccacgcccttcccttccccacttccgtatcatttaaatggaccatgccgttccctttccagcacttgtgtatcatttcccccctctgaagaggtacatctaactaccgctagaatatggtttagctgcttcctgctgacagcggatgttgttttggg

SEQ ID NO: 179432 - DNA, 411 bp, Homo sapiens
agagactgacattcaggtgagaggcacacagcaaggcagacacaatggcgtgtgacacacatggagacaaacacaataggcaacacacacacaccccagatctccaactcagaagatagagacaagacaagagagacaaacctagggacagagatgatgtgttcacagtatggcagagagtccctggcaccctggcccaccactgttgcacacacatcagagatgctcccagggacaccaagccgaagccttagaggtacacaccatctcaccaggaacacacacatgtgggacctggcaacagattgggtagatctgggcagactgacacattcacagacatggtctggccagacagtcacacccagtgcagagaggcacagacaggccacagtgggacattcataaaca

SEQ ID NO: 179433 - DNA, 163 bp, Homo sapiens
tgaacttccctcagcagttcccaagcaagtttagcagcagaatcatagacaaattgtcttcctatgccttgcagtgtgggtgcttgtttactatttgagggaaaagtgtttaggcaaacaggtatcctgagggtgaccagctgtgcaaggattaggctactga

SEQ ID NO: 179434 - DNA, 636 bp, Homo sapiens
ggcgggcgcccccagacggggcggcggcagcgagctgcggcggccggaggcagcaagggctgagccccgggacgcgcggaccaactggcccgacgagccgccccggagacggagacgcagatcaagcgctgcagctgccagatggagttcgaggagggcatcctggcaggggcgcactcgcggcgagggagctggccgccatgggcaagcaggcgagcttctcgggcagcgtggaggtcatcgagatgtcctgacccctccgctgcccttagctccgctgcccacagccagacccgttataaatatatattatatataatgcaaagaaaggtaaatggttttacttttatttttattgagaagtaaatatttctattttttatttatttaagctattcattctggcaatgatttggcaacagtgcaggtggtcctcgagctctatttttactgtctggtatttaaactgaaacatacctttctaagcaatacgaggccaccttcagtcgcaaggtgggtgccaggcctggtgcccctcccagttcccccaccccaggaaacactgctgacacttgcaaaggctgccgagcttttgtgcactttttacataagaaaaaggattaaaaaaggaaaaaa

SEQ ID NO: 179435 - DNA, 366 bp, Homo sapiens
gggtgatttatttttcccaatctatgttcaaatctgtgagctgaaaaggaggcatctggactcagcacagtggctcacacatgtaattaatcccaaccctttgggaggccgaggcaggaggatcccttgagttcaggagttcaaggccagcctggacaatatagtgagatcccatctctacaaaaaataaaacattagctggacatggtaatgcatgcctgtggtcccagctacttgggaggctaagatgggaggatcgcttaagccaagccagggagatcaaggctgcagtaagctgtgattgtgctactgcactccagcgtaggtgacatagcaagaccctgtctcaaaaaaataagaaaagaa

SEQ ID NO: 179436 - DNA, 430 bp, Homo sapiens
tgagagcttgagcacaagtatttagctaccacatataacttacttccacccaaaatatcgtcgatggttcacctaaaatttttaggcatttctcttgaaatgcctgtaatttactaagtcatcaagaagtaggaatgtggaatggaatttcagtctatcacagttaatttttaacaacaataagacagacatatgttacctatttatacttaaatgtttgatttcatggctattctgtctttgtaaaactatattggaggctcaaacgtggtgcattgttttggatttgaaaggtgttcattttgttttcttcttttcttcctttctctctcacccctcatcgctccagagcatgctgggctgccccgtgcactgttatgcttatttaattctgctatttttctcatttcatgtctccccaatattacta

SEQ ID NO: 179437 - DNA, 273 bp, Homo sapiens
aatagcttctctgccttgcatctgactgactgagtgactgactgacgagaggtcacagtgtgttggactgctaaagtagccagccttttcttgttttcccaccctatttgtcagtgtaaagtgttctaagctgatggcttctctttcctttttttctactttcttccttggactccagtgaaatgaccctctccaagttacctctaccctcgtggctgcttttctgcttcttcattagtgcctaagctgagtgtattgctcatggttctagcc

SEQ ID NO: 179438 - DNA, 332 bp, Homo sapiens
attttggggttacaaatacattttaacaagtaggtgaattcacaaatatggaatctgtgagaatcaattctacaagttttctgaaagacaagatggcaaggctcatggaagggcttaaagatattcatatcctttactcctgtaattgttattctagagataatcagtattcattatgggtcacttacgatgaggatgtggaagatacagagaagtacaaggcatttaacatccaactgggtaatgggctaacaggcataaattgaaggaaaagtgaaagatgtaaacactgaaacactaggaaaaacaaattttttttttgggaggaagtg

SEQ ID NO: 179439 - DNA, 249 bp, Homo sapiens
agcaggaacgtgggtacttccttaatattagtcagtaaactatacatatgtacactcttttgtatgtgtaatgtatttcccagtattttttttcattctttcaattgtagtaaggtacatttaacataaaatacataaaatttctcactttaacctttttttttttttttttttgagatggagtttcactcttgtcgcccaggctgatgttacattttctagaagttctcagtgatgggcatttaaagg

SEQ ID NO: 179440 - DNA, 269 bp, Homo sapiens
gagattctgcatttccagtagtctccgaggtggtgctggatctctggactgccagaagcagctggaatacctgcttttggaagaactgggaaccagccaaaaccagcaaactagggcctagaattcagtgcagaggcccaggaaggctaccaagttaacagcttaggattcaaagtaaaaatggggtgagctgtaaggctgactgatgcagtgctattcagaactggggctctcagtgccctgtgtgtccctgacgcgaggaaaaatgg

SEQ ID NO: 179441 - DNA, 562 bp, Homo sapiens
aaagctccctcatgcagagggaggcggttctgagtggatgtcctggtttgtagtaagaggtggttggttttatagatgagtttgaagagatggtgtctaatttacatagggtgcaaaggattggttggaccaggtgtgccatttacattgtgccctaatctttcaccaccctaatcctttattatgcagataggttctctacctggccagcaccatgttgcctgcttctttactgcatacatagtgacaaagaaaagggaagatggagcctccgtgttgaacatacctggcttccaggtatcccttttctatttgcacagctgccggcatttacctatgcagcttccagcttgcttacctgtctgcagcttgatttttcaggctgctgtttgttagaaaagaaatgattttggggctgatttttattaaaaggcaaatcttgctgaggactctcttaccctcactatctgcctaaataatttttttctagctcctgtatcaatagaatcagataagccaggagagagtactagaaacaatacattttttttcccattgaaat

SEQ ID NO: 179442 - DNA, 563 bp, Homo sapiens
tatatcacacaaactggttggcgtcctgttgaacacaaacaagagaaatgtattctctcacagttctggaggccagaaatccaaaatcaatgtgttggtagggtcactctccctccaaagtctctggaggaaggatccttccacgcattttcctggtttctggaagttgctggcaatccttggcgttcctaggctcatagctgcatcactttagtctctgcctctgccttcacatgggctgtcttccccctgtctgtgtcttcccatggtgctctctgtgtgggtccccagtcacaatggattagggcctattctactctactgtgacctcatctaaacttatatcttaattagatctgcaaagaccctctttccaaagaaggttacatcacaggtaccaggggtaggctggagtgcaatggtgccatctcggctcaccggaacctctgcctcctgggttcaagtgattctcctgcctcagcctcctgcgtagctgggattacaggcatgtgccaccaaacccaggtaattttttctattttcagtagagatggggtttcacc

SEQ ID NO: 179443 - DNA, 502 bp, Homo sapiens
cacagttaagtgccaggttctatgcacccctatgtgggggtacaaaaacactgaatacaacccagtccctgctcagaaagaaatcacagcccaatctggaaatacagatgtagacaaatagttttattatgataaaggaagtgctaatggcaagtactaatatgctgctaatggatgctgtgggcaggcagggaagcagtccttagcctaaccttggggggaaaagaaagcttccttgaggaaatgatgttacagctgagccttaaagtataaataatgttagccaagtaaaggtgggtgaggacatcccaagtaggactactacaaggaataaaacaaaaatatgcgtgcatatacctgtactacaatagaacctgtgtacacaggcaggaagacaagatggttccatatgttccatgtaccaacattttcacatatgtctttgcacatgctcccaccagtttcaaggttcgttgtgttcactaattaactcaaccacaaa

SEQ ID NO: 179444 - DNA, 174 bp, Homo sapiens
catgtccttctctttcagttgaaacaattgattttttttcctgcacctgaacacactgggctgtacaaaaggagagcattaaaacgctcccctggaggtaaacattgcagttgagctcactagaattctgacgacatcagagggtttgtcctgtgctacttgtaattgacccag

SEQ ID NO: 179445 - DNA, 423 bp, Homo sapiens
gttctattttgagaagtagtggaaaatacttaaggtggaaccgagtaaaacaagctatttgttagaagagttaagaatttgaattttatctgaaagtatataaaaggaatatatggtcagttttttctggttttttttttttttttttgaggcagagtcttgctctgtcacccaggctggagtgcagtggcatgatctcagcttacggcaacctccacctcctgtgttcaagccattctcctgcctcagcctccccagtagctgggattataggagcgtaccaccgtgcccagctaatttttgtatttttagtagagacggggtttcaccatgttggccaggctggtcttgaactcctgacctcaaatgatctgcctgcctcagcctcccaaagcggtgagattacagcgtgagccagcacgc

SEQ ID NO: 179446 - DNA, 240 bp, Homo sapiens
aaaattagccaggtatcgtggcacacgtctgtagtctcaactccttgggaggctgaggtaggaggactgcttgcacccaaaaggtcggggctacagtgagtcatgatcacgctgccactgcactctagcctgggtgacagtgagaccctgtttcctagaaaaaaaaaaaagaaaagtaaaaagaagaaatgccctcaacatgctaaacatgtaaatctatacagtcagaaagcaggttag

SEQ ID NO: 179447 - DNA, 650 bp, Homo sapiens
  misc_feature (618)..(618): n is a, c, g, or t
cctctctcatggatgatagctagcatttaggagtgcttgctctgagctgtgtgtactatattcattgttttagattcattttcccatttctttcaaacctacttaaaaaatacctactacgtgctaggtactgttctaggcactaggaataaaaacaaaaatgtccttgtctagaaagagtttatattgtagtgaaatgtaatctttataacatttaatcctcattacacctctataaggtaggaactgctattatttctactttacagataaagaaactgaggctgttcgggcaccatggctcacgcctgtaatgccagcactttgggaggccgaggtgggtggatcacaaggtcaggagtttgagaccagcctggccaatatggtgaaactctgtctctactaaaaatacaaaaattagctgggcgtggtggcacatgcctatagtcccagctactcaggaagctgaggcaggagaatcacctgagcccaggaggcggaggttgcagtgagccgagatcaagccactgcattccagcctgggcaacagagggagactccgtctcaaataaaaaaattcactacctaaaatggagaacagcttgcagcaggtacgtnaggaagggccctgggatcccacctaagaagaa

SEQ ID NO: 179448 - DNA, 515 bp, Homo sapiens
gtagggtggatgaggggctgccaagttagcaatgaatgtttcccatttcttcttagtttatggactttccataaactcaggatggcagtttggttggttggagaaggatatggtgatggcgggagttacaatacattacttataggggaagataggcttttgaaaggttaaagcttaaaagtgagaatggaaaagggatgaatgaatgaacatgatgaggtgagagggaagaggtaaagggaaaaggagaacaagcaactcttctctgcgtggcacctgggatgaatggtttctggggacatccctgatggcagttttgtggagaggtgcaaagctttatgtgttaagaaatgagctgtaggctcagtgcagtggctcacgcctgtagtcccagttactcaggaggctgaggcatgagaatcgcttaaacctcggaggcggaggctgcaatgagctgagatggtgccactgcactccagcctgggtgacagagctgggtggtggctcaagatatg

SEQ ID NO: 179449 - DNA, 354 bp, Homo sapiens
ccaacgctgctcacaggcctcactgcaatttgatatgcctgctgatcagagtctcttgggcattttatattttgcatctctgatatatcaaggagaattgtgttagtcacatgatgattttgttttacttttttaatgcatttattattttattaattggactaaatgatgagaccagaccagtgtctacatattttcattgttagaaaaatctacaaaagtctaccctttctacagtgatgactttaaacaaaaaaaagcagcataaatattagcctgcaagagcagtcctaaacagtcacaattaaactatactacacaagaagactgttgtgagagcgttggcctccccca

SEQ ID NO: 179450 - DNA, 312 bp, Homo sapiens
attcaaatttatagacactattgaggagtaatactctctgatatatcaaggagaattgtgttagtcacatgatgattttgttttacttttttaatgcatttattattttattaattggactaaatgatgagaccagaccagtgtctacatattttcattgttagaaaaatctacaaaagtctaccctttctacagtgatgactttaaacaaaaaaaagcagcataaatattagcctgcaagagcagtcctaaacagtcacaattaaactatactacacaagaagactgttgtgagagcgttggcctccccca

SEQ ID NO: 179451 - DNA, 260 bp, Homo sapiens
atgaacagagtcctggagtgagctagtcaccccttagcccagtgggccacaatggcttatagatcaaggtctccatgtaatagctgcctccgtgcaaatgctgtccaatagtgagtgaactgggctcttctcagctacaaaagtgaagccttgagatcatcaatcttgactcccccacctgtggagaaagtatcctccctatcattatttgaaccattgggactttgaatacctttaggtcgtatttttccagccctctt

SEQ ID NO: 179452 - DNA, 563 bp, Homo sapiens
tgtgtagagacagggttttgctatgttgcccaggctggtctcaaactcctgggctcaagcaatcctcccacctctgccccacaaagtgctgggattacaagcatgagccatcatgcccagtctgctgtaacaaattattttacatggtggtggtgatgatggtagtgttttaatcttaaaatgtctttatttgccttcattcttgaaggatattttcactgaaaaaagaattctggatactagtttctttcaggacttacatgttatttcattctcctctgtctccatgatttctaacgaaaaatcagccgtcagtaaaattccctatatataatgtgttgttttcctctgctcctaccaagatgtgctctttacctttgtcttgatttgggcttctttgtgtttattcctcttggtgttttgaggggcattctgcatctataaatttctttttttttaattaattatttttttagagacagagtcttgctctgtcgtccaggctggagtgcagtggcgtgatcttgactcactgcaagctccgcctcccaggttcacgccat

SEQ ID NO: 179453 - DNA, 384 bp, Homo sapiens
ttttaaacaactgatcaaatatataataagcatatctatctatctatctatctatctatctatctatctatctatctacaggatctcactctatcacccaggctacagaacagaggcatggttgcagctcactgctgccttcaactcctgggtgactcacctcaccctcctgagcagctgggactacaggcatgatccactgtacccggctaatttataaagtttttttaaagatggggtcttactattatactgcgcagcctggcctcaaacttctggcctcaagcaatcctcctgcctcagcctcccgaagtgctggtattacaggcatgagccaccatgcctggccaacttttcctatttttaagccttttcttataaata

SEQ ID NO: 179454 - DNA, 669 bp, Homo sapiens
tcccccaggtagactgaaccgggtagtttagcgtcgtctcaggttaagaagcatgcgcgactattcggcagtgaggaggagggaggttacggagagagaaaagaagtctctttcacttactgaggtgtcagtgcgggagggactttcgcatcatttcttctcggaagttggcgattcgctggttttcgctagagaacgttagagcttcacaggctggcttgtaaaagcaacctggagtgctgttaggtctacctggccaggtagacctaacccaggtctggaggaaatgggagtggacttcattgtgagtcaaaatccgtatcccaggcccctgaagggaaaaggcatttccaggagatggagaaagaaagaagccacaacagtaggtctagtaaacccaagtcaggaaaagggatagaggactatagatggggttctctatctttctagccaaatgatcattaggtttcagaactagaaagaagtgtttggttgtgctgttgtttatgacatacctgggtctgtattgttgttagttcctgaaaaaattaaatagagtggataaaatagcaggctttttgagaaaggaaaattcgctttattggaaagacaacattttaattttggtttgtattttggcttaagacacagaaattgcaaatggctctg

SEQ ID NO: 179455 - DNA, 443 bp, Homo sapiens
ttccttcaccgaagttcctcctcagcagtgaggatcctactgttgccaggtctggaggaaatgggagtggacttcattgtgagtcaaaatccgtatcccaggcccctgaagggaaaaggcatttccaggagatggagaaagaaagaagccacaacagtaggtctagtaaacccaagtcaggaaaagggatagaggactatagatggggttctctatctttctagccaaatgatcattaggtttcagaactagaaagaagtgtttggttgtgctgttgtttatgacatacctgggtctgtattgttgttagttcctgaaaaaattaaatagagtggataaaatagcaggctttttgagaaaggaaaattcgctttattggaaagacaacattttaattttggtttgtattttggcttaagacacagaaattgcaaatggctctg

SEQ ID NO: 179456 - DNA, 463 bp, Homo sapiens
tgtcacagagtcaattccctggaataatcacattttctggccggctccctcctcctcgccaacacgattccaggaaaccccaatcagccaggccccaggaggcttctccagagcttcaggaggcttggggggaagggcccacacccagagctttctgggggccagacaacacagttcctggaaggggcagtgaaagggtgaaagaaaagagggaggtttagtgaccatgtctacattcagttggaactgaattttggcctctgctgtccctaccagaccaatcccccaagctttgctgtcatacctgagaaccccagccatccttaacccagttcctgaagagacagcacagattctcccttggagaggttcagggagaaggcccaaaggaagggatcggtccatggtgcggcttacagtggcaccaggcatatttggagagattgactcacgcagaaaggct

SEQ ID NO: 179457 - DNA, 726 bp, Homo sapiens
aggaaacagtagtgtccaccatggtctgcgtctccccaccacggattgtcttggctccggatttgagacatggcagggccagatgaggacaacttgatgacagtttacagagatggaggcagggtgccaggaagccacgggggagcccccagggcactcagcagtccaggcagggctgggcgtcctggcaaggagcagggaccttctgcccaggggtgtggccagcctgtgggtgctgtgtgcaggaccccaggaaccaaggccgcagtctcttccctcgctccagcatcctcccaaggccacccttggctgcactcagccagagagctggggcacagggaccccacaggtttccctggaggctgtcaggggctccggtgggggcggggggtgagcccgctgggttcactgcacctcccaaagcccatgtgccctgcctgccccaaccaaagtgggcctccaaggtgctggggtgggacagagacccacgagggaccctcccctcactcctggacctgggtgttgtggcttttggcaaaaatagccacatacactccaagtttccccctcagctgggattcctggtgtgagcctggtcaccagggtggtaggacagaccctcctctggaggcaaagtgacggtcagcagggggttctgagtgccccacagcgctggcaccagtcttggctgaatggcaaagctgcatctgtctccttccccatgag

SEQ ID NO: 179458 - DNA, 325 bp, Homo sapiens
cctcctctggctgaggaccaggctgacgtgagcccagaggaactcgacccccgcccgtgggtgttgtctgcgccactccctgccccgggtttcatcctgcctgccttccgctctgtccgcatggggctgcccggggggtaccgggtcaccctcaggaacgccaggctctggcagaggaaggggtggcggctgcagccagtggctagggagcgcattctaggcctggcctatctcagtcaggaagctggcgtctggcgggggactgaggcccagggaccttgggggacccagctgatttgctccaggctcctcaccatgcccggag

SEQ ID NO: 179459 - DNA, 488 bp, Homo sapiens
ctcaaatcaaacccctcttagtggtcctcctgtgtttaattaaccaaataagtgtattcagtagattactcctttatcggctgaatattctcgatgtcaacagtatgagcaacagaaaataaaaacttggaattcagtgacagctttttatgtaactgcctcagttttcttagggtaatcaagccaaagagaaaatcagagatgccaaggatagagtggttgagagaggcccatattgaaataggcacacgattgtcaccatttctcactttacaagctgtataatcagtaagctgattctttttatacttcaaattatatgaacttgacctcatatttggctgcaaataccctgatgattctcaaatctaatgctacatcttagcttattccctcgagctccagacaatgtgtctaaccaaatgtttgcatttgaatgtcccacaggcatttaaatttagcttgtttaaaatctttttctgaaaaaa

SEQ ID NO: 179460 - DNA, 556 bp, Homo sapiens
ctttactctatgttctcgatcgttatctgtatattattttgtgtactccaggtacataagttcctaatctgtgaaaaatgacatttgtgtttcatcctctcctatcacccacctacccatccattttttacctccttaccactctgctgaggacttccaatatgttggtagatagaagtgggcaagtggatggacactattaatcttacatcagaaggaacattccagtgtttcaccattaaatgtaataactggtataggttttagatactacccttaataaagttgaagttcttttataaacttttattttaggtccaggggtacatgtacaggttacacaggtaaactacgtgtctcaggagtttggtgtactgattattttgtcacccaggtaataaagatagttcccaataggtagttttttttattctctcccttctctgtctccacccttaagtaatccccagtgtatgttgtttccctctttgggtccatgtgttctcatcacttagctcccactaacgatgagaacatagaagtatgtggttttctg

SEQ ID NO: 179461 - DNA, 735 bp, Homo sapiens
gtggcggcagaaaagggagtgagccacacaggaccacatttgtgcaaatgcgtgggtgggagaaacaatggcacgtttggaacccacaggtggttcggcatcagtaccaagtccaccagatgagggagggacactggccagagaccagatgacaaagggccactgatccctgcgaatgaggtcaacatgttctgaaaggtactcggggttccgtagcagggttctcaggccttaaccaggagagctggtgaaggcacaggcggctgggcctgcccgcgtattttctgattcagcaggtctggagtagacccgagaatctgtacttttaatttatttattactgaaacagggtctcgctctgtcacccaggctggagtgcagtggcgcaatcacggctcactgcagctccaaccttccaggtctcaagcaatcctcaagtctactgagtagctgggaatacaggcatatgccaccacgcctagctaatttttgtatttttttttgtagagacggggtctcgctatgctgcccaggctggtcttgaactcctcaaacaatccttccaccttggcctctcaaagtattgggattataggtgtgagccactacgcctggtcagaatctgcaattctaacaagtccccaggtcctgtgatgctgctggcctgggccacaccttgacagccactgctctacaggacaggagttcaaatgggcctgattgtctttttagata

SEQ ID NO: 179462 - DNA, 652 bp, Homo sapiens
gtggcggcagaaaagggagtgagccacacaggaccacatttgtgcaaatgcgtgggtgggagaaacaatggcacgtttggaacccacaggtggttcggcatcagtaccaagtccaccagatgagggagggacactggccagagaccagatgacaaagggccactgatccctgcgaatgaggtcaacatgttctgaaaggtactcggggttccgtagcagggttctcaggccttaaccaggagagctggtgaaggcacaggcggctgggcctgcccgcgtattttctgattcagcaggtctggagtagacccgagaatctgtacttttaatttatttattactgaaacagggtctcgctctgtcacccaggctggagtgcagtggcgcaatcacggctcactgcagtcttgaattcctgagctccagtgagcctccctccctcagccttctgagtagctaggactataggtgcacaccaccattcccgactaattctttatttttttgtagagacaaggtctcactgttgcccgggctagtctcaaactcctggcctcaagtaatcctcctgtgttggcctgccaaagtgctgagatataggtgtgagtgaccatgcccaacctcatttttttttttgttgttgttgtttttt

SEQ ID NO: 179463 - DNA, 321 bp, Homo sapiens
gacgttagaggattcctcgaaatcgactgtttctccttatctaagtgcatgtttgtttttatttgacacaagcctatgatatagaaacaacgataagccccattttgcataaaagtaaagtgaggcttagaaaaaataaataactttcccagggtcccataaacagcaaataggaaattcaggatccaaagccaaataaatggtctgactgagggtgagtccactccctccaccactgagctagatatctcaccaattctaaaatcatctaggaaggaatgcttggattcctacatagaactgaaaataataaaaagtgtt

SEQ ID NO: 179464 - DNA, 779 bp, Homo sapiens
  misc_feature (779)..(779): n is a, c, g, or t
ctcataatacggcagtttacttttttacttttatcttccctaattcactttttatcttccatttatttgtccaattctcattctcttaaggaagaaagagtgttttgctcaaggctagttattttacttgtgttcctaatttcacctcatctaacttaaaagttgcaactttacattttttctctccctaaattttatattatttggcaacaaccaacaagttatccctcttttataaatcccaaaccctcaataaatattctcattgtcaatcagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggggggggcaggaaacaaaactacgccgggcgggcaacaagaaaacgcacgacacacacacagatgtagggacagaggggggggcaacaataaggggaggaaataaacaaggaagaggagcagagagacaggataaaaaaacgagagacgagagaacacaacagaccaaagagagagcaaagagaagaaaaacacacccacggggggaggcaacaaacagcaaaacaacacagcgcaggaagaaaaacacaacgcggagaaccaaaacaaaatacgcaggtaaagaagagaaaaaaaaagcggagacacagcggacgaaagacaaccggagaagaggaaacaagaagaaaatatacacggggcgcacagagagaggn

SEQ ID NO: 179465 - DNA, 307 bp, Homo sapiens
  misc_feature (290)..(290): n is a, c, g, or t
tagtcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgcctggctgtgatgtgaatccctcctgcgcactgtgtggttcaggcagcatccagcatctccgctttgnaaggtccggctcatctc

SEQ ID NO: 179466 - DNA, 569 bp, Homo sapiens
  misc_feature (19)..(19): n is a, c, g, or t
ccatagctgactctagagnataaaaacatgacacttagaatgtaagtcacagtatggcggccacatgtaggtgtctacagataaacaattaactgtaataccaagtcaatggcatgattgtcaaccaaggtaaatgcaatatgctttggggactcaggggccagtgcaaataatgttgatgaaagtgtcaagaaagtctttatagaggaggcataatttgaaatttgcagaataaataagatttttttccccaggataaaaagaggcataaaggcattctagttagaggctggagacctaagaataaaaacccacagaagcagaaaggaattcagcatagaagctgcctttctagagtgaggtaaagctggaatggcagtctgggccagatggcagagccctgaaggctattgctggatttgggttttattccataaacagtggagaagccattaacagatttctgatgagaagagggatgtgattgatccttcaagtgttttagaacatagctggtgtattgctggcagtgtataaagtggattggatgttttcactaaaaaaaatgt

SEQ ID NO: 179467 - DNA, 643 bp, Homo sapiens
ctagcagatccctaagaggctgatggtgaggctgaacttgagcaggaagcagagcaggaagtagtgctgggtcttcttgggaatggactggaggtttttccccgttgccatagacatgatggagctatgggggggcttccccagcagagagatgctgagcagagggtagcaaaagcaggacagccacaggatgtcggtggtactcaggagtggcggcagctggaccaggcaagaaaggaactagaccaggaaagaagccaagagccacagttcaattcaggcaaataataagggcataggagcccccgagctcccttgccctgggcccagatagatgctcacatcctgccagagggaacaggggccggagggaatactcttctgccaatgagggtcagctcaaaaagcccaggggcttcacagaggctctggggggaccccttgactgtactgctaaccccagcctccttcctcagattttcagctggcccctgagtgaaggggtgagtggcacgggggcgatgcctgtgcgggccccacctcacctggctaatatctatatatcctttaaatccttttgttctgtcttggatgtcactgtcttcaggaaaccatccttgattttcccacctctcagtctgtg

SEQ ID NO: 179468 - DNA, 757 bp, Homo sapiens
ttttttaaatggcatgtgagaaataaaaaggaaatcccctgttcaggcagctctggagttccctaattgcacaagagcaaaggacacccccacggaacatgtatgccttctgaagccattgctcaacctacactcattgtgcaatttcaatcttccaaagttttttgctgcacatatgcaaaccacgttttcctctgcattctagaattaagaacagtttatcattattctcttcactttagagaggggtgtatgcatgagccaaaaaagaaaaaaaaaagtattgctagataagcattcactacaaatgaggttttatattatttcatctggttatttctgagtttactggtagttaagaaacacttgaattcactcttaggcagctaaagattcatttttcctgtcactgacaataatgatatcacaaaaaatagcccacgaaaacatcaaaccttcaaaagcctttgtcctaaatgatggcaattctagagtatttgaaacagttaaaagtggaagtccctactgtgtagtcaaaattccaccggaaggctaagcgccgtggctcatgcctataatcccagcactttgggattacaggactgagccactgcgcccggcctcctttttttccttttttcttttttttttttttggaaatggagtctcgcgttttgtgccccaggctgaattgcatgggcacaatctctgttcaaaaaaacctctgttccccgcaaccaggtttcctcaaaagcca

SEQ ID NO: 179469 - DNA, 628 bp, Homo sapiens
acagagcctaggaaaggtcgccacacgtcctcatcccagctccagggggggcaactctgggctcagggatgtcacttcccacagtcaacatgctgggattgaggctcataccctgaaagtggcctccccatcatcactgaccccgcccaggtagcagaggaacgtcgggttctggatccacagctcggaaagtctgctttgtgactggagagagtcaccgtcgaggagtggccattatcctgagcctgtcttttatcgccacgttgatattttacccgtaaccatgaaaatagatggcgactggattttgttccttgcggtatgtcctttgcaggtaaatttaggaaacctaatagggtaaaaggctcaaggaatagggctattaaaacggggagactcctccccgcatgtgaaaaattgagttgtctcccaccactacctgaggggtctaccccacccctttgggtggtggcttaggcctccatgtctgtatcaccacatctcacagacgagactgtcctggccccagaaggtaggaactgagtcttttcaattccccgagagcccatgatggggtctggcctcatgtaagaggaacatgaggaaagccagagatggcactgtcatt

SEQ ID NO: 179470 - DNA, 385 bp, Homo sapiens
  misc_feature (75)..(75): n is a, c, g, or t
ggagtacaccagtatggaggccgaacttagtgcggacacccgatcgaatagcgcactacagcccagaactcctgnactcaagcgatcctccagcctcagcctcccgagtagctgggattacaggcgcacaccatcaatgcctggctaatttttttgtattttaagtagagatggggagggggtgggtgggtggtgtgtgcttcaccatgttggccagagtgatttcgaactgacctcaggtgatctgcccaactaggcctcccaaagtgctgggattacaggtgtgtgccaccacacccagctgcacccaattgttagatctaattttaatctaatctcaaaaatggtcttttaattggtgatttttgccttttaattggaggtt

SEQ ID NO: 179471 - DNA, 1532 bp, Homo sapiens
aagagagccaacagacaaaagagaaaggccagctagacagggaccgagagcccactggatgtagtaattaggggccactagaccctcatcaagaacagtttcctgtgagagatggggcagaggaaaatgaaagggcaaggaaagcaggcagcatggccacctctcagggaaagctgctagagtaacagtttgggccaggggacaatttctgagctggctctggactgagatgacctaaggatagatgtgatagaagcagtccagaaggctatcacctagagtcctcccacctgtctgagtcagaggcaggagcaaagggcgagggtgggcaaggaaggaaaatgtgcatagctggcatcaagtaggaaagtgtatgtacctgtaccggttgggagctcaccaaagaagggtgagcatctcaacagggatagatgaagaaccagagatgcactcaaagaaggacaaggccagaaacgagttcgtgacattttaggaatgggtacaggaagagagtcctgctgaggagactgagaaggaggggccagaggagaagaccaaaaacatggggttcctagaagccagaggacagtttccaaaaggacagagtggccactggtgggccacatgcacagaggtcagtggaggctcaggcatctcctagacctggcctttggggacttttgtcacagcaactttggggcacggggcagaagctcctcttggtgtggggggaatgaactgggtctggctgagaaaggagggagggggagttggagcaggcagtgggtccaggaaggagctaattcttccaggagacatgggagggaggaagcagtacaagcccagttggaagggcagggcggggcagtgagaggggccctggagctctgggattaagtgtagaggtgaagggattagcagtgttggtgaaaagggacaaaagtaaattatgtacattttagcaagtaacctgatctccatgttctttgggaggccttttctctgccctctgggtactgactccagctctaattagcacgggtttgtctgcctcgtggctagggccatgtctttctcattttcttgtacctttcagcacctagcaacaggcagccagctaggtaggggcagaataattattttctgcttgaaatccagtgtctgaaatagagattcagaaatttttctttgtatcaaaaagactttgtgacaatatccagggagcaatgaaataggtaaggtccaggtcacaggcttgaatgggacattcagggtctcagtagcagttctatttgttggtattgcctagacatcaaagaattctatttcttcgctatttggacagaagtcaaagtccagagagaggcttggtttagctggctgagcttgggccttgtgccatccccgataggacctgggtggtaagaggcaggacctggaggaggggcctccatagcttccatgtgagagaacggcccaggtcccaccacagccacataagatagaaaatttccctaaaagtaataaggggc

SEQ ID NO: 179472 - DNA, 266 bp, Homo sapiens
cggggtccagctccacttctacccagtctccttgctcccatgcccccatctgaaagctggggtgacgcagcaacagccctgtttcatgggtgccatgagcagctcacaggcctgcccagagccagtcctcagcacacagaagtcactaccctgaagggactcatagggtcattctcaaggagcagttttccttttaggaggaatggccgggacctgcccatggcctcctttcagcccctaaaccggcctgcaccctgagactggat

SEQ ID NO: 179473 - DNA, 417 bp, Homo sapiens
gttgggcataaagatgggaacaacagacacaggggaatacaagaggggaggaagggaggagggcaaaggttgaaaaactacctattgggtattatgctcactacataagtgacagatccattcgtataccaaaccccagcatcatgaaatatacctttgtaacaaacctgcacatgtaccccaattctaaaataaaagatgaaaaacaaaaaaccagaaaaccccaaagtaaatacagaagtaaataaataaaaagaaatatgtaaaatgttatgtcattccaaaggaaaccacttgtattaagggacagtggttaaaacaatgagaggactttggtaataaggagccttgtgttaaaccacaaatgatggatatgactttaataggtagatgtggtagggaagaccttccaagcaa

SEQ ID NO: 179474 - DNA, 536 bp, Homo sapiens
cttgagtgtggctagaggctactgtatgcagtcagtcaactgtttaatgacaagtttttgtcagattcatctttgtaacccccatattgccttacacatttccctcaaaacagtagttgatcaaaaatgtatcaaagaatatcataacaatatattgttatatactatttttcatggcaaattcagactttcaacttattggagggtgaaataagtcttggtgaagtaacttgagattataatcattttaagtgtattataacagtgctttgcccataagagaggtgtgcaatgaatagttgtggttctcgtgtgttgctgagttgagtacttttctacattgtaaataatagatttaccattgaactttaggaaatacataagttgaaggttttctgtatcatattctctagaataactttctcctccctgtaaaactgccaaacctgcacttctataagagtcatccaggatcaaaagtttctccagaaatatataccatggagagtgcctactcccactacagatttcatttt

SEQ ID NO: 179475 - DNA, 367 bp, Homo sapiens
tctacatatgtttacctttatggtttgtagtttatcaagtggggaagatcatagtgacacaagataaatttactgattacaggcgtgagccactgcacccaggaccaggtcattcctcatacctccaattcttaagagttattgtcagtctcaagtaggcacattggaagtatcttttgcttgagtgatctgaaacctgaaaatttattatttttttttcttttttagacagagtctcactgtcacccacgctggggtacagtggcatgatctcgactcactgcaaccttctcctcctgggttaaagtgattctcatatctcagcctccaagtagctgagacaggcatgtgccaccacacccggtaa

SEQ ID NO: 179476 - DNA, 310 bp, Homo sapiens
caggtgttcaagaccagcctggacaacatagtgataccctgtctctacaaaaaataaaaaatgaaaaattagctgggtgtggtggtgcacgcctacagtcccagctactcaggaggctgaggtgggagaaccacttgagcccaagaagtcgaggctgcagtgagttatgattgcagcactgtactccagcctgggcaacagcagaagatcctatttcaacacaaacaaacaaagaataatatctgcaatgtattgaaacatagaggatatgtcaaaatccaagcatttatagtgatattttaaaagcttt

SEQ ID NO: 179477 - DNA, 633 bp, Homo sapiens
ccctctgttggccaagcccatgggtggtccaggagcagctgtcacattttgactgccaagcattttggagtggaagttgaccgaggcatcttccttctcactaggggccttgcgtgtgttttgggggtgaggggttggcttcctgcctgggcctctgtggagcttctcctttcttgcccagccttcaggacttcagtgtaggctctgcagcaaccccattgtctgctcaaggagggactggagagatgggattttccctcctgctactgcactgtttggagcgatgggaagtggaaagagctctccctctctgtccagacaggccagtggggagctgcctggcaagctgctctctagctgtgggctctaggctgatctcttaatccttggcaggaaggcagaacttgataccctggagagggaaggactgaagcccagtttattcaggtcccagaatatccacactcaggaggatgtgtgttgggggtgaatttgggatccctagagttccagatttagccactgtctcagtgtgtggaagtcaatttgtgtgctttgggatgtattgtttctatgtctgttaacttaaacacacaagttcagggaagcgtccatgacagctataaatatctt

SEQ ID NO: 179478 - DNA, 641 bp, Homo sapiens
ctcacagagcagtggtgggagctaattgaggttggcgggggaggcttcaccccaatctacagcatttcaagcctttgccaacctcacagagcagtggtgggagctaagtgagataatgtacaggaaagcactgggtaaattgcaaagccttttacaaagataggaagcattatgaagacattttccaaatggcctcaagaaactgatttggttgtgcaacataaacataccactgggaggccgcagttaccagagtctctatcagagacttttcaaaataaatgcagtgactcaaatgtgtttccagatgatgctttgaggattactaacagagcagctattacaaagcagtcagacccaccggctcatgcatgccctaatcctattataagacagaccagataccacttattttgctatgtcaaccttcctttgactgatagtaacaattgttaggcctgttataaaaggcaggctgaacagtgggaaggcatttcacagtgagtcagcaattatagccttgcaaattctaattgtctacaccttcagggtgtagacagttgtgtcactttctatgtatatcctgaaatgagtgaaataaaactgaaaacctaagtgatataggaatacacaggtacaga

SEQ ID NO: 179479 - DNA, 151 bp, Homo sapiens
ttttccattttgatgctttttgccttcttttctactttatttgatttagggggaactctcatttacctacttatttttgcgcatccctttactttcatttctctgtaattccgttttaggtatgtgctatgatctgaatgtgtcccccaga

SEQ ID NO: 179480 - DNA, 122 bp, Homo sapiens
tccctctttacacgccactaggtcaccaaactgtccctgaaatttccacccaacttggatatttactcctccaagatgcttccctacccctccactccaaaattaatcaccctcttttctat

SEQ ID NO: 179481 - DNA, 379 bp, Homo sapiens
cttgtaaaataaggtgactggatacagtcatgactaatgacgactcccttcttgataaaaatttagacaggcttctctgggccctccctttgaggatgcctcatccttgtgctccgttctcaatctggttagcctagttttagcaggcatcctgataaatcagtccggagagaatccaccccacctttgctatctgcaagttcctcatcccccacctttgatacataagtccttagctacaattagcagctacccttaatgtctcttcttggtaatttctcatccactgaccacatcactctgctccttggctgtaaatcccaagttctctttgttgtatccagagttgagcctaatctctcttcactatggcaatagt

SEQ ID NO: 179482 - DNA, 530 bp, Homo sapiens
ggtggcggtggtggtggttgttggtagtggtgtgtgtatgcatctgaattggttgttcatgtttgaaactccagattttacattatgatagggcagtgtgacaatactgaatggtggttcctccatgacagccatcagttggaggtgagtagcagctgccttttttggataaggtgtgagctttcagctggacacaggtcacagctgacctcatcattcatttaagcttcctctctgccctctgtgggcattagggtttctgccccatggtccaagggactgagaatggaagaaggagaaatgagtgtttaaggtgtgagtgggagaagaggagctagagacagagtgactgtggagatagaagtatttggagaagccaagcaggaatcaagttctaagaagtcagggataatccacagaatcactctttgccagagttgagtcagactgagcagtgagacatttttattgacctttgagagaacagtgttattggagtataaggacaggaacagactgaggaacgagta

SEQ ID NO: 179483 - DNA, 506 bp, Homo sapiens
ttacgcttcaaatctgcctaccaggttttccatttccaggcagtcttttctaattttttccacctggaagaaactttcttttctctgagttcgtaatcttataataagtacctatttttctcttcttctagcgtatataaaatgtattatctgacgtgtcaagtgagttaatgcatttaaagagcctaggaatggtacctagaacatagtaagtactcaataaatattgttattatggtgatgattgatgatgattaagatgaggtgacctttgctttctgctttcttgtgatggcaaaaatgatttgttgtctgtctttggacactagggaagcaaagtcttttactttgcttatgtatataaaagtacaaaagtgaaattattcttgagctgtaggtgagagatatacaaagctagacaagcccttaaatattgacgattttgttaagcttcaccacagctgtttgaggtaggcggtatattagtccctttttaaaaatgggta

SEQ ID NO: 179484 - DNA, 544 bp, Homo sapiens
gttaacggtactcaagagatatcaagatgtctggaacgagaaaataaggactgaatattaagactcacccagttcaattttcttatagtatgctttaccaaataaggcataacctcagcctacaagcccttccttctactccagcttctaagtcttcttcatggtttacctgtgccttaagctaagtgtgtttcgattaattcttgtatgtaattgagtttggttcaaagtcaaacgtgagggtaattaactccagaacatgatcaaaatattttttagccatcgacaaactcattagtgagaaaggtcttttttttgtttgtttgagacagagtaagactctgccttaaaaaagaaaggaaagaaaagcaggcaggcaggaaggaagaagtgaaagtattgcattaattcttaattcttgagggttttggtgcctcttaaattttgcacccaaggtaagtggctcacctgcctcaccctagttcctaccctggcctcccaccatgcccagctcatttttgtatttttggtggagacgaggttt

SEQ ID NO: 179485 - DNA, 267 bp, Homo sapiens
  misc_feature (267)..(267): n is a, c, g, or t
atatgtgcacaatttctgcttgaaaatacctgtaagagacaccactgagagtgaagctgtcatttgaggatgccttctacctgttgtaccttttgaacaaagcaagtgtgaaagcatgtaatttgaattagggcaggtaataaagcttctgctaatttacgatgacactgcacagcttctaagtcttcttcatggtttacctgtgccttaagctaagtgtgtcatcgtaaattagcagaagctttattggggatactctagagtggn

SEQ ID NO: 179486 - DNA, 439 bp, Homo sapiens
gagtaaggtaagctttgtgccctcaaggaatttaaggcctagaattagaaactcaaagaaatcaagtgcctaaagtcacttaatattaactaataacttacttgcagtagtaatgtgaaaacacttttaggaaagcctagaaaatatagaggttaattttgcctaatgataaatgaaagctttatagaagaagtgatgtttggatagaatcttgaggaatgagtataaattttctaagtagagataaggaggaagatcaggaaggggaagttaaactgtactacctatagtttttatagatgatttgatagatggtgtggagatgcacacattaggagagaccatagaaggaagagggatacaatttgaaggagatgatgaatttcattttggatatgtttattctgaagagcctgggaaacactggggtgaatatgtt

SEQ ID NO: 179487 - DNA, 465 bp, Homo sapiens
gcgactctagcaggacctccaggtagacctaaccttttttctttaaactggtcacttgccttcaacacaacctgacccttttttcttttttatgttttgcttaatttatttccctctgcctgtccctcaattatcagagggtctctgaccatcttctcttctcctactaaaaattctcaaaggatgatcttaagcatttccttcacctacttatgctacactgctcatcagctcatacaagtctcctgatagctctccaaatggcttccacaaatctccaccctaggcccctcaaactaacatgcccacaattgaactcatcttggaaaacaataacacagtgtctttgaaagtgtagcacatgtaatgagttttgttttgttggaagtagggcttattccacattttgataaacactggtatccatctggtcttcccagacaaatatctgggtgtctttcttga

SEQ ID NO: 179488 - DNA, 393 bp, Homo sapiens
catgtgactgacaggtgaccaatgaagtaaggtagaagtcatgctatgtgacttaagactggctcactctttcctggtatgctggcactggggacttagtcatcacactgtgaggaagcctaggcggtgtgaagatgttacacaactccagctaaggtctcaagctgacagtgaataggccttcagatgattccaaccgctggcttttgagttttccagttgagtaggcatgaggagcagatagctgttccagctgagatctgtcagaattcttgatgcaaagaaactgtgagagctagtaccttacgctattgttcttctaagctgctaagttttgaggaatttattacagagcagtaaataactaatgcacaggttaaacagtattacaag

SEQ ID NO: 179489 - DNA, 445 bp, Homo sapiens
atgtgttcaggaaatgctgagtaaacatgaatgacctgtttccttagggttgatttatttatggagctaagagaatatgctttgcctatgagcaaggatacttcctttctcacaaatatagatcaactttttccagtgaaaacatcaaagcataaaatacatttttagtttcaaggatgacattaatcatagaattcatgattatgtaagcttttcttcctaccataagcattaaattaactttggcctttaaccctaaaatgtataaaatcaatcataaattaggctttattcctatcctgggatatggaattaagcacattagaattgtagagatacatgtggttatgtctaacctactgaacaaaatagaatatgtttaaaaactactcattgcttgctatgtcctggcaatggaaaatttcatggtagaaacatagggaga

SEQ ID NO: 179490 - DNA, 717 bp, Homo sapiens
tccaagggaggagcctctgttctgcacttagcaaagtctgaggaaaactttctcattatttggctgagactcttcccttcacatggcttcagtgttattgagaaggatttacccagattaagtttcaagttgcagattctccttgggtccaacagaatcaaaaagcactgatcccccacagcacattctttccagatttaattttaattttctctcataaccttgaatgttccagctttaattctgaaatagccataatcttatccctccagttcacttgaccacaggaagtctagctctttaccaacctcccctctccaaatacttctggaaatgctcaaggaatgcttacatggtctacaaatctttcctggtgtttgctctgccagttttctggctccagacactgttgattggaagaccacctctcagtgccaggaaaacagcattccttagacattccccactcttgcatttactttgctcccagcacagacacaggcccttcctagagtgtcccaaaacacaattaaacccaggctgagagctccataagccaagaccttcatagggacccaaccctacactctataactgttagtctgttgccatattgcaagacctagttttcttctaacaaaaagagttcccttggcaatacattccccaaattcaagttctccattatttgaggttcagagaacagaagattcaaca

SEQ ID NO: 179491 - DNA, 299 bp, Homo sapiens
gcaggagaatcgcttgaacctgggaggcggaggttgcagtgagcccagatcacgccactgcactccagcctgggaaatagagggagactctgtctcaaaaaaaaaaaaaaaatctgtccccgctaattactgtgggagtctaagtcctttccttctgccccttggaggggctgactcctggagcagcaccccctccaatccatctatccagtaacccatactgttaagttcacttagacagggtctcgctatgttgttcaggctgccctcaaactcctggactgaaacgatcctctcat

SEQ ID NO: 179492 - DNA, 372 bp, Homo sapiens
atgaaatgttagggagtcggagttgtcttcttgcactcagtgagttcctggctgggggccacaagatcagatgagccagttcattgatctgtgtggggccgccggatccatcaagtgcagggtctgcaaaataccataagcaaactttctcccaaagttaattcagcctatgcccggggaggaacaaggacggcttggagatgacaagcaagatggagtcagcaaagctagatctcgttcaccgtctcagtcataattttgcaaaggcggtttcgtttgcacctccctgaccccacccccatcgctggatgctgcattaaggcgagaacattcctaattcatacacatggtcaacactgactccaggaaaac

SEQ ID NO: 179493 - DNA, 252 bp, Homo sapiens
gcatttggtccaagaacctttcagccacagttgatgagctgattgtgggttttgtcgtgagcctggtctttagtgtcagctgggtttcattctaagatccccctggagaatttctattctgataattgcttctcttaacaactgatacgtttttattttatgagctggatgggcacctggtaaatattttttttcccttttttgcttttgttgctggggagcccagagccaagttgctatcctgctataact

SEQ ID NO: 179494 - DNA, 109 bp, Homo sapiens
tacaccctgaaaaatgctactaattggatctttttgagtgagcagctttttttgtagttatttggttattccatgtttggatgcttccttctcatctgtgctttctaaa

SEQ ID NO: 179495 - DNA, 468 bp, Homo sapiens
ggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaataccttttta

SEQ ID NO: 179496 - DNA, 143 bp, Homo sapiens
cacacagaaagttctccagcatagatggcatgttaggccacaaaacaaaccttaacgaatttaaggagactgaaatcatattcagtattttttctttttttttttttaatggagtctccctctgtcatccaggttagagtgca

SEQ ID NO: 179497 - DNA, 111 bp, Homo sapiens
aggtcttccaggtcatgctgtagctgtcactgccatgcagcccttttttttactccggacagctcatgtactgaagcgtcatgaaagaaaggctgtggtctgagcccttct

SEQ ID NO: 179498 - DNA, 431 bp, Homo sapiens
cagagggaagggaggatgtggaccctcctcaggaacccccagctgccgcctggaggccaagttgtagcccctggtgtaaggcagagaaaggtctggccctaagcccctttccaagacagggtgccctgagaccccgcccagcaggagcctaccaggaacccactggcttggaagcacgctggccagctcgctgagctccgcaactgagggggactgggtcccatttcacacagcaggagggtgaggcctgggtgctggcaggctgagctgtcctggcgtgtcagcactggaccccagggctcggaggaggggcacggctgaacaccattggtccctggggtcacactgcagaggtttggttctgtctcctgacccctcatggcacaagcgcctggacttctctgtgcctcagtttctttcttttttttttt

SEQ ID NO: 179499 - DNA, 1033 bp, Homo sapiens
cttcaccgcatacctctcgttccacagcccaggccagcacaggagtagggaggagacacctgaggggaggccggagaagcccagcagggccgtggggccagggaggtgcgcagccagcgctgatggcccccagggacagagccctagggaaccggagcaggagatgagagtgtctgctctgggacaggtgctctgcactggctcgggatggggaccagaggctgctaatccatcatcattaacgaatagagtgggtgacagtccctgataactgggaacaggttgcagagcttagccacaggatcacgctccaggctgttggccagcaggaccaggctcgatgctgagtcaaagatcaacttaggaggaaatttgagttttgggtgagagcgactccctggtggcctcagccctgtgacactcacatccaggacagttcccggtgccaagcgctggttatgtgtggggggcttgactccctggtcccaacgaggtctcagtgtgttgcccaggctggtcttgaactcctgagttcaagcaatcgtctcagcccagcctcccaaagtggtaggattacaggcgagagccactgcgcccggcccctggtcccagttctcaccacagcccctgcagtaagcagtcgggtatgtcactgacagagcagaagctcaggggactaaaactccccgcctgagttccctggtgaatggatggtggggccgagttccattccaggctggatggagcccagagctgtgggtctcctaccctcccatcccctcattccagcttgatcttccttaagagactcatacgccccaaccccttggtctgagtatcttagattgttctcgtggttcctccgtccttcaccactgaaggctgctgttcattctctctccgtctctgtcccttattgctctcacgtctgtctctgtcatcttttcactccttgtccctcttactccgttctttggcccccaatgaaagctgagtcagagacagacgcttcccctcagttcccagtgcctcc

SEQ ID NO: 179500 - DNA, 151 bp, Homo sapiens
cattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtg

SEQ ID NO: 179501 - DNA, 370 bp, Homo sapiens
gaaatggtcatttctgaatgtaccacgtgtaatgccaaaggaacccaagatccctgcccatgcctaataactgccaaacactgacaggcttcactgagctgctgaggccaaaaaaataggttcctaaactagtttatgttttcattcattcaacaaatatttactaagcagccactaagggtaaggcaataagtatcagccacgttcccggatacactgcagtgaacaaagcccttgcttcagtgctatgattctcaataggagaaagtacagaactaaagagggtgataggaaaacttcagaggctggggagccttttcggctacctgcttcattacaccctttaagggagtcctcctgaatatttaca

SEQ ID NO: 179502 - DNA, 391 bp, Homo sapiens
aaacattataccaaggggaagaaactactcacaaaagattacctatgatatgattacatgcaaactgatgatatgattacatgcaaactgtacaactctgtgaatatactcaaaactattgaattgcatatttgtatgatatgtgaattatatctcaataaagctgttaaaaaattatttctatagccaagcatggtggctcatgcctggcaaaaaaaaaaaaaatccatttcagaaaattagactcagtgcatcaaataattgtttgtatgtttatattatcttttcttagtgtcattcatgtatagagcattattagaatttgaaaccaaaaatctttttttcctcattgaattttggtgaggaaatatgtaagtggaaaaaataaaat

SEQ ID NO: 179503 - DNA, 806 bp, Homo sapiens
agatgaactcttaagtgtaggtggtatccttgttttctttttcataatctctttaactcgtcttagtaccttatttatttatttgttctgggaaccacatttgagctttgagaggcaggaggacagtgcttgatgtgttggcagctagtaacccctagtttaactgagttgaggacagtagtaatactatggtggcaatagcaagatttttatctctgcagccttatagtacaactgtcttggtttaaaactggattttattttaactaaattctgttttaaaccaagatagttctatataagaatgtctttggattggaagccttggttttagtttattcttgaattgtcaatatcagaagtttagaaatagtaattcaatggcaaagtattattacataataacaaaagatttattgtgaaatactggggccaacatggaggaatggcaagtatacgagctttgaccatagacagaccaggattttgaatcctagttctaactcttactaactctgtgaccaaatgtagatactcatcctgagatttcctcattgataaaatgacatatcatctcagcggagttgcaagtggtgttttacttttatctccatgtaaattaaagataaatgaaacttatgaaaaagtgtttatatagataaatgatatgtaaaatattttctaagttggaataactttgaaaaactatagagtttaatatgaatatgcagtatgtaccattttagcagaataactagtacctcatgtttgtgattgattaaagtatttatttcctcttaaatacc

SEQ ID NO: 179504 - DNA, 387 bp, Homo sapiens
tgaggggacacataccaaggtgacagtgctttaggtaaattttgtttattccttatttatcttcttattcaagaggtatttctaatattttaggcaggagctgcattttcaacacaggaataaagtttgtagatatttattgcagcttcctgttgctgctatctctacagtaatcatcatagcttcttccctacgtgtccggccagtggccggacacgtaccccataaatatatacacctactatgtacgcacaaaaattaaaaattgggcagacacagtggttcatgcctgtaatgccagcactttggaaggccaagacaggtgtatcacttgagctcaggagttcgagaccagcctgggatacatggtgaaaccccatctctacc

SEQ ID NO: 179505 - DNA, 346 bp, Homo sapiens
cctggattgtttacacggtgctgctggcatgccagatcattcctcagttctacctggattttttaccctcacttctgcttagagtagcagcaaaagaaagccttgttgaggaaactgaatgtctataaaaagcatcttgggttaaacttcccctctggtcctgacaccactccgcgcagtaagttctctgacttggcaagagcacgtctcaggttgtgtcctactggctcctcgcccctcaaatcctccattggttgttttgcccattttggatttgatcatatgtgtaattctttgaggtagagaaataaaagaggtaaattatacgtaaattgtgaaatgggag

SEQ ID NO: 179506 - DNA, 369 bp, Homo sapiens
gagagggacttaaatagagacagagatacttagtccatctagagatgctagaacttagaagtcaggtggagcagaagcttgggctcggctcctggaactgctggagctggactacggaggggagagtagagggattgtgcagccccttacccttggttcctggctttaatggatgttggctctctataaagcccttgggatctgagagacattcactatctgcttccattgagctttccttctggggttgtgtcattgagagtgggtttctgtttctcacattcaaatatttcctaactctgctatagaactatgagtggtgtagtcatatatgagtagtgtgcgggctcaattgtaaaccccatcaga

SEQ ID NO: 179507 - DNA, 508 bp, Homo sapiens
aggaaaagccccgagggccaacagttaagcactgacttaatgtcacaaaaaggggaaaagaaatccggatagagagagtggacagttagtttaaaggctctaagcctggcatatctgagatgaaagaaggcctctgtgactagagtatggtagggtgagaggaaaacagctgtagaagtagaaaagtcaactagggttagacttacaagtcagataatgaactttggattttattctaagtgctatggaaagccactggaagacattgacaagatctgaattacatttttatattttaagaaaatgaatctagctagtgtggagaatggattgtaaagggtcaagagcggagaagcaggggaaaagcaaagaggctgccacagttgtctgagtgaaagatgatggtggcaaagacgagaggtgtggcagagatggagagaagtgagcagatttgggatacgttttggaggggaggaagtgtcaacagggctcactgatgacagactgg

SEQ ID NO: 179508 - DNA, 179 bp, Homo sapiens
aaaattctacactcgaagcagtttggaaatattctcatcgttagtggggatgttaatttggcagagagtgatttggcatatacccgggccatcatgggcagtggcgaagaagattacactggcaaagatgtactcattctgggaggtggagatggaggcatattgtgtgaaatagtcaa

SEQ ID NO: 179509 - DNA, 511 bp, Homo sapiens
tcacacatccatgctctctctctctctctcactcactctctcaatgtgtgggcatgttccatgcatcactggagactagtgcttctaactgataaaaagtccctactgacagtttaccaaaacccatgaaataacagtgcccaacagacaggaattctccatttggaatataaagtgttgttaagtggaacagttattgtggtggacacactctcaggaggcccccatgacccatcctcctgatggtcacacctttgtggaatcccctgccttaaatatagacagaagctgctccttgctcctaaccaactgaatatggcagtggttccggatgtcactcctgtgaatacattgtgttatccatgatgtctccatctcgctagcaagctcactctagaacactccttgttagctagaggaagaaggtgaccatgttgggaaagcccactgtcagaggtctgggggaggaccctggaacctggggggccctctaggacctgtgggtagccta

SEQ ID NO: 179510 - DNA, 1063 bp, Homo sapiens
gaatagtttgtaaggagacaagagaagaagcagagaaaccagttaggaggttgttttaataatcccattgacttggactaggctacagtgaggaggcggggagaacggattagtttctggatgtacttttgaaggtaaaaccacgagattttgctgatggattgattgtggggatgaggaaaggacaataatcaaggaaaacaagttttgacctgtggagttgccatttgctgtgacaggcatgactgaaggaggagcaggttttgaggggaaaatcaggacatggctgaatatgaaatacctattaggtgtctaagcagagatccaaatgaggtccaagtaaagtggatagttagacatataagtctggagtgtaggaaaaagatctgggttaaagatatagaatttgctatatagaaaaaaggttagaatacttctttttaaaaacagaattgaattgcaaggttaagattttcaaaatctatgtatcaactcccttgattttaccctggtggatacagagatccaactaatttgaaaatcactttacttctctgctatgtaaccaagctctagtcaggagggtttagctcaggtgatctcacagccattatggcatgtttacttaaagattctttaaagttctgctgaagtttatgcttgatcctgtcaatatgagtttgattactctccctatcctctactcccagcctcctttttgtaggaagtaatttttattcagcagataaatgtatagtgtgtggctgggtgcgatggctcacgcttgtgatctcaacactttgggagtccagggcgggtggatcacttgaggtcaggaattcgagaccagcctgggcaacatgctgaaaccctgtctctattgaaaatgcaaaaattagcctggagtggtggtgcacacctataatctcagctattctggaggctgaggtagaaaaatcgcttgaacctgggaagcagaggttgcagcgagcctagatcatgccactgcactcccacctgggtgacagagcaagaccccgtctggaaaaaaaagaaagaagag

SEQ ID NO: 179511 - DNA, 369 bp, Homo sapiens
gataaatagtatattatcattacagtttaatggcctcatatgctttattgaatcattcccttaattggcgattccttcctgtcctccatctctccaccctgccattgtacataacactgcagtgaacatctttgccttccattgtggatgatttttgctgtgatctgaatactgagtctccccaaaattcacattgttgaagcataattttcagtgtgatagtagtgaaaggtgggtcgtttggggaatgtgattaggtcatgagggctccatcgtcatgaatggaatgagtgccctcctaaaagaggctgaagggatgccgtgtgaggatgcagcaagaaggtgccatttttgaagcagagctcaagc

SEQ ID NO: 179512 - DNA, 427 bp, Homo sapiens
accacttacagagattatataaaaggatccaaatatcaaagaagggttagttgagctactcagtgatttctaaaccccggtccttagtgaatttttcattgacccatgcaaaagaaaaaagtgtctgtgtggggatagatataaatccacgagtggggtaattttaacacagctcctctctggataggaagaactctcctttaagtctgacagcatacatattcttccccctttccccaccttttctcttttttggtacatcaaaaggattttgacgaaatgcattgacaataggtagtaactgctgttgtcaattttaaacacacttatgtagcaacattaaatgctgacatatctgacaatccctaatatttgcttttttttttttttttcattttacaggtagacgaaaacaaaaggtatagga

SEQ ID NO: 179513 - DNA, 457 bp, Homo sapiens
attaaggggagggttttcctttacagattggagatggataaagtgcctgccaaggggctgagggtgttgtgagcatttaaaagggctcagctctatgtaagcttcccaggaagataggtgagaggtcctctatctaagagcctcaaatttacaggatggatatgatcaaaagagaatcaagccatgtccaaaccatgggtgcatctgaggacagataggccttgctaattatgtgtgtcttccactaaggtgaaaatttgcttcatttcctaaatacataatagacactatgagggaatgtggttcagaaaatatgcatgagggcttgcgagaagaagaatgaaaagctgttttcaaagctacaaaaggaaagctcagtttctttcttctacatttaaagtaggtggcctaaaactgaaccaataaaagataattgcaaatatatttcttattgaaa

SEQ ID NO: 179514 - DNA, 344 bp, Homo sapiens
gagacaaatggtaggcctgcccgtcacactactagtgtcaatatttatctaaggcctgggtattcacgatggtataaaccaggcaccttttcaattcagttattcacgtaattcgccactacaaagccccaaaacagagattctttacagcttgatttcttttcttccatttccatacacagggggctggctgcaggacccatggtctatgtcagcaataatccctgcagcctgggaataaagcgtacaatgtatttcagaactacctatatcaaatggcattgcaactgaggacaatgaagaggtggggaagggagacagagcacctgctttcttccttccca

SEQ ID NO: 179515 - DNA, 655 bp, Homo sapiens
gagaagaaagaagaaaggtagagctgatgttgaaaggaacctaagtcctcatctattgtaagaaatcactagaaaatgtctcaagctgataaatgaagaaataattttataagcctatgaatcctatcagtaaaaacaagcattacaaaagggaactctggagacctgaacaatggaattgagatttataaaaccttttgtaaaactggttttttaaaatctgtatgtatgtattactttgatagacttcaaaaattattttaaaagaaatatgaaatctagtaaaacaaatatgacattaggaaatttaaaaccgcaagaaaggaaggatatgatcgaaatatactaacggtatagtattttaagtcatgtggtgttagtacagaaatagacaaatagatcaatggtacatgaaggaaggtccagagatacttaggtttatataggagaatagttcattgtccaggtgtcacttccagtcatgaggaaagtatatactcactggtagatggattggcagcaatatgggaggtctgtccctacaggggaaataaagctgtatctgcaaatcaaagtcaactagatggaattaagtatatagtaacaatttttagatcgaatgatctagagttctggtggtcccttcaatgaggtg

SEQ ID NO: 179516 - DNA, 327 bp, Homo sapiens
atttactcagtctctttgaataaaactttgtgaaatacaaatattttacttttctagtttttctccagaatttttgtttcctgtaagtttattggggcactttcaagttctccaatagatgtacaaaaaaaaaaaaaaaacagctttataatcaaagctgtttattgtgtatgccaatattgtccctgatacttcacaagtagattggtctattttaagtgagtagccggaaacaggaaagcattgaggaaaggctgatagagatgtttctactacaattctaacattgtatactttattatgattactattattattattttaaag

SEQ ID NO: 179517 - DNA, 621 bp, Homo sapiens
agttttctccaagttgatctatagatttgatgcagttgttatccatggggagggagtggcaattttgctcccagaggacatctggcaatttgtggagacattttggcatgtctttacaacttgagaagtgctactggcatccagtgagtgaagaccaggtctagtactgaacatcctacaataaacagcacagcggctctccctaacaacaaagaattgtctggccccaaatttcaatagtgccaggttgagaaactgtggtttaatggaatcataatgcaaatctcaagtgttttttagaaactgacaagctcatttagtgttaaatggaaatacaaattatctagaatcgacaaaacaatatttaagaatcaaaacttggaggaattatattctcagagtccagaacattctacaaactataataagtaagaccatgtggaataggtgcacaagtaaacaaggaaacctaagaagcagaatagagtttagaaatacatatacacacacacatttccattataggtgctactatagtggggaaaggatgctctttctaatatatggtgctagagtaattggatactcatatggggggaaaacaaaccttgacatctatct

SEQ ID NO: 179518 - DNA, 501 bp, Homo sapiens
tcccgttccttttccccttctgcagaaagtgtggctgtagaaaatgttgggtagtgacttttggcttttcttctatagctttatgtggtactgatggcagcttttatattgggctgtgtggtttgatctagaagtaaatagattgcgtttatgggtaagagctggctgtggtcaaactggctgggtatatacttggtttctgtttacagagagaagttatatgttgcctcagacaatgagctgatccatggagtgcacaggggttggaactctctactcagccccagggtgctcagggacaagtttagcagggctgcaccagacggacctgcctatgggtcccccaatggcacacacaagcaccagcactgaggcagaatccagtgggaaaataccaagcacctagatgtgtgcctttgtgggcagatgggaaacctccttggccccaagttatctgcatgggtttggagggtggcctaaactcctaatacaggagagtgg

SEQ ID NO: 179519 - DNA, 299 bp, Homo sapiens
aaaagcaaacttgattctatctgtccacctaaaaaaagaaaaatcagaagttccccattatctgcagaaacaaatccacactcctcagcatcaagtacaaagctccttcattgtctgggctccactgatttatcctttcccattgcctgccacttcttcacactgacattgcgctttggtcttaagaaaccatttgcagttccctgaacttgtatgctttttcaaacctgtctttttatctcacccaaaattcctttccccacttttaaagtttgccatttgaacattgtagtaaaatc

SEQ ID NO: 179520 - DNA, 399 bp, Homo sapiens
tgggggggagaagattctccaacatcttcatgccaccaccttcagaaagtcaaactttctgatttataaagagaacatttcttcttgtaaaatagttaaataatagaggcataaagaataaaaatcaattcccctgtatctcagcatccagttacaacccctgttaacttcaatgtgaatatcctttcagactttctcgatgtattaccatagaattttatattaagaagattacacattacagaatgttttacaacctgctttttccattcaataatacagtaaataaacatttcaatgtcagtattaatagacttacatcattcatattgatgcctgcaaaggatgttattttatgacatagttattcaaaaattcattacccattccttcttgagg

SEQ ID NO: 179521 - DNA, 201 bp, Homo sapiens
aacctggcttaacttgaataaaaatgtcagagtcaggaaatgagagtcctatagtgtgatttgctgcaggtcattagtactcattttcaccaaccgataaattcttatgcagaagcatcacagcccggaatttggaagtaagtaggcttcagtcttgctatgtttcattgattctaagatacttttttcccccacatcact

SEQ ID NO: 179522 - DNA, 341 bp, Homo sapiens
gatgggcctgtgatggttaattttatatgtcacttgattgggccacagcatgcccagaatgctggctaaacattatttctgagtgtatccataagggcgttttcacaaaagactaccattgaattggtatactgagtagagcacatggctctccccagtgtgggtgagtattatccaatctgttgcagtgcaggcacggatagaataaaaaggcagaggaaaatggaattttctctctgcctgactgcttgaactgtgacatagatctccagcccttggcactttaggttcttaagtcttcatatccaaactggaatctataccattgccactctaactct

SEQ ID NO: 179523 - DNA, 444 bp, Homo sapiens
tggtagttcccacatttcaactaaaaattttaaaacaaaatgacacacctcccaaattgtttaatctaagctagtaaaaaaacaatacactttgaaatgctattccagggagactgctgggacactggtgtaatcatacattcattacggcactgtaaactgatacaactcttttggaaatcaatgggtaatatgtgtcaaaaaccataaatgtgtttatacctttgacctaaaaacttctaccctgggaatttatcataaggaaataatataaaagaaaaacatgtgcaaagatatttgatgcaacattgtaatattttaaaatattaaaaatgcccaacaataagcgattggctaagtaactaatggcatattcttttaaaaataggaaatacaaaaaatacacaggaacaaggaaaacataacaaatgatacgttaaaaaa

SEQ ID NO: 179524 - DNA, 299 bp, Homo sapiens
  misc_feature (12)..(12): n is a, c, g, or t
gctgagggttanggtggctggggcaatttcttaagataagacaacagtgaggtttgccacatcaattgactcttcctttccaaaagatagatacactcctttctttctttctttctttctttctttctttctttctttctttctttctttccttctttccttctttctttccttctttctttctttctttctttctttctttctttctttctttctttctttctatcttctttctttctttctttctttctttctttctttctttctttctttctttcttcctttcctctatctctgta

SEQ ID NO: 179525 - DNA, 366 bp, Homo sapiens
aagaccaatgcacatttgccttgcaggaagggctttagatctctgtgtcacaaacaatcaagaaatcatttcttgctgtacaaatgtagcagcttattgtagcaccagtgaatgggcacgggagtgaaggatattgctaattgtactgagcctggctgcattgcaagtgtcagatgatttgataggactgacatgcagctaaatggaataggaaaagacactgcagtggactgttggtccattagtttgctcgggcatcttgttttactaaggagccctctaatggtttctcggcaataattactatctctcttcttcatgctattcaacatgacaggcacttgctgaagtcgcagctaatatatt

SEQ ID NO: 179526 - DNA, 1255 bp, Homo sapiens
  misc_feature (397)..(397): n is a, c, g, or t
  misc_feature (421)..(421): n is a, c, g, or t
  misc_feature (425)..(425): n is a, c, g, or t
  misc_feature (431)..(431): n is a, c, g, or t
  misc_feature (451)..(451): n is a, c, g, or t
  misc_feature (466)..(466): n is a, c, g, or t
  misc_feature (519)..(519): n is a, c, g, or t
cgcctggcctgggcttggaggcgccgggccctggatccgccggacgtggatcgccgagatcggtgtcgtaccttgaccatcgacgacgcgttcattgcagccggcgagagactcagactccaggaccccgccgacgaccccgcgcttcccaggaggttcatctgctccttccctgactgcagcgccaattacatgcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtgtagtgcagccaatggctgtgatcaaaaattcaacacaaaatcaaacttgaaganacattttgaacgcaaacatgaaantcancaaaancaatatatatgcagttttgnagactgtaagaaganctttaagaaacatcagcagctgaaaatccatcagtgccagcataccaatgaanctctattcaagtgtacccaggaaggatgtgggaaacactttgcatcacccagcaagctgaaacgacatgccaaggcccacgagggctatgtatgtcaacaaggatgttccttgtggcaaaaaaatggacggaacttctgcaaacatgtgagagaaacccataacagaggaaatacctatgtgacgtatgccggaacacatttaaccgcaagattaccttaagcaaccacatgaaaaactcatgccccaagaaaagggatgtatgtcgctgtccaagagaaggctgtgggaaagaactatacaatgtgtttaaatctccaaaagccatatcctctacttcatgaggaagacgcactttgtgtgtgacactgctggctgttgcatcacattgcaatgacccaaggtctcactaggcattgctgtgtaactgctccctgacaggaagcaagatgaaggctcacagtacaaaaatctcgtggaaaaacaggagttgggccatcatctaaggtgattttcctccagaggaccaggcacgtatttgagcaaacgcagttacaaaggtggagacacaggcacaagtacagattaccagatacggcgctgtaagcgtggaaagggagtcatacagaatataattgtgaaaagcaataatggggccacactagcaacactgtaagctatatcaaccacacaagaatagactacataacatcacgatacacccagatactaccact

SEQ ID NO: 179527 - DNA, 636 bp, Homo sapiens
  misc_feature (251)..(251): n is a, c, g, or t
  misc_feature (256)..(256): n is a, c, g, or t
  misc_feature (273)..(273): n is a, c, g, or t
atgttaagtaacgggaatttatagtacttaaatttatctgcaaaaggaaaacatgataaacactagcatggttttctatcatttaaatcctaaattcacaggatggaacattcaactcctgattttccagaaaatctactcttatgaatcctgaagttatcttgaaaggcaggctttgtatttttccagtgaatatattgctgtttcttatcaatgttgcacttgattttttttttttttttttttttttngaganggagttttgctcttgtngcccaggctggagtgcaatggcgtaatctgggctgaccgcaacctctgcctcccgggttcaagcgattctcctgcctcagcgtcctgagtagctgggatgacaggcatgtgcgaccatgcctggctaattttttgtatttttagcagagacagggtttcaccgtattagccaggacgttctcgatctcctgacctcgtgatccacctgcctcggcctcccaaagtgctgggattacaggcgtgagccactgcacccggcctgaggagtccttttatactggagttaattaagttcctagaagttttcttgattggttggttggtttttggaagcattttgattagttatgtaatcaagaatga

SEQ ID NO: 179528 - DNA, 357 bp, Homo sapiens
ctggtctccaactcctggacttaagcgatcctcctgcctcagcccatgtgcatttcgaataccctagtaatatataatgagatgctatgtttggaaaagtaaataattcccaactctacaaaggctgcattgaagatggagacttttatacactgttggtagggtaacctttctggaaagctgttcatgcatgtattcagtttatcaaagcctgaaaaaaactgttcatactttgactccatttttagaatattgtgttaaggaaacagatttaaacagaaatttttgtataaagaccctgtcacttgggtttatctaatagtctagtggaaagactctaataagagtcagatacta

SEQ ID NO: 179529 - DNA, 691 bp, Homo sapiens
  misc_feature (1)..(2): n is a, c, g, or t
  misc_feature (4)..(4): n is a, c, g, or t
  misc_feature (6)..(6): n is a, c, g, or t
  misc_feature (27)..(27): n is a, c, g, or t
nnananatgcatgtatgtatacatatntgtgtatatatacgtatgtatgtatacatatgtgtgtatatatacgtatgtatgtatacatatgtgtgtatatatacgtatgtatgtatacatatgtgtgtatatatacgtatgtatgtatacatatatgtgtatatatacgtgtgtatgtatacatatatgtgtatatatacgtgtgtatgtatacatatatgtgtatatatacgtgtgtatgtatacatatatgtgtatatatacgtgtgtatgtatacatatatgtgtatatatacgtgtgtatgtatacatatgtgtgtatatatacgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctc

SEQ ID NO: 179530 - DNA, 386 bp, Homo sapiens
tggaactgcctagataaatttggcctctgtacagggcccgggatgcctttctcagcagccccacgtggagaggtaatcctcctcctatatgaacagccaggggtgaagctcccagtggtatttgacagatgctatcagggccctgggcccttccagctggggctcagacttgtttggtaggaatgtggtgaaattacataggaacttacggctcacgcatatttgtctacacctggagcccgtatgaaaaggagtgtacagtcacccgtgccaagacattagctcaaactatgtggctccatggtgggagccaggagaccacatggcagaaatagcactagactcagaagccctgggttctagtccaggtcctatcaaaagacgac

SEQ ID NO: 179531 - DNA, 587 bp, Homo sapiens
gaaaccctaatcccaaatgtgatagtatttagaggtggggctttgggaggcaattaaatcttaagaatggtaccctcattaacaggatggaaccattataagatacatgagagacatgacctctctccctccctgccctgtgaagacacagcaaggaggtggttgtctatagaccaggaaggggactctcaccagaaaaatgaacctgcaagcaccttgatcttggacttctcacttgccagaatggtgagaaatatttgtttaagccacctggtttatgggatttgttacagtagcttaagatgaggaagacaacagttaaccttaaatatgggaccactttaagcaacttataatatactgaaactcagagttctcatggagtgactgctcacgtaacttcaatatctactggaccatatcttcaacatccaattgaccatactggagcccaaaacttggtcaccgaaacactgatctcacactctggccttctctcttctcctcactctttggacgagccacttctcaaccctaacacacaactactgatgtttttttctgcacctgtgcccaaggtttaaaaa

SEQ ID NO: 179532 - DNA, 411 bp, Homo sapiens
cctccccttcaacccccagatacactcaagtctcccttcctgaaatggtctttccccagtctgaatgctccctagccaccactgcatttcttcctctcttcataccaccatgcttctgtgtttgccacttccaatttttcactcccgtttctcatcaagtctttgcgattggccttcttcaccctctcctctaccgaaagtgttcctttaaggccaacagtgacctcccctttcccgtatccagtggcctcccctcatgctactttgactgcagcatcccattctcctgaccaccttctctctgatttggcatgcttgagtcctagatgtcttcttcaccctctcctctaccgaaagtgttcctttaaggccaacagtgacctcccctttcccgtatccagtggcctcccc

SEQ ID NO: 179533 - DNA, 378 bp, Homo sapiens
tctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagatgagtcgtggggacagcttgaaggagccaacctcaattgcagagagcagccgtcacctcagttaccgctcagagcccagcattggtacacagagagcttccgttctcctacctttggcataatgttttcactacgatgca

SEQ ID NO: 179534 - DNA, 226 bp, Homo sapiens
catattcgctcttcacaatttagtccagataaaacccctttttaagcatctttccttgattctacattacataaaagtataaggcatatatttctaattcttcatatttctattagaagagattattatccacatattcagaaattctgtctatatccttaaaaaaaaaagggtattcaactttaactcttttcttttcttttttttttttttgagtctgggtctc

SEQ ID NO: 179535 - DNA, 414 bp, Homo sapiens
gttctgtctccttgctctgtccatttccaaaaggccaatcactaagtcaccaaaaagcctccagagactttgtaaattgtctttccatatggttttcagtgatggccaagttggaagtcatttgcctgcagtagatgccaatctacagtgttaatttgggagctggcagctctacctctgccccactggataatccaataacagaacccaataaaacttctatttgagctgcaaactctagttaggtcaagtggccttaaaaatctctattaagccatatccctggattcaatgaagctctcatattcacactagtttcttttcttttccttgtttttttttttttcttttttttttgacagagtctcgctctgtagcccaggctgaagtgcagtggcgtgatcttggctcact

SEQ ID NO: 179536 - DNA, 776 bp, Homo sapiens
tgctgggagtgcaggggcggccttgggtgtggagaaccctggctgcacagtccctttgacgatagtccaccggccacccaggcctgtctggggacatgtaggatgggctcttaccccagggagggcggcaggctccacttcggcgagaggttcgtccatgcagaggtgggcaagaactggggtctccgacaggtgtggctatttctttgagttctctggcactgtcaaaagcagccaacccaccccccagtccacatggtcaccactgctgctaccagctgctcagtgcagtggccactgtgtctcctaaggtgctcgcttcagtcagcacttcatctcaggcaaccacaggtgacagttaaacatgatgaaaccgcatgctatggctttctagtgtctcatattctgttggcaagaagctcagcactgcattcctgaccgaggtcagaaccagatcaatctcagaatctcacctgtgtaggtctgtttcatgggacttttcttttttgggggagggggcagggtttcactctgtcacccaggctggagtgcagtggtgcaatcactgtttattgcagccgcgacttcttaggctcaggtgatcctcccacctcagcctcccaagcagctgggatgacagacttgcgtcactacacctggctaattttaaaattttttgtaaggacagtgtctcaccatgttgcctaggcgggtctcaaaactcctgggctcaagtgatcctcctgcctcagcctcccaaagcgttgggattatag

SEQ ID NO: 179537 - DNA, 448 bp, Homo sapiens
agcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaa

SEQ ID NO: 179538 - DNA, 467 bp, Homo sapiens
tggtggttcttgtgtggcgtgtggttctttgctggacaaaagcgcctccatcagacaaaacagggcagcaggcccccaggaggcccgtagggttcagcgacgccgtctctagaatgccgtgatggccccaggacccttcctcacgcagaacttgggtttgggtcacttcggcaaagactgtggggtgttgacggcgcgcaccagccccgagtgagtggatgcttcagggatgagaaactagagttcatcccagtctcacctcccaccgcctccacacaggctctcctgcaagggcttctgagctactccctggtaaagaaccaagcaggaggggaggcctccaaggcatctcccttgcctgcccccaggatcaatcagccctgaggaggagctggaggagggcggaggctaaatccgagtgactcatacttgtgactcatcttccacatctgttggagatttagcct

SEQ ID NO: 179539 - DNA, 739 bp, Homo sapiens
tggtggttcttgtgtggcgtgtggttctttgctggacaaaagcgcctccatcagacaaaacagggcagcaggcccccaggaggcccgtagggttcagcgacgccgtctctagaatgccgtgatggccccaggacccttcctcacgcagaacttgggtttgggtcacttcggcaaagactgtggggtgttgacggcgcgcaccagccccgagtgagtggatgcttcagggatgagaaactagagttcatcccagtctcacctcccaccgcctccacacaggctctcctgcaagggcttctgagctactccctggtaaagaaccaagcaggaggggaggcctccaaggcatctcccttgcctgcccccaggatcaatcagccctgaggaggagctggaggagggcggaggctaaatctccaacagatgtggaagatgagtcacaagtatgagtcactcggatttagcccacctgccttgctccctccccgacaagctggccccagctcctgtagtccttctattaggttggtgcaaaaaatgactgcaaaacacaaatacttttagactaacctaaatagaagataatgcatctatttgggcccagaggccccattccagactccacttgcccattcaaacccctgcctcagaccaccaaggggagacaggcctggaggaatggttccattgcaacctcaaattccttgaaccatatatgccataaaaggtccttagtaaa

SEQ ID NO: 179540 - DNA, 478 bp, Homo sapiens
cacacggcctataatacaataacacaatgaaaagacaactatctgggtaacaattaacatgatgaagagaacaatacctcacatctcaatattcatgttgagtgtaaatgctccacttcaaagatacgggatggcaaaatggacaaaaacaacacatccaaatatctgctgtcttttagaggctaacacagaaatactcatataaactccagataaaggggtaggaaaatgtattccatgcagatagaaaccaaaggcagcagggatagctattcttgtatcagaaaaaccaactccaaatacaattagttatacaaaaagacaaagatggtcactatgtaatgataaaacgatcaacaagaagatactacaatcataaatttatatgcaccaaacactggagcttttagattcaaaaaacaattactactagacctaagaaatgagatagacagcaaaacaatggtgtaaacggatg

SEQ ID NO: 179541 - DNA, 705 bp, Homo sapiens
aaacatgcccgggctaacatagtgaaaccccgtctctactaaaaatacaaaaaaatattagctgggcttggttttgggcttaataggaagcttttaaaagttctgaggaagggaatgccatgatttgtagtttttatctagaaagataaatctgggcaagacagggactagaatagagcccaagaggccaactgcgctattgccactagaacagtagcactggagatctccgaaaggtgcaaatactggaaccatccttgagacttgctaatgatttagaagtgaagagatgaaagatggaagggaaaatgttatagaagccaggggaaagaaaagtgcaagattatcaagtgtcaggtacagtaggaaactaataaaatcctgctgcatataataactggaaagaaacacaaagaggatagcagtgtcaaatgaagggtactctaaatgggagacatatgagcatatgtataagccaatatgaaaaaaatcagcagattgaatattattcaagagatgaaggctactctagaaaactgtgacaatgttacagcaatacaaattatcttgccacttcattttttatttaaatatgtgatagtttaagcagtagtgcctaagataatgctctactcagtagacactcatatgtgtgattattggatgaacaacaactctgagcttggaaagcctggttgaagctgc

SEQ ID NO: 179542 - DNA, 450 bp, Homo sapiens
tgtgtatatatacaggcacaagcattcacttaaaaaataatggggaacacgtgttattttatgacctgatggtttcatacattgtgggtacatttctttattaataaacacgcaccttgcttaacttcaatcagtctctcctgtctgcaactcaaatggccacagaagacaggatttacacacagctctgcccagagagaccctgaaagatgcagacacaacatagtggcacatgggacaggaggcggtggaaccagatgggattcattggagccagatgggattcgaggaccacccatttcagggaggaaagtaatactgggacttaactgttaccaaacaagaaagaaggaggaaatgtatatttcactttttccactccgaagcttcctcgcatagctttatccctccaccctgaacttagttttataaatagttatttcttttgag

SEQ ID NO: 179543 - DNA, 409 bp, Homo sapiens
tgcagcccctcttcccgggatgctgtaggagaggctgaaagccagccaccggcccacccacctacctgccgcagcgcctccatctcctcattggccgccttcttctcagatgtgctgctcttgagcttggactcggccagctccacttcggtctgcagcttgtccagctcagagatgacctggtcacgctcactcatgatgagcttgtactcgctgtacacagcgtcccgctcctccctgtatttctccgactcctttgctgtcttcacctgcgtggttctcagctcggtcagctctgactgcagcagctccatctcccactgcaggtccttgttctgcgccgtggccttgttcagctcatggtggatcgcctcaaacctggcaagagaggtggcgagatgtgggaagg

SEQ ID NO: 179544 - DNA, 461 bp, Homo sapiens
ataacagcagataatatttatctgatactatgtgccagatattatcgaacacactttacatttattaattaatttaatcatcacaaaatccaatcaatcagtcagacacaaagtagttaaatagcttccccaaagttggccaacaagtaagaaacaaggatgggattttagcacagtctgtacccagagcctatattcttagttactatgtaatatagcatcacatgtatcaataaatggttacacacataaattaatgaattttatagtttcagtttcttctggtcctaagctgcttttacccttttccttttttttttgagacagggtttcactctgttgcccagattggagtgcccaggcatggtcacagcttactgcagcctctgcccccaggctcaagtgatacacctcagcctccaaagtagctggcacagtaggccactactggctaatttctc

SEQ ID NO: 179545 - DNA, 341 bp, Homo sapiens
gaaacatgtgatctgttagtgggtctgagaaaatcatatttattaagcaaaaaagtcaatatgtgcttgtgttttgcttatgaatttactcgaataaaatgtctgaaggtcttgaaacttcttaaaagaaaatggttcttacttcattttggtgtgtttacattaaggggagccatgtgacctcttatgagagttactgtcaaatttcaagtgcatgggcattgcctggaggacttgttcaaacacagattgctggaaagcccaagaatttgcatttgtaacaagtttacaggtgatcatgatgccgctttccctgggtgactcactttgagaaccactgt

SEQ ID NO: 179546 - DNA, 725 bp, Homo sapiens
atccaccatgactggtgccgttataagaggatattaggggcctggcaccatggctcacacctagaatcccagcactttgggatgccgaggcaggaagaccacttgagtccaggagtttaagaccagcatgggcatcatggcaagacccctcatctcaattaagaaactgtatatatagagagaggatattaagatagaaacaaacacagagggaagacaacgtgaagacgtagggagaagacggctatctacaagccaagaacagagaaaatggaagaaaccaatccagctgacaccttgatcttggactcagcctccagaatcatgagaaaataaacttctgttgtttaagccacccagcctgtggtactttggttatggcagtcctagcaaactgatacacctatttgtatatttaatatacaactcaatggtttaatctgttcaagttgtataaccactgccacaatttatattttgaacatgttatcacctcagaaagaaaccccatacccactggaagccattctctatatcctcccaaccctcattcctcccccagccctgggcaaccactaatctgtgttctgtctgtggtgttgcttatattgtggatgcttattttaaatggaatcatgtaatacgggttttgatttttttgtgattggcttcttagcatacttagcataaggttttcagggttcatccatgttgtagcatatgcc

SEQ ID NO: 179547 - DNA, 493 bp, Homo sapiens
gaggccgaggcgggcggatcatgaggtcaggagtacactaacatggtgaaaccccatctatactaaaaatatgaaaattagctgggcgtggtggcgtgcgtctgtaatcccagctactagggaggctgaggcaggaaaattgcttgaacctgggaggcagaggttgcagtgagccaagatcacgccactgcactccagcctgggcaacagagccagactctgtctcaacaagtttttttcagataattttcccaactggttttaactaagtttaaaaaaacagagcttcagaatacagttcattgcaatttcatcaaagcagcctcctctacatgacctacctttccttcacaggtaggtctatcatagaatacatttacataccttatatttaataaaaagttattatttttgaggctaagtgttaattcatcttcttaaccactccctgaaaagttgccttcttcctgttttactcctttgcatattccaa

SEQ ID NO: 179548 - DNA, 678 bp, Homo sapiens
tctgtacatgcttcttctctccaagaaatgcttttttgtttgtttgtttgtttttgagacagagtctgtcgcccaggctggagtgcagtggcgtgatctccactcactgcaagctctgcctcccgggttcacgccattctcctgcctcagcctcccgagtagctgggactacaggcgcccaccaccacgtccggctagttttttgtatttttagtagagatggggtttcaccatgttagccaggatggtctcgatctcttgatctcgtgatccacccatctcagcctccaaaagtgctgggattacaggcgtgagccaccacacctggccaaaatgctttttaataacgacactgtgcggggtcctaggccagatgggttgggcgtgcggagattaaaatgaaatcattttcttgtgttcaaggaactcttggtccaagcccacatttacctactagatgaccatgtgctgagctcctcctatgagtcaggtactggtccaggcacagcacagataagaaaatgtagttacatccccattttacagatgaagaaactaaggcttggaggttacagcttgttggataggagccagctctagaatcctggctttccctttacagtttttactcttgaacaggtcctggggaggggacagggtacaggtgtgtgtgtgtgt

SEQ ID NO: 179549 - DNA, 445 bp, Homo sapiens
cccaggaccttactctgtggggtggaggtgaggtcccagatcccgattctgtgggatggaggcgaggttccaggatggagatgtccacactgagtagtacaggacagcaagattggcaaggctaagtggggagtggggaatgagaaaggaggcttgagtctgggcttaggggccaggtcaagagggccttgtgagcccttctctgaagccaaattctttccctgaagtggtgaattgaaaggatttaaacacaagaaggtggtgtcaaggttaagatgaagaaggatattagttataatttggaggaggtagggatgacgatcgtaaacagaaaggtggtgatgtttctgcatgaaaaaaatgaacttgaactaaggcttttgtagtgagaatggagtggagaggatgacataaatttataggattggatggccaactggatgag

SEQ ID NO: 179550 - DNA, 361 bp, Homo sapiens
gttccgtacaagagtcttgtaaagagattctaccattggacagctcaggtttttctgtggagcccagatctcttagccttgtttgttatttcttttttatataacggcccaaataaatgggctactttgtccacatgatagccctttagatatttggcaagattaccttcaggttaaatattcctaacttttgtatccattcctcatcacattgtttgtgaagtatttagaatagtccctgaaacatagtgaatactatatgtgtgttaaataagtaaatgaaaatcttcatcatcatcgtttagtagaacttgtttgttaattcttcccttagaagatggtgcccagaactaaccttatt

SEQ ID NO: 179551 - DNA, 572 bp, Homo sapiens
ttgaagaccatggttccagatttaaatcagcttcaagctgtggaaaatgcaacaggaatcagagagagaagaacacacgtaggcatctgtgttcttcaaattaagtacttagcaatagaatgtatttttatatattttgatggtgaaaaaatattcctgccatttgtttgaatatcttataaatacagagtttagtccttcattttctcaattggtatataccctagagtccatatatttcctggtagataccattcacctaatttagagagtacagactgatagatataacataaattattgtgcttgtcagttgtggattggcaatgaccatatagacttagcaaggaaggtgtttctttatacagatgctccttgacttgcaatggggttatgtcctgttaaacccattgtaagttgaaaatatcaagttgaaaattcatttaatacacctaacttacaaaacatcatagcttagcctagcctccttaaacattttcagataacttacgttagcctacagttgggcaaaattatctaacagaaagtctattttataaaaaaaaaaagtg

SEQ ID NO: 179552 - DNA, 696 bp, Homo sapiens
agccccagctcagagcacagttgacgcgaccactgcccagtgctgcctgggaatgagggcaggggagccgccactttctcctgcgatgccctctcctcccggctcccggtgcctcctcaccctcagtaggttttgtttgcttttgagaaatgaggtggaagtggggattaggaaggaagaaatgcaagaagggcaggcaagccccctctcctatcatgcaggatcctctttcttctgtagccggcggttcccccacagtgggaggatgggtggtcccaagaatgaggccaattgcctgagcccatctgcacccaagagttcccagccactcacatgcccaggacgagcttgggcccagcctgaccaggaaggctgccttcgatttgctccctgactgcacctggatgccaggaagccccctgcaggccgaacacgcaggaggtaacccagcagtgcagtggggcacacggagtctgatccctgttcctcccctagactgtaggtctcacccgtcccctacattggcccgcttttgctgtaataattagcaaatgggttgcaacggggacctggaggcaacggcagcccactgaacttgcatcatgtccacacgccacttcctgtacaagcggccaagagcatcatgtatcatgctgtcttcagtgagatgggggagctgccaagaggtcagttacc

SEQ ID NO: 179553 - DNA, 268 bp, Homo sapiens
acatatctgttaaaggtcttatatttagaatatataaagaactccaatactcaatagaaggaaaacaatcaacccaacttttaaaaatgggcaaaagacctgaacagttcttcacagatgtacaggtggcaaattagcatgtgataaaatgctcaatatcattaggcattatggaaatgccaattaaaaccacggtaagataatacattgtctgttagaatgattaaaaaagactaatcatactaatgatggaggagtaggaactctc

SEQ ID NO: 179554 - DNA, 298 bp, Homo sapiens
tttgctttgctgcttttacatattaaactgccatgaatacgcagatactttttgatgctgatagaataagggtgaaacataaaaggacacagacaaatctgttttaaaaattaccaagtatcaaagggataagagctggagtgaagtacagagatttttaaatatattttctttttctgccactcttccacttcaaaacttgcagtgatgacacattgtccgtagcatcaaacccaaactcttcagtcccaatgtcaaggcatccttcacctggtcctgtcattcaccaagtacctcc

SEQ ID NO: 179555 - DNA, 214 bp, Homo sapiens
tcaaaccttagcaagcactataacatactgagggaccataaataggagacgaacatatagagataggaagctatgtttttttgagacaaagttgataaaacagaggggaggcaggaagaaaggaaggcaggtgggcaggactgggtcaggcagctggatacagtagtgtgtcaggcagatactgagaagatacctctgcactaacagcctccca

SEQ ID NO: 179556 - DNA, 425 bp, Homo sapiens
cctggtacataggaagggcttgaaaaacatccgccattgtcattatcacataacttgcataccctttgttatgaatcctgcatcctggagcttcacataagcttgatctcctgataaagccaaggatttggagtcaacccatgtaaaggggctggtgcaaggcctggcagagtcagggtccggacccagcagcaccctttgcccccgctactcgcagagggccccaatccctgaaggtggtgagtgccatccttcctccacaaacctcctatttctcataactctgcaccccaatgacccacaagtttgtcaacatctcttccaatgtgtactcctcaatttctcccaaattttcagttgtcgtaacgctacttttagaactttaaaatattcttccaaaacaactttagtttctaatttaacca

SEQ ID NO: 179557 - DNA, 295 bp, Homo sapiens
  misc_feature (35)..(35): n is a, c, g, or t
  misc_feature (71)..(71): n is a, c, g, or t
gtatttttagtagggacgaggtttcaccatgttanccatgatggtctcgatctcctgacctcgtgatccanccgcataccattaggcagcaattccacctcaggctattagtctttcctgtccaccttcccaaactaaccatgatcccattttgatcacttgaattctttcctctatatcatgatttcttcacgtaggtattatgagagtcatctggctagatgtggagatgtatatttctgggcttaaactactccccttttaaaaatctttataacatttcaacaatatacat

SEQ ID NO: 179558 - DNA, 369 bp, Homo sapiens
gccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgcca

SEQ ID NO: 179559 - DNA, 301 bp, Homo sapiens
ggttgttgtctctttcaaaactccacctacccatcccacaggaacttcaataggtccaaaaccaaaccaaatatacttccttccacatgcctctcaaactcagaatttctatgccccctacctaggttaatgaacaaaaatacataatggaaagagtacaggcattccctggaatttctgctctggtatttaattatgtatgtggccttacgcaagcttcttaatatctctgagcattaaggttcctcatcagcataacagacaaaatacctatcttaataaagggttggaggccagatgc

SEQ ID NO: 179560 - DNA, 469 bp, Homo sapiens
ctgttctgtgacttattaaaatcctatatatccttcaagggcaagttcatatgctacctcttccatgaagaatctcttcttcttcatctgaaatgccccaaatatctcgtttgtatctatgtgtggtaattttcaccttttgctttatattcttttttttttaataaacagagatggggtcttgctatgttgcccagactggtctcaaacttctggcctcaagtgatcttcctgccttggcctcccaaagtgctgagattacaggtgtgagccaccatgcctggctccaattatgctctttttcaatgaaatttttcaagatttttcaatgtacgattaaattattttttactatagtcactctgttgtgctagcaaatactaggtcttattcattctttgtaactattttttatacctattaaccatccccacttcccccataactactcctcgctactacttttacc

SEQ ID NO: 179561 - DNA, 3597 bp, Homo sapiens
  misc_feature (3113)..(3113): n is a, c, g, or t
  misc_feature (3154)..(3154): n is a, c, g, or t
  misc_feature (3333)..(3333): n is a, c, g, or t
  misc_feature (3381)..(3381): n is a, c, g, or t
  misc_feature (3432)..(3432): n is a, c, g, or t
  misc_feature (3444)..(3444): n is a, c, g, or t
  misc_feature (3477)..(3477): n is a, c, g, or t
  misc_feature (3492)..(3492): n is a, c, g, or t
  misc_feature (3510)..(3510): n is a, c, g, or t
  misc_feature (3519)..(3519): n is a, c, g, or t
agttggtactttcaaaataagtgacatccaaatagtaacttaatattccaaatatggctgcaaaacaaattgtcgattatggatgactactactgccatctctccataccagtccatcttctgccaggctgtttggtcttgatttgtcgaccttttaggtttctccccatgtattccacatgaccttcaccaaccccacttctatctccaaacgtctttctgagttgtggggatgcagatgtattctgccaccatcacaagggctaaccgagccctggctgcggatcttcattgttgttcacattatttccattcttacaccctacttcatgtttgtacactattttcttacatttgctgtctcttctaaacattctttgctgcatccactttttctctatttgtgctctaggtgctgcagaggctaatgctgggtttcctttcattcctccttgcactcagcacctcccttctcaattccttttgccatgtctccactttaaatcttaacctactccagatagtcttttccttcacactattggcatctgtgcttgggttgctttcagtctattctctgatctatgatttctttgcatgatcaagaaggtgccatgaaaggatcccttaagaaagcctgtcatttagccagaacgaactagcttcatgatagcaccaggaagactgatatctcccaggaaacaaaccactcatggtggtgctctttttgccttcactatgaagtgtttgtctgcctgtatgtgaaaacgagagggtttaattgtaaggatgcagcacagattgggactggcatcagaaagccattggggactgaggtagctctagagaccgctttctgtctccagtgctctccctcctgggtgacatgttttctgtctcctggcatctctgcttctctctatgggcttctttattatttgcagcttgcaatggtaccccaaagtcctagctcatggctcctctctgcatatatgctttctgttcctacccacaaagctctttctattcttctagtttaaattttcaagagaagaaatctgatttttttttaacctggtcatgtcaaagaccactgaccacatatgagctggttgccctgtgtcaagtgcccccttctcccaccctcttcccctccccatctggtctgtcataactgaatgatggagtgggaaattgaaattgccatgggaattccatgataagctatctaaacagttttatctataagtggtagacagagtcacttagaagggagtcccaggtgagacaggcacctgtcaactccaaactggcacacattctaaggtctgcaacaccccagagagagcactgattttgtagtggcctgtactggggcggtaggctggagaatgggagaaatagccacttcagaatcccccagcccaaatgcatcaagctcactatagactctgcagccacgattcagctggcttctgctcagatcaacagaaaacattcttagtgaatgatgcttgtggcacatatctcaaggctaccagggtcatttcttcccatttactttttctctgatctatcctctccaggacactagcgtcagaagataatcttccgtcgttttcaggtacactatttgggtactgagtcactttcaaagcctctttctgggtttggatttccagagcagcctgtgctgtaaagcaagacagaaagcttccctgccattcatgcctgccagggatagaatgacagtactcctgaggctctccctccccacccctcccctgctggacagctgatctgctggactcagccagagccagcaggcaccccctctttatcctaggagctgcaaacttgatgcctttccaggaaatccccagaagctggagtatcctcatctacatgtggcacagtgtatggttgtgtcaggtgctcatgtcccattgcataggactggggtggaaaatagggaccgtccttttgtgtcagctccagtcaatgagtagtggccatccagggggccatcttggaaaggacttgtgaggctgtatctgcgctcagttgtagatgtgagaagaaaaggccaaatatctgccaatcctagtcctgggattcaagatagaaagaactgcatggagtgaagaaactaggagtctccatttcactgagatgcataagaatgaaattattgtcactatttcttcaatactgggccaatcctaataagaaaaccctttttgagtctctcttttctttatcctacatataacacagaagctttttctattccctggatgaacccacagggacagaaattcttgttggacaggtgaagcagataatttctttatcagactagaatcttccagaagcactgctaacctagtgagttttgtactctagacaggtggttctcaagccagctccccaccgcaggcctttttcatggtctgcccctccctgtggaacccatgttttaggttattagctgataattggatttctattttttctcataaaatacagcaaaagatagctagtgatattatgatgagttaatgtaattatagccaaagcagagagaaacaacattttaattaacctgtgtggactgctggaagaatataaactttctattttgggggttgagtagagacagaaatgaacacagccaagggctgactgtcagaggacatttaactgatgtaaaatgctttgaaattattgggcactcattgtttaaagttgtttttgatgatggtaactccgtaaggggatcagaacatgctggaaagaatgggcacagctttggttacctgggccttaccactgttattcaggcctctgagaaagcttactattgttgttatgtttcttacataataaaacttctaatatttgtatgaaaacatagaattccacttttaaagatgtaaggattttgtcataccattagggttactatgatcacttgattctaggtctaagaaatattaagtaatttacccgcgaacacagagttttaagggtaagtatcaaaaccttgatcttctaataccacatattctcactcatatgtgggagctaaaaatattgagctcaaaaaggtngagagtagaattgtagttattagaggatgcgaaggaggatngggagaggttggttaatggatacaatgtgaagttatgtaagaggagtaagttctagtgttttgtagcactgtagggtgaatatggttaacagtaatttagtgtatatttaaaaaaaaatagacaggattctgaatattcacaaagaaatgataaatattcagctgggcgtggttgctcncgcctatattcccagcattttgggaggccgaggtggatggatcacctnaggtcaggagtttgagatcagcctggacaacatggtgaaaccccgtctctnctataaatacanaaaattagctgggcatggtggcgcacacctgtngtcctagctacttangaggctgaggcaggagantcgcttgancctgggaggcagaggttgcagtgagccgagatcacgccactgcactccagcctgggtgacagagtgacactctgtctc

SEQ ID NO: 179562 - DNA, 640 bp, Homo sapiens
tgtaaactaaacaaccctggctgcaagaagctcacagcctggtagaaagacggcactcttcaccctttagaggtgtctttgtaatagagtggcgcaggcactggggcttgggcccccaggaccaggacggcaagtcagctgaagcaaggatgattgcggtggaagagccctgtgagggagagccaggagtttggctttagacgtgtgcattaggcatgcaggggagacgtcaagttatcaagtaggcagctgcgtatgtgagtctaaagtttgagaaggagggacctggagctgcgcattcgggaggtgcaggtacagggacagtagttaaagccagagacccaatgagatccccaacagaggataggtagggatgagaaccaagaactgagctgcatgtctcccccccattagctgaccttcctccttttacagaaaggaacacacaagtgcagagaggaccagtgttttgccccaagtcacagcacagctgctgcaatgcggagggaaaattccagtgtaagatcagcaggctccagagcccacactcttcccattgcttctgttttgtttgtttgtttgcttgttttttgagacaagagtcctgttttgtcgcccaagctggagtgcagtggcgtga

SEQ ID NO: 179563 - DNA, 644 bp, Homo sapiens
tcaggctcccgagtagctgggaccacaggcgcccccaccatgtccggctaatttttttgtatttttagtagagagggggtttcaccgtgttagccaggatggtctcgatcccctgatctcgtgatctgcccgcctcgacctcccaaggtgctgagattacaggcgtgagccaccgtgcctggccgatgtcacccacgtttcttaggaaagacgttagcatcctctaaatcctcaccgactgtgcctggcgcagcattattttgcagttttctgggatttacagttggcatcatttgcacagcggcagcgtgatgtggctgtggagagcacggaagctctgtccccacggaagtgggctcttctggttgcaacatggtggaggccagcccggccgcaggtgagggaagatgccacagcaaacctctgagcaaccaagatgacaagcacctgcttggaaaaggtgacaagccacaaggccataggcccagttataaggatgaattgtgttacacgaatggttataaacctgaccgacctcagaaggtatatggaggaggcaattatcaagccccttgatggtctgtggctggatgcaccatactttgccaacggtgtgagcatggcagagaatgtaggtgtgtata

SEQ ID NO: 179564 - DNA, 582 bp, Homo sapiens
aattttagttcgatatttgtgggagagatgggaatcttcagagtggtggtagccaacttctgcctccatggttcaattaaaagcaagtcccctagttaatagaagtaaggggtctctaggcttgcaagtttcttcagatgctaaaattatgcctttgtgtaaaatcagactttctgttatatgagtagacgtaggaattctctgtatactttaaaggagaagcaaatagaaataaagagagagggtgataaaatctagattcatagaattgtggaaaccttacttcattttaagagtgaagaacccagtctgattaaaggaagttccgtgtttaaggcaacatgttgcttgtggcagatctagactcaaaactgagattcctgcctctgtccagtgcttttttcacttcattacattacgagccatcttaactccattcatgcaattctggggtaaggggttttgtcagaattccacctgaccttccctagagcagggtttggacaggatgagagaccccaatctctcagatttgaggcttcttttcaagatatctgtttttcccttttccttaaaaaaaaa

SEQ ID NO: 179565 - DNA, 304 bp, Homo sapiens
cactggctcatacttgacctggcagtgctgtccaggtgtcctggcacctgtgggacattggtctggggacaaagtacatccccacagcagctggtaagagaagggtgctgcctacgttatgtaggcaaatggatttccaactaaatttcacaaagcaatgatggtgtcttgacaaaaaatgagcgctgggcagggtggcttacacttgtaatcccagcactttgagaggttgaagtaggaggaccgcttgaagccaggagttcaagactagcccaggcaacataatgagactcccatctctacg

SEQ ID NO: 179566 - DNA, 329 bp, Homo sapiens
tgatatgattctgctcattgaggagaacagtgttcattcactcatttgttgaccaaaatgcttaatgaaggtggactgtaaaccaaacactggttcttcaatggtgagcacaagagagacagcctctgccctcagggtgggtgcttgcagtgtagtgcaggaaacaaatgtgacattgatataagccatctatcttgttcagacctccccattttactcataatcacttttgtatatatgtgttttcagttctgtgcagacttaatcacatgtaaagtcatactattttcaccaccacagtcaagatacagacagttccatcaccacaa

SEQ ID NO: 179567 - DNA, 202 bp, Homo sapiens
ctaaaagaatgcatcccaccaggagagcccaggaaagcatggattgatttatccagcatttactgagcacctttgatgtacctgcgagctttaatgctcaaacacactggtcagggcctggaaggagcacagagtcggtggttcacacaacttggggcacatgagcacatttttgagacagaaaaaggaacagcatggaccc

SEQ ID NO: 179568 - DNA, 171 bp, Homo sapiens
gatagagagaatttggaaaacgagcagggttccaaagtactgagcaattttcaggaggagtataaaagcctaggggataattcctatgcatctgcatagggaatttatttgatagctatattttcaggacctgttgacattttattcatccttaaaggcctctttcagttg

SEQ ID NO: 179569 - DNA, 603 bp, Homo sapiens
aatgttctgtttctgactgattatgaagcaacaaagataccattaaaattcctagctcacattggcccttcatcttccatttttcaaggcataaaattgtccatatattagattggccaaaatcctccacaaatacaaatataccctacaaatgtacaagagagatccttttcagttctcttattcatagaggcataagcaaggaaaaatagagagatcagagtctcataatagcagagaagtcttgatctgtgatactgggacaaagcgtccactttaaggttgtcatttgcttgtggggagaagcatctctagttagctttactttaagatctctgatgggtgtacagttccaagagtctcaagggacccttctgagttgtgatattatgaacccaaggcccaaggtcccaacgtttttctgctgtgtggatggcaaagacagtctttctctgatgttgttctcaaaagatacaatctctaagttctagattatgaagggtttgattattctcagtcaatagaacatgagaagctttctttacctggtaaaaatataccttggcataatgtattaaagcattgcagcatttagctctatca

SEQ ID NO: 179570 - DNA, 346 bp, Homo sapiens
caggttctgcaaaaacgaaacagctctattccaagttaaaaagtatgcccctattccaagttaaaagaaaaaaaagttgtattccttgttcatttattgagtaaggaattgagagatgggtgctgagttattacagattctaactgctcgccacacatggagctagaaatacatttaacagcctttcaggaaaacgcctaaagctttagaatttcaagctagccaggttgcaatctagagctctagtttgttgctgaagtttgggagaggatggcctctacctgtgcacacatcgagttaattttccagagtcttttgaagttaatagggagcggcttttctgttt

SEQ ID NO: 179571 - DNA, 1271 bp, Homo sapiens
agaaacatagaactgagtgtaaaggaaaatacgacatcaaaatatgtggaatgtggctaaagcagtcctgagacggaaatctgttgcactaaaaactgaaagaaagatggtttcaagtcataacctaaggtctaaactcaagaaactagataggaaaaaaaggcagaataaatgcaaagtaagaagaaggaaaaacataaaaataagagatcagtgcaattgaaaacaaaaacgatagagaaaattaatgatacagaaatctggttcttacccaaaaattcagcaaaattaataaacctctagtgagactaataaagaaaaagaagacacagttgcatatcaggaataaaaagaattattgatacagattgccaaaatcaaaaacgcaaatactatgaataaatctccatatgtaagtttgacaacttggatgcttgtcgcccaggctggacagtgcagtgatgccaactcagctcactgcaacctccacctcctgggttcaagtgattctcatgcctcagcctcccgagtagctgggattccaggtgtgccacaccacgcctgatgaatttttgtatttttttgtagagacggggtttcaccctgttggccagtctggtctcaaactcctggcctcaagtggtctggccttctttggcctcccaaaatgctgggattacaggtttgagccactgttcctggcctgaagtgaaccctgtttctaaaaaacacaaactactacaactcacacaatatcaaacagataattttaatggccctataattattaaggagatgaatttgtaatttaaaatctctgaactaatctccaggcccagtttcactggagaattcttaccagaattaacaccagttgtacacagactcttccagaaaatagaagaggaaggaacatttcactcattttatgtggttattaacctgctaccaaaaccagataaagacagtattaacaaaaaagataggctgggcacggtggcttatgcctgtaatctcagcactttgggaggccaaggcgggtgggtcacctgaggtcaggagttggagaccagcctggccaacatggtgaaacaccatctctactaaaaatacaaaaattagccaagcctggtggcgggcgcctgtaatctcagcctactcgggaggctgaggcaggagaattgctgtaacctgggaggcagaggttgcagtgagctgagatcgtgccattgcactccagcccaggccgacaacagcgagactctgtctca

SEQ ID NO: 179572 - DNA, 436 bp, Homo sapiens
aattgtttttcactttttgtgaatctcaaggaaaaacatttttgtgctgtgaatatatttttcaacatttcaacctatagtgctcaactgtgacttttacatgcacaattcaatgctttaaaaactgaagtcttatgcctacatgcctactctcaggtgagatgttctaatgtgcacatctgagacagataattaagatagttggattatccattagaactttagtttgttagatgcatgtggttattgactaaagctataacttcataatgaaaaatatcagccatgttttcagcacagatggttgtggaaattgatattttaacatggtaataagttcaataccctgcatgttgcagatttctacatttttccctcaaagtgtatgcttatatccaatggaggagttctttaaacatgaataattttaaattga

SEQ ID NO: 179573 - DNA, 111 bp, Homo sapiens
ccatttctccaattttaggttttctcattggagcaaaatgaatatatagttcatcctatatgggtgtttatttccagctctagatttgtaaggaaagagagactagctaca

SEQ ID NO: 179574 - DNA, 181 bp, Homo sapiens
tttatataacaataacacaaatcccccagtcactatttcatctgaccctcagtagtccaatcagtttatatttagactagaaggtccccaagggtgagggctgtttttcactgttacatccttaacccttagcaccaatgactggcaaacaaatagccccggaagtatttactgagttcat

SEQ ID NO: 179575 - DNA, 116 bp, Homo sapiens
cctaatcgctaaccctactcgctaataaagaaaaaaaaagaaaattaagcctcagagaagttaggagactttctcaaggtctcaaggatctagaactagaaataccatttgaccca

SEQ ID NO: 179576 - DNA, 329 bp, Homo sapiens
ctcctacattccttctacattatcccccaatgttctgttcttcctccacccaaagataaaaccaaaatagatattgtagaagtaaatgacctaaaacaaactttagcaattgaaacaggatatcaagatgcaaatgcctggatggaatggattaaatattccgtccacactttaaacaaaagcaattgttatgcttgtgcgcacagcaggccagaggcccagattgtcccctttccactcagatggtcctcccgtcgaccaagcatgggctgtatggtagctctcttccaggattctacagcttggggcaatatatcatgccaagctct

SEQ ID NO: 179577 - DNA, 501 bp, Homo sapiens
aaaccatccatgtgctttagaaagattactccagcacacttaagcatgatgaagaaagaaagacaggaaggtaaaaagatttacccagagaccagatttcttttcctataaaggacatgtataccaacgaggtgcccttgcttcaccactcacatttgtcccggtttttaaagacaatcatatacacagataaaggaatgctgaaatggacactcacatgttgacaaacgtcaactgttaaaatagctgggcaatatgcatgaaaaatcttgttgattcttgtcttaggaatgaatatgatctctgtcatatgttgtgattctatcttaggaatttatttctggaaaataaaccaaccatttttcagttaaaaaaaagtatacaactattatcaaaaatcattgtttatgacagccaacatattgttaatactataaatgcaatattcttgaatttattacaagcaaaatgtgttttttattttaacttttaggttcaggg

SEQ ID NO: 179578 - DNA, 160 bp, Homo sapiens
attgccaagctgctttcctcccggctgggtcaatgtcagccccaccagtggtgtataacaggaccctctgaatgtatattcccaccaacccttcttactgtcaatctggaatggggactgggaaatagaaaaataaatactgattttaatcattattgga

SEQ ID NO: 179579 - DNA, 156 bp, Homo sapiens
actaaatactacacactgaagggacggttagagtttctagacaatagacaaatataggcccagaaactcatctccagcactattttatacttaaaagtgtctccagtaaaaacacaactaaatcataacatagcttaatgcttagagtagtacttg

SEQ ID NO: 179580 - DNA, 155 bp, Homo sapiens
aaggttattactgttagcttggaagcaaaaatacaaatcaatatcttacttctatcccaacaatttccttacttaaactgcaggcttactaggttttctgtccacagagttcatgctgcagggccatgtttatatatatattttttgtaaccatg

SEQ ID NO: 179581 - DNA, 268 bp, Homo sapiens
caggtctccggggagctttgagagaatatggaatatctatttagaaatataagaatctttccagactctctggagtcttccaccagatgatgcataaagaacatccctagtaaataggaacccaagaaaatagctgaaggccaatactgatctgtgactcctgcattaggagatggacttccagagtagaaagtgctccagatctcttttccttagtagctcgccattgccatcatatctccaaccctccttcctccccaaccaccgc

SEQ ID NO: 179582 - DNA, 520 bp, Homo sapiens
gggcgtgatagccatagcgaggttggtaaacacctttctgagaagctcccaaggcacatgtgttatcggagggaacatatggaacccaccatggacgcaaacggggtgcctgggactacttggatatacagttttgttaattttccagtcttgttgaaggattcaccttcattctgattaactttcttaaatgtttacgttctaatacaaacattttgtcattgtcctatgaaaacaaccatgttaaaatatgaagactactagcgctaccattatgtagtaaataccgagcatttactacatgccaggcactgggcagagctttatatttatatttactcattctcacaacaacctacctggctacatattatccctctcttacaatccaggcttacagatgacgggcagttatgataagcaagcaggagaaatgagatttaaagccagttcttttttcaaagcctgtgccctgcccatggaagggataactcaggaacctacagaaaaacatatttga

SEQ ID NO: 179583 - DNA, 366 bp, Homo sapiens
acattttaacattttgccctatttgtttcagatctccagatttttgttttttaataaataaaacatagatattggtggggaccgttgtacaaccaattaagagcaatttggcgatatcttacataaagatacgcatgctctatcacctagcagttcctttcattaaaattttttctagtatttattgcacaaagatggcatggtctgtctctctctctctctggctttttctgaaaatctgtagaaaagttgaaaaactaaaataataccctttacttttcacctatagttaccaattaatattttacatttgctttatttttcatatgcaaattgttatttttgctgaactgtgtgaaagttgca

SEQ ID NO: 179584 - DNA, 998 bp, Homo sapiens
tccccggatcgagataagcacggtggatgtgctcaacagaagaacgggaggacagaagaaagaatccgtgaactgaaacacagaatagaaatgacctgattggaaccacagggaaaatagactgaaactgaaccagagagaaaatagactgcaggaggggaaaaaaaacagtttcagggacctgtgggactacaagaaagatgtaatatgtcactggcatctcaaaaggtgagaagagcacatgagacgggctgtatggtggtggccgtctggaaaatatcatcagctacatccatgttaatgtatggagctatagttttctgttccactataatatagtattctattgtgtgactgaaccacaattcatttattcactctactgtaatgggtacttgggctattttgtttttgatctaataaacagtgctctgtgactattccatccatatctccaggagtagaactgctgggtctcagggtgtgtgaatgttcacttttaccaaataatgtaaaacttttcttcaaagtgagtgtactcacctctagtcccactgcagtttaatagttacatttcaccagcattttgtcagtcttctaatttttttccaaactagtgggcatgaaatgaaaatttgtggttttatttacatttcccctttttactaatgaaggtgagtatattttcatatatttaatgggccatttgtgttttctgtgaaatacctgtttatggtttgttttgttttggtttggtttggttttttgagacagtgtctcactccgtcgcccaggctggagtgcagtggtgtgatctcagctcattgcaacctccacctcctgggttcaagtgattctcctacctcagcctcctgagtagctatgattacagaggactgccaccacgcccggctaacttttgtatttttagtagagatggggtttcaccatgttggccagggctggtttcgaaatcttcatgtgtcgtgatccgcccg

SEQ ID NO: 179585 - DNA, 447 bp, Homo sapiens
gaatattaaatgtgaaaatatacgtaaagcatgtgacacataacctagaagttgacacttgtaaatactacttccctttattaccataattattctataaggttggaaggtcaaatattactatatgggatgaatcacttaagaccttactactagataccagaagtacagtttaattatattaaatatgtaaggtaagtttatgcctgccagaggttcatttctatattacacacacatatatatatatattcatttccatattatcacatcaagaagaattaactgcaattctgaggaaatatagaaaaataagtagggcattactgcatggccagtgttctgggctgtgtcctttttctcttctgggtacacttaaagccagcccactgttaggtcgccagaagatattactgcagtatttcttttctatcaaagaagaatgag

SEQ ID NO: 179586 - DNA, 180 bp, Homo sapiens
gctttaagtcagggaaactagaggttccaggttgcccattgtggtcaacagagaaggaagtggacagcctgcctggcctctcgctgacagaggccatgtcctcctagctggaccctggggaggtgggcctctcactttctgcagcagctggagccatgactgggcttggtggctcaggag

SEQ ID NO: 179587 - DNA, 430 bp, Homo sapiens
gatggctggagaaatccacagctatccacctcaggagcatcaacaaagaggacaaagattgtgaataggagccaagggtcaatcccaagtccctagcttggtggatggtggtgccattaatcaagttaggaaatatgggaagagggccacagtctagggggaaaatgatcttggttgtcctctaagtactgaatctacagtatggccttagacctcagaaattagggatgtggatgtggttagtctctctacaagagggaaaaccatgggaatgaatgtgacaatttaaggacagagtagtcagggaagaaagaaaaggaccatggatggaatgctagggagtaataaaagttaagaagcagataaagaaagcaaagctaggcaggtgaatgatacagttaatgaggcacaatggtctattgagaaatca

SEQ ID NO: 179588 - DNA, 423 bp, Homo sapiens
ttggcctcccgaaggtattacaggcatgagccacccacgcctggcaagatctggtttttgacatgttgagcctaaggtttttgacatgttgagctatcaaggcattccaaaaatgttattaaataggcaatgggttgggcatggtagctcacacctgtaatccaacactttgggaggctgaggcgggaggagcacttgaagccaggagtttgataccagcctgggcaacaaagtgagacaccttgtctctacaaaaaataaaaaaataagcttggcatggtggcatgtgcctgtagtcttagctactcaggaggctgagagtcaggaggatcacttaagcctaggagtttgaggatgcagtgaggtatgattgcaccactgtacttcagcctgggcaacatcgcaagaccctgtctctaaaaa

SEQ ID NO: 179589 - DNA, 198 bp, Homo sapiens
ctcttctccaggtagactaactagatcagaaatagatgacccagacgtatatttggtccataataaatattctttcttctcttactatattgagaaaaaatatcacagacagtcccctacctcctcttgctctcctaaaacctaactatattctcatcattttctttcagtgtgtgtgtgtgtgttaggtctacctgg

SEQ ID NO: 179590 - DNA, 621 bp, Homo sapiens
aacttacggctaggtagcgagcgctcggtgtgactgcctttccacgttgcacaagcccagcgcacggtacccactggatatgcccgaggcctccagaggaaaggaaaggaggaaaagggacagaagaaatgttcacaggaactgcatatgggcctgctacttgtgtcaaaatgtgactgaactctcttccagcagaccaaatatctatggatacaaaaagttcagcatgacaagatctactgttctcccacataatttttcatgattcatagtcctaaaaggaccaagttccatgcagatctgcagaacaagaggctatttcactgaactgaagcagtcaaaagagaatgctcatgagatcccatcaccaccactttaccgaactacttccatatgtgactatttactctttcttcttttctattattattgatgaactggccatgtacctagctaaggtggatcctgccacttagatattagatcttatctaccctttctcactctgaaatattgttccaagaattcttttcttgtatcattacttttccctgtttactagtgtaataagtatagaaatatgctgttattttcccatattaaaaattctcttgagtagga

SEQ ID NO: 179591 - DNA, 542 bp, Homo sapiens
ccatttcttaatattgtatttactgagttgtgtttcaccttaactctgtttaaatatttgtttttttaaaaacataaacacttgtgtaaagcattctcctgtatgctggtaggtatagaaatacatttagctgtgtattttctcttaaggaaggttccagagtacagatgaggcagtaggatgatacttgagtgagtgatctttggaacctggtagacctgagttcaaatcttgctcctgtcatttattaagtctctgactttggctaagttcccttacctcttaatgccttgtttcttatttggagatgaggatattcttaatacatgtctcatagggattttgtgaggagtgaataagataatgcatatcaacatttaacgcagtgctagcataagaaatatgcaaaacaacagcatgaaaaataaaaatggtaaattttgtgaaatagttttagttgaagtgcagtgggaggagtttagttttgggatgatgggagaaaactttgtggacttgatataatttaagttggtctacgtggt

SEQ ID NO: 179592 - DNA, 823 bp, Homo sapiens
atagggaagtccctctggtaaataggtaaggatggatggagatactcgggctggagtggacttggaagaacaccaaccttgccactcacttcctgtgcccctctaaggagcctgggattctctacagcacagctggaaaccctggagcatatggtggacaaatgccctttcagctacaagatttcatggtccagtcatcactggtaacaactcctctttaagaagagagaccacttcaggcatccatctccccttgtcaacagcaggaaaagccagacaacccagtcatgaattgggatttttctaattggaaaatagttgtaatactgcactcttacagaagataacctaagaggaggataatactcattattgatgaggtttatctaaagatagatgtatttttacatctttcccccacagatacaacccacctccatctgaattgtggaaaaggcctaaactgggtgacccaagatcatcctggtgacaggtgtgtccctagcttcctacacaaattaatgaatgtctcattggtgaacttcttgatcctgattgatccttgagaggaaggtgtgacgagtgcagcatgagctgctgattactagacctgcatgcaaggaagaccccagtgaaggcccaacacgaatgctgagtacacctgtgggcactctggagttgccatcttacctatgcaagagggggagcagcgctttggggtgtaaacctaacagagaagtggaacccaagagtggctattttccaaaacagtaccattgcatgcaaaccctaaataaggaggaactgtccacatttacagtcc

SEQ ID NO: 179593 - DNA, 175 bp, Homo sapiens
ttgaattactttctggattcagttgctttcagcttaaataactctctttggtatttcttgtagtgtaggtctgctagaaacaaatttttctcactttatctggaaaagtttattttaccttcaattttaaagttagctttgctgaatatatgacttttgtttaatgaatggtttc

SEQ ID NO: 179594 - DNA, 510 bp, Homo sapiens
atctcattgattgtatagttctcatgaattgcattatgatttttttgtccacttcagttattgaaagaagtatctctcctgatgatggtaaatttgccaatttctgctttcagtcttgacaatttttgctttatatctaagttaggttaatagtttcctgatgtttgaatattttaacaatacattgtgaacctctttacaactagatgtgctttttaaggggtattttttctttgtatttgtcccacttattcagcatgcatgtttgcacgtttcttttttaaattcaaaaaagtcttctttttgattaaaccatgtttacattttattccattttccccttctactatcttggaaattatatagttatatttttagcgaatactgatatatttaagcatacatattaaattaaaattgaaagtgaacaaatacctttatccttctcctaaataataaaagcatataaacttagagttagtatctaaggctctagtatatttaggagaa

SEQ ID NO: 179595 - DNA, 487 bp, Homo sapiens
atctcattgattgtatagttctcatgaattgcattatgatttttttgtccacttcagttattgaaagaagtatctctcctgatgatggtaaatttgccaatttctgctttcagtcttgacaatttttgctttatatctaagttaggttaatagtttcctgatgtttgaatattttaacaatacattgtgaacctctttacaactagatgtgctttttaaggggtattttttctttgtatttgtcccacttattcagcatgcatgtttgcacgtttcttttttaaattcaaaaaagtcttctttttgattaaaccatgtttacattttattccattttccccttctactatcttggaaattatatagttatatttttagcgaatactgatatatttaagcatacatattaaattaaaattgaaagtgaacaaatacctttatccttctcctaaataatactagagccttagattactaactctaagtt

SEQ ID NO: 179596 - DNA, 238 bp, Homo sapiens
ctcccaaagtgctgagattacaggcgtgagccaccacacccagccagaaaaagcaatagtttcttgaaagtcaggtgcagtgtagaatccgcagctgtagaactgcagcccgaatggatcctgtctcccatgtgttttgtccatcatgcaccaggcatttggaacacactagctcacagagttacacgggccttccagcagtgacacatttaatcacacagatcatcaaaacatccca

SEQ ID NO: 179597 - DNA, 294 bp, Homo sapiens
cagctttctactgcgttgtccagcagaacacgttgaagcttggggcctgcaactcgtgtagagatgattgcatttaggaggctgaggtagattttttccctcttaagtgtgtgctcactgctttttggcgaagtcttgacccgagacatacacagcttgatctgtgaggattttaacatcgagatggttctgttatttgagttaggcatggctaggctaccaaggcattgcttttcagtccaaacatttggtcatttcaatttattgttagtgaggtttttgcgatttgttaga

SEQ ID NO: 179598 - DNA, 553 bp, Homo sapiens
gcaccaagattgaaccctaaggtaactatgggctttgggtgattatgatgtctcaatgtaggcttatcatcaattgcagtcaatgtatcactctggaggaggctgttgataatgagggaggctgttcatgtgtggggtcagggtgtacatgggaaatctctgtaccttcctctcgattttgctgtgaacctaaaactgctctaaaaaaacttaaaaaaagaaacattttctgggcagcacaagggcttcttgtgaaatggtttgaatattttagatatgtgggttctgttatttaataaaattacaataagatgcattcatcaatagattactagtgcattgcttattagattactgaacaactagtgcttctctgaatggattcactgaatacagacatttatttgatctgccctttgtaacccttgataatactccaaggttttgctgctacgtgtgagaacccaagataagcctcaaacttggattctctctgaaggtataatgagctaccaccccagccatttggcacatcacccatgtttgttagaaa

SEQ ID NO: 179599 - DNA, 188 bp, Homo sapiens
ttaaagcgtctcccactgcaccctgcagccctgacaccacaaagtgggggccatttggctgcagaagtttgttacctgctgtgtctgccaacagctgtgttagctggctggaaagactggggttggctggtacctggagaaatatgatcaaggaagcattctctcacccacctggggtgtggagctga

SEQ ID NO: 179600 - DNA, 519 bp, Homo sapiens
caattctcctgcttcagcctcccaagtagctgcaattacaggcgtgtgccaccacacccagctaatttttgtatttttagtagagacggggtttcaccatgttggccagggcagtctcgaactcctgacctcaagtgatgtgcctgcctctgcctcccaaagtgccagaattacaggtgtgagccaccacactcggcccaatttcctcttctgactgtaatttctgtgaaattagagactttgtttcatgctagtatcccagcacctacagaagtgccggggtgtatagttaagaggtcaaaaaatatttattaaatgaacaaatctagcatatataaagacttatacaaatcaacaaggaaaattgttaacatggacaaaccacagaaaaggaaatatgtatacatggctaataattactggaaataaactcaacctcactatcccaaaaggaagcaaattaaaacaaaagactacttttgaccctcaaattgccaagaatttaagacaaaggaaaca

SEQ ID NO: 179601 - DNA, 730 bp, Homo sapiens
cagtaaacggcaaggtaaccccatggtaattttcagtggaaacccaatattgattctaacaattgtacaggctgagcactgttagctatttactaagcactgttctcctttaagacatttgattctcacaaccctgtgaggtagtcatcattatcctctctaacactcgagagttggcccatggttgtgcagctaattaaatctgctggaccctgaaatcagcttttttctcttatacagactctgccttctaaggaaaactggagagacgccttccggtgtctattttgcaggtagtaaaagtgagtcacagaatcatggaaattgttcaaggcaacagcagagctgcagatcctctgccctaatcccaataatgcctttctgttatatgtagagctttagagctctcaagattatctcatctattgctcacagcgggtctttgtgatgattatatctatttatagatgagaaaattgagacatgaaaaggttaaatggcatttctcaaggtcaccaattactatattgaagaacaagaaataaaatccgtttctaattctctgctgccttactagatgtggtgctttaaaaatatttcatccacttatctgtttcagaatgtatcagatacattaggtaccatatattatgtgtggttgacaagattttcaggattaactttaattcaccagagataaactttatatctaatgagatcatctttatgg

SEQ ID NO: 179602 - DNA, 583 bp, Homo sapiens
tgggaggccaaagtggaagaatcgcttgagtccaggaggtagaagttacagtgagccaagatcatgtcactgtactccaaccactccaacctgggctacagagtgagaccttatctcaaaagaaaacccccccaaaaacaaacaaaaaaattggatacagtttaactatatagtgtattatatactgtttatacagttaacactgtatagtgtttaactgataccattttagtttgggaagatgtaaagttctggaaatggatagtggtgatgactgcacaacaacgtaatgtacttaatggcactcaactgtatgctttaaaatgattaaaatggtaaattttatgttatgtatgttttcgcacaatttgcaaaaaaaaaggttatccaaactaattatttaaactagtttttataggaaaacattgtgccagttttacaccctaaaaaaaaataataataatcaggttgagtcgagttccatttatagtgatgcaagtctactcctgagaatcctttaggaatcactgttctctgctcctttctggctttatgtcagcctcccctctggactcccatttgc

SEQ ID NO: 179603 - DNA, 241 bp, Homo sapiens
acaacacatatagaaaagtttctagaaattaattcaaccaaaaatactcaaaaactttatggagaaaatctgaagattaataaatggttttgattataatacgaaaaaatggagaattgtttcatgttcttgaatgaaatgtcaactcacctcaataaattttcaattgcacttttgttgcatttaataaatgtatttaaaatttatgtggaagaataaatgcacacaaatatcaaaatca

SEQ ID NO: 179604 - DNA, 364 bp, Homo sapiens
tcatcctcgccttcatattgagtaggctgaggaggagtaagaagaaggagggcttgatcttgctgtctaaggtggtaggggaggaagaaaatccacttcatggacctgtgcagttcaaacttgtgttgttcaagggtcaactgtatgttatgaaactgtaaacttagaaatatccttaactttttactatatctaatattataaattatttaagtactataaattcacagcagtacatcaccaacgaagtctcatctgcaggcttttagtcacttaaattactagtaaaacacacataaggatatggatgattctgtagtgcatatttgcctaaaggttgttgattaaaatattacaggccaat

SEQ ID NO: 179605 - DNA, 422 bp, Homo sapiens
taacagtaaaatcccatctctactaaaaaatacaaaaattagctgggtgtagtcgtgcacacctgttaatcccagctactctggaggctgaggcatgtgaatcacttgaacctgggagctggaggttgcagtaagccagggccaggccattgcactctagcctgggtgacggcaagacactgtctcaaaaaaaaaaagttaaattataccattcttctcatgaaatatttcattgtttgggaaaatgtttttcataagagatttttaatattttaaaaatgtctcccttttagtttatataactgttaatgtcaatgcctataactcatataaacaaaagctcttgggcttcctcgataattttgagactgtaaagagctcccgagaccaaaaagcttgaggtgactgtcatagagtattgc

SEQ ID NO: 179606 - DNA, 584 bp, Homo sapiens
ccatcttagttgtcaagtctcagctcactgtccttagaaaagcctctttctccctcccttcctccctccctctgtcagccacaagccatcatgaccctcttttgtcttctagatattgtattctctatctgtaatttctttccttttcttttctttttttttttctttttttttttttttgagatggagttttgctctggttgcccaggctggagtgcaatggcgtaggctcggctcactgcaacctctgcctccccggttcaagcgattctcctgcctcagccgtccaagtagctgggattacaggcacccaccaccacacccgactaatttttgtacttttagtagagatgagtttcaccacgttggccaggctggtctcgaacccctgacttcaagtgattcacctgcctcagcctcacaaagtgctgagattacaggcgtgagccaccgccccaggcctctgtaatttttcttaacccttcctttcttcttaaattttttcctgtgggggcattgtgacctgagctggggtccacgcttgccgggttctgtgttcatcacattccctgcccgcacaggac

SEQ ID NO: 179607 - DNA, 506 bp, Homo sapiens
taacattacaagaatggattaatgggttgggaatgctgggttttggccttcattctggtgctgtggtcctgtttcctcatttgtaaaatgaagggggttgtaaagatatattctctaaaacccctaatgctatggctgtggcattaagtcaaactattatttcttactgctttgtaccggacatcactttcacattagtaaaacttttcatcagtgtagtttctcccaagcttgattattgagaaagatagtgccttgtttttaacatcctgtatcctagttccaccgcagtgtttggtacacagtagatgtttaaaagaagcttattaaatcaaatggtggccaggctcatggggctcacgcctttaatcccagcatttggtaggctgaggtgggcagatcacttgaggacaagagttcgagaccagcgtgggcaacatagcgaaaccccatctctaaaaaaaccccacaaaaaccaaaacaaatgaaaataaaataaatcaaat

SEQ ID NO: 179608 - DNA, 135 bp, Homo sapiens
tcagaggatggagtgaccaggctggttccaatgacagttatacggccatggggagtagacatggagtctaattcagtgcttgaggctaagaatgaagttgtatgcattgtggaaattgttccaggagatcttgca

SEQ ID NO: 179609 - DNA, 529 bp, Homo sapiens
aatctcagctacttgggaggctgaggcaggagaatcacttgaacccaggaggcggggaagttgcagtgagctgagattgcgccactgcactccagcctgggcaacagagctagtctccaactcaaaaaaaaaaaaaaaacaaaactaaccatgctctaaaagtgcacatgcacatggttcatagcttcttagtgctgcctgtcagtccttgatatgcatccaccacttacccatttcctatcagctcctcatccataaattattccagggtgaatatccttgtacatttccacaggagctagtgctagaatttctctgagacatgtaactgggagagggatcactggatcctagagtttacacctacctctgttccatcagattactttccagaaaagctgttcttgtctgccaccttctcaccgtcactgggttttttaccattctaatatttgtcattctgccaggtgtgaaagcggtatcttgttttaatctgtgtgtccctgattcctggcaggtttgggcattt

SEQ ID NO: 179610 - DNA, 537 bp, Homo sapiens
acacaactgtagtccccgctaccttggaggctattattggaggatcacctgagcccccgaggttgagaccaccatgagccccgattgcgccactgcactccagcctgggcaacagagctagtctccaactcaaaaaaaaaaaaaaaacaaaactaaccatgctctaaaagtgcacatgcacatggttcatagcttcttagtgctgcctgtcagtccttgatatgcatccaccacttacccatttcctatcagctcctcatccataaattattccagggtgaatatccttgtacatttccacaggagctagtgctagaatttctctgagacatgtaactgggagagggatcactggatcctagagtttacacctacctctgttccatcagattactttccagaaaagctgttcttgtctgccaccttctcaccgtcactgggttttttaccattctaatatttgtcattctgccaggtgtgaaagcggtatcttgttttaatctgtgtgtccctgattcctggcaggtttgggcattt

SEQ ID NO: 179611 - DNA, 279 bp, Homo sapiens
ctggggggctgcagtgcaagtggttggattctcaatcaatctaaagttggatccaacaagttttgataacttggatgtgatttgtgacaaacagcagtcaaaaaggagccttgaggctgggtgtggtggctcatgcctgtaatcaaaacactttgggaggccaaggcaggaggatcgcttagggtcaggagtttgagaccagcctgggcaacactgggagcccctatctctacaacaaaacaaaacagaacaaaaacaaattaaccaggtgtagtggtg

SEQ ID NO: 179612 - DNA, 294 bp, Homo sapiens
tcaaagtaatggctgggcacagcagctcacgcctgcaatcccaatgctttgggaagctatgtgggatgatctttgaactcctgggctcaagtgatccccctgagtagttggaactatggacatataccaccgtgcctgcctagataggcatatattggaaaagatacatattattctgtgtcaggcattttcaggtaacaacctaagtatttttcctgtgtttctaaataaccttcatagttgttattgggtatttgtgtcaatatatttgtgtttgtgtgtgtgcgcgcttgt

SEQ ID NO: 179613 - DNA, 543 bp, Homo sapiens
tgcttaggattgtgttacactcttttttggttccatatgaattttataatagttttttttctaattctgtgtaaaatgattttggtaggtgatatactatagaatagtatgcagccataaaaaatgaatcatatgctttgcagcaacatggatgcaggaacagaaaaccaaatactacattttctcacttataagtaggagctaaacatatggacataaagataggaacaatagaaactagggactaatagacagggttaagaaggtgaggacaagggctgaaaacgacctgttggatactatgcttaccacctgggtgttgggatcataagtaccccaaacttcagcatcaggcaatatacccatgtaacaaacctgcacatattcaccttgaatctgaaacaaaagtggaaataataaaaaggaagataaataaattacagtttggtaacaaggtttacaactcatcgtcaaattaactttttattagatcactttgtatagtttatgcatttccaaaattagacaaaatgaaacttgtgg

SEQ ID NO: 179614 - DNA, 443 bp, Homo sapiens
aactcttgcatgcttttctggagatggggttcacctcaacaaattccaggcactgcacccagcccttggtttagtttaggatgcctttaactgaataccattaattctataaattctggaaattacagggaggtacgattgatagactatattaacataagaagcatcaaaatttatcttgccagaatatgcagtattggaaacaaaatattgtcgagagaataaagaagttggtaaatcatgatattggtgcaagccatactcagtaatccagtctggcccagcctgctatctacaaacttacgagaaagcctgtggaatttcagaaatcttacaaccttgtaaataatgcatcttgttttgtgagaatcatgcagtgaataatacatcagacacaggggatctgaaattcagaacaaagaatgggactggggagaatttca

SEQ ID NO: 179615 - DNA, 348 bp, Homo sapiens
ggagctaagactagggcccagagtcacccactgaactggtggcccaaaagtgttctggtatttcctgtcactaggccgtgcttctatcctttcttttttcacccctacctcatacttccttatccctcctcaagaaatccctagaagggaactgacaaacttagtgcctgacatgtaccaggctcatttcatgagatcctgcagctgtgaggggaaccaggctcagaggcagggggtggttcccccagcaaatgggggcaggatgggattgaagcaggtcccacgcactccagagcgccttctccttggctaacctcctgcaggttttgggctttttgctccccttca

SEQ ID NO: 179616 - DNA, 276 bp, Homo sapiens
tatagggtggcaactcaatttatgtgtgggatgcataattgagagatgttattttgagtccctttttttgtgagctctgctgtgaactgcaaactgtgtgcatgtgtataaaaggttaagagcccgggtagctgagtggggtgccatgctgttagcagacgatgagggcagtattactcaccaggtgcatgctgtcagctctgtagaagattccatcttcatggagtcatctcatggtccactttttcttgaagccaggtaacatttccaatgggt

SEQ ID NO: 179617 - DNA, 467 bp, Homo sapiens
atgccgcaggacaacacaggcaggaactggagtgatgaggctgcaagctgaggaacatcaacgactgctggtgacaccagacactacgaagaggcaaggaaggattctcccctacaggtttcagaggaagcacgacactgccaacacgttgatcttgaacttctggcctccaaactgtgagacaatacatttcttttttttttttggagacagagtctcactctgtcacccaggctgggagtgcagtgatgtgacctcggctcactgcaacctccacctcccaggttcaagcgattctcctgcctcagcctcccgaggggctgggattacaggcacccgccattacgcccagctaattttggtatttttagtagagatggggtttcactatgttagctaggctgatctcgaactcctgatcttaggtaatccgcctgcctcgtatgtcagtttccgtgggattatag

SEQ ID NO: 179618 - DNA, 314 bp, Homo sapiens
ggcagggttttattttcctaaactcaggggcttcctttgatgacccagttagagctcagttacatttcagtgggttaatactgtattacaaaaaatcttcgctgagttccttcccagcaagaacatgactttgctaatgagcttggattatctgtcttccattgtctgtctgacccctatagggatttaacttcacaacccagacctagcccaattttgtattttaccaagggggaaactgagacacagagaggactgctctgtagcaagaacatggctttgctaatgagctcagattttgcatgtggaaagat

SEQ ID NO: 179619 - DNA, 237 bp, Homo sapiens
agtagtctacattgtgatgtttcttaacattttaagatgcctacacattaaaattatttcatctgaaggacagtagcacaaggcagaagctattaaatatgaggggataatatagaaaatgagatagtaaagagataggattgatagactgcttgaaagagagtggagagttagagggtctagaacagtgctgtccagtggaaagatcatacctggtgtttctgctttctagtagct

SEQ ID NO: 179620 - DNA, 301 bp, Homo sapiens
gtttccttgtctataaaatgggaataacagcacttgtcttgtgataccgtcctaaggacagcattgaggtaatccaaggaaggctcccagcaaggtgcctgacacacacccatgtgcttaggtgtgtcaattttcttccctcctttcatcagtcagtcttacatccagaaagtgcgtttgtaagacagcagctcagggagagaagcatgggatctggactcaaggaaagtccagcagctccccacttaccaccaaccccaggctaaccagcaaatcccctacgtcaccaattttagacacc

SEQ ID NO: 179621 - DNA, 573 bp, Homo sapiens
taatagtcctgctgttgattgagggccaggatctgttaaggtccatgggtcccagggttcctagttagtctttcagtttttgcttataaacttctctctatacagcctctatgaggctgtgttagggaaaaatttgagacagcttcttctctggacaatattcattctctcattgcacaccaactctgcagtaggccctcttctagccatcgggcctagagtagaaataaaaaagaagtccctgatgtgaaacctcctttctggtcaatgagagaaaagatgataaataagcaaacaaagcaataagtaagatcattttagataataaatgccacagagaaaaatgttaaagcatgaaggagtatctttttataagagatatgaggtagggagagcatcagttcagataagatgatctgagaaggtctctctgaggagggaactttgattagaggcacaaatcaccatcccctttggagatctaagattggttatcatgcccggttgctcctgtcttcctaaagaatcccttccccaaagaatccttaatttataacaatcttttggcaagcc

SEQ ID NO: 179622 - DNA, 254 bp, Homo sapiens
gatattgtttataccatgtagacctctcctaaaacaaggtctgagctgaagcattgctcagttttaaaaatatccaagttaggccaggcacagtggctcacaccaacactctgggaagccaaagtgggaggatggcttgaggccaagagttcaaccagcctgggcaacatagcaagaccccgtctctaccaaaaaacttaaaaaacagctgagagtggtagaacactgtagtctcagtgactaaggaggctgag

SEQ ID NO: 179623 - DNA, 562 bp, Homo sapiens
gctaaattgaagagctagaatttgaaaccaggtctttttactccagggccaaagcttttaaaacaatacagtatggggtagtggttgagagtaacccatttgttaatggatctcaggtatgtgtctttctgcctcatcaaaaaaatactcgttttgaggggtggtgactaaaatgtataccagctagaatagcccagaacagttgataaatacgtgaaatctcagtttatactttatgtctaataaccaaatgtgtaattcccacttatgacttgatcattgaaagtatcacaaagtcttatctttagcttctgcagtaggatacccagactttttaaatccttaggcagttttacctaacagtctgatagccactgatcaaagcatgactccttatgattatagcaatatctcgtttatttaatgtataagtggaataatttcattaagctgctgattgttcttctctgttactggcattctggtctttatccagaaaacagtactccagtagcacccaactcatgtccatttccaccttttaaaagacaaagggtgcatt

SEQ ID NO: 179624 - DNA, 939 bp, Homo sapiens
tgaaaatgtggatgatcaggaccaagttattctcccgtaaggccacagtctgctggagggaatgacatctccagccagctcttctccagagaaccctgtttcctctctcctgcttactcttcaagacttccctttgatgtcacctggtctgtgagacagcctttcctgggacccccccacggagagagaacccactcataagactccaaaatgccaaggcgcccagcttctcatgcccacctctgagctgtgaggcagaggcctgtttattttgggttgatgagtaaatcatgtggaacagaatcaaaagctctgctgaagtcaacacagatgacatctgtcacttcctctttctctcatgcactggtgaaggaaaacaatgaattttcaccctattgtttatcttagaagggtcaggttttgaggtcaaacatcagtgtaaaattttgtcttaaaaaatgcacatgcattctaactgctaatagctcatatgcccatctttgaaatcaatgttcttgtttctttacgaatgtgcccactgcaaggatatcaaagcattggcagacattaagtcagtggctttgcctaagccaggctttctctcattgaaaagggagggatctatttggggagagagtctctgggggccgtgatttatccagtttgattacatggaacactggtctctgtttatttgctgcaacatggcatctgccttgggaggagatgctccacagtcgactagagcctctgccagctgtggccacttgtcttcaggctgcacctgtgtgagtcccttactcggctcactgagcatgactccttctgacctcagggaatgaatggcctgtttcccaggcacaggacagatcctgaatgtccccaaccctgagagtgtgtgcgtgcaccctcctctcttgcctgatctcgtcctggcct

SEQ ID NO: 179625 - DNA, 687 bp, Homo sapiens
gaggctgaggcaggagaatcacttgaaactgggaagcagaggttgcagtgagctgagattgtgccactgcactccagcctgggcagcagagcaagactctgtctcaacaacaacaacaacaaaagcagcaactgggagagcacggtgcaggaaaatgatcaacggagaaaaaagtttttcctcagaattaggagacacagtcccttccctcacgacaccccagtctctcaagaccattcaacacaatacaggctctaatgaagatgtgtacagtattggatgggggtgggagaggagacaaagcttgcaccaagaatgtgatgctacacatttgcaagatggaaaatgtggggaaaagaattgcagacagaaggaatagaatatgcaaaggtatggcatgccctactcgtttggggaattacaagtcgtttgttagaaccaaaccatgaagtgctgggagagtgatatggtttggctctgtgtccccacctaaatctcatctcaaattgtaatccccacctgtcaaaggagggacctggtaggaggtgattggatcatgaggcagttcccccatgctgttctcatgagactgtgttctcacgagacctgatggttttataagtggtgatttcccctgtgctttttctctctctcttgtttgccgccttctgaagaaagtccttgctt

SEQ ID NO: 179626 - DNA, 480 bp, Homo sapiens
gctgtgtatgtgtatgtgtgtatggggcaggtgttgatttttaaaagtcctttgttaaggttctacaaagaagtattttttgttttgttattttctggttggctgaagaattttgcttcagcatggaatagagtggtagttggggatcagggtaaaggatggttgggataaagattttggtttttaacaggaaattggtttgagccttccaaaaaaaagagagaatcaatcaactctgaacaaaaggagtaaatagttggtctacagggattaatgtttctttattttacaaataatctgaaaaacaggcccatagatctggaaaacagccacaactgcgtagataatactacacaaattggtaaacggatgagagtaaattaaaatacaggtttataagcatgtgaaaatagccagaaaaatatcaactaaaataaagtgttgatgcataaatgcccttgaggaaaaataacctaaact

SEQ ID NO: 179627 - DNA, 738 bp, Homo sapiens
gagagaggagaggtgagggcaggaggcagaaggcgggcacggtcacccctggcccatttgtgaacctgtaaagtgctgccttccccagctatggtgaggaaactaggtgcagggaggttaggagtggcccaagatcacccagccagcgagagtgagcatcaggaattgaactcgggtctgtctgaagccaagggtgtcttcctgaaacttcattatctacacgtcctatcagagaagagatgcagagagaaggaagctagagcttaaggggtgtgtgtgtgtgtgtgtgtgtgtgtgtgtgtcaggtgggtggggtggaggggagcatgaggaagatgagacaaggtcatcagaaaggagaaggatgccaggcacggtggctcacacctgtaatcccagcactttgggaggccgaagcaggtgggtcatttgaggtcaggcatttgagaccagtcctggccaacatgatgaaaccctgtctctactgaaaatacaaaaattagctgggcatggtgatgcgtgcctgtggtcccagctactcgggaggctaaggcgagagaatcacttgaacctgggaggcagaggttgcagagagccgagatcgtgccactgcactccagcctgggccacagagtgagactccatctcaaaagaaagatggagttgctgagggaaggggaatgaggttgagggaaagagaaaagaaagacttttggaagcataaacctcaatgccaga

SEQ ID NO: 179628 - DNA, 456 bp, Homo sapiens
cactgtgtccacagatcttaggcaaggattgttataaactcttgataagtttacacaacattcgtctactttttacttttataggttgtgtcattttctccaagagtcttctattagagttctgtcacggtgctttggcaaagactgagattatccttcacaatgtatttttctcactttccatttgcaaagcatgttgcttgtctacagatagaatgtattgaaaacacagtatgttaactgaagaaataggtaggaaagggattttaagaaatacctgcattaaggcttgcttctcttcttgatttttcaaatttaataagatccaactccagaaagcttgaatacagagatttagtttagaattcatgaaggaacagggcaggagtttgcatataaaatacagcattttaaatattccactttcccaccatctcagggttttagttacagact

SEQ ID NO: 179629 - DNA, 509 bp, Homo sapiens
tggattttcctacttccttcgtgccgttacagatctccctaaaaatcacctccactttgattctctcttcagccagagggctttcccagaacactgcactgcagtggtcaagccttcttccaaactcccagtgaaacatctctgaacacctaaatccttaagatagccccagtgctttgctttgtttatgcacaggtctggactccactcagtacatggcaggcagctcagtaagtgtctaaatgaatgacatctatatagtactttacctttaacaaaacacgttgataaaacttctcatttgaccctccaaacaatcctaagagctgctgctctagtttaaaaaacaactgtaaagaccactgaagttaagtgattttccataatcacacagctatgaagcagcagagccaggacccaaatctgggtattgagacatctctttgagattttgtatacaacatatttatgttttgaatcctttgtgacaaatagcaaatactagataa

SEQ ID NO: 179630 - DNA, 303 bp, Homo sapiens
atggatgaagagggagaaggggacatcagcaccaagctcacctgagggtataggaacaggtcagagaagtcctgattttctaagctaagccctgagggaagatacgcaaagtcctaagccttcaaaagtggatgatgcttttaggaaattcaggtaggtgggaaataaagagagtctaagttaaggtgctaagagtagagagatgacaagtaaatgggttcacaggaataacaagaaggtttctaactactgactgaaaatggaggatgagggagaggagtcaaggatgggtcctcatctatg

SEQ ID NO: 179631 - DNA, 263 bp, Homo sapiens
acaattcattgctgtggcagaattatccttaagttcagatctggtggctaaaataggaatttgttcatccaataagtgaggaacttctcctcacagggttgtagggacagggcagcatgagcactgtctggggagagcaggaccatgagacaggctccagaaagcacaagtagtatagcaagtactgtccaagggggcagggccaaatataaagttaacctgggaggcaggtcatgaaagacccctgtacaccttgctgaaga

SEQ ID NO: 179632 - DNA, 407 bp, Homo sapiens
gttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctg

SEQ ID NO: 179633 - DNA, 1006 bp, Homo sapiens
  misc_feature (750)..(750): n is a, c, g, or t
  misc_feature (780)..(780): n is a, c, g, or t
  misc_feature (799)..(799): n is a, c, g, or t
  misc_feature (804)..(804): n is a, c, g, or t
  misc_feature (841)..(841): n is a, c, g, or t
  misc_feature (850)..(850): n is a, c, g, or t
  misc_feature (895)..(895): n is a, c, g, or t
  misc_feature (897)..(897): n is a, c, g, or t
  misc_feature (901)..(901): n is a, c, g, or t
atgctgcttcggatgctccaaaaaacctcactctactcgctgaaacagcagatgctagaggaaggagcggctcttcaagtagaacaaacttcaccattttgcctgttgggtactcactggagatagcaacagctctgacttcccagagtggcaacttagcctcggaaagtcttcacctgccatccagcagttcagagttcgatgaaagaattgccgcttttcaaacaaagagtggaacagcctcggagatgggaacagagagggcgatggggctgtcagaagaatggactgtgcacagccaagaggccaccacttcggcttggagcccttcctttcttcctgctttggagatgggagagctgaccacgccttctaggaagagaaattcctcaggaccagatctctcctggctgcatttctacaggacagcagcttcctctcctctcttagacctttcctcatcttctgaaagtacagagaagcttaacaactccactggcctccagagctcctcagtcagtcaaacaaagacaatgcatgttgccaccgtgttcactgatggtggcccgagaacgctgcgatctttgacggtcagtctgggacctgtgagcaagacagaaggcttccccaaggactccagaatgccacgacttcatcctcagtccttctttcaccctctgcagtggaatcgagaagaaacagtagagtaactgggaatccagggatgaggaattcattgaaccatccacngaaaatgaattggacttacgtctttgcgtnggcaaaatgattccccaanctttnggagaacatcagcttgccagcagctctgaggtgcaanatggaagtnccatgtctcagactgagactgtgtctaggtcagtcgccccatgananggtnggaggattcactgcacacgggttctgaccaacggccaacttctgcgatgtgacggaagccgggtccaatccgagggggaagctcgggggccagccgaccacggag

SEQ ID NO: 179634 - DNA, 636 bp, Homo sapiens
gcaggctgatggaaacatgatggaaaatggaaatatttcagatgagagagagtgagggtttcactgagtcgaggagtgcaggctgatggaaacatggaaaatggaaatatttcagatgagagggagggagggtttcactgagtcgaggagtgcaggctgatgggaacatgatggaaaatggaaatatttcagatgagagagtgtgagggtttcactgagtcataaagttgtggagaggaagcagtgagtagaagaatacttaagaagtagaattaataaaactttgtgccagaacaggtgtgatgggtctgggagagagctatacctggaacagtggatcagagtctctgatccagttacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcactcctgaaaagaatcgaagtgcacaactctcaattatttttaat

SEQ ID NO: 179635 - DNA, 280 bp, Homo sapiens
ggtttcacctgttagccaggatggtctcaatctcctgacctcgtgatccgcccacgttggcctcccaaagtgctgggattacaggcgtgagccaccacgccctgccctgttcttcttattttagtgactcatctcccttccgcacagttccagaggtcaccggtgctatctgttcctgagcctttggaggatccactggttgttcctaactttcctgctcctcactgaggattcagcttcctttgtctgttaattctatcactgcttctccatctgcttt

SEQ ID NO: 179636 - DNA, 601 bp, Homo sapiens
tgcagggtcctcactgtcactggcccgcagacacattgcggggtcctcactgtcactggcccgcagacacattgcggggtcctcattgtcactggcccgcagacacattgcggggtcctcattgtcactggcccgcagacaggaaaggaaaagtaaatccccgctgaggcaggggcagtgggatggacgatggcttcccttttcaaaactccctttcatgttgctttaatgatgtgtcgttttaaacggtactttaaccataaacagaaatcaagtaaatgagggagcgagggccgcgtggtggctgagctgcgtaaaggcagacagtgggggtcccaggcgacagattgcaaactgcaggccttggggggtccaggaggtgagtgagaccaagaccagacctggggtccttgaggcccctccagggcaggcagccccaaacccacgcctgtgccttccttcgaggctcctcccgggcaggtggcctccctaaacccacatctgtcccctcctttgacgcccctcctgtacaggaaggttgtaagggggtacgaggtcgattcgtatctggtctactgtctctttaaaaaaagtattatga

SEQ ID NO: 179637 - DNA, 621 bp, Homo sapiens
cgaaagtataatcaaagaaagaatatatacttgcgacatgttcaagatctgagaagctgggttgggggaatgacattattaccagaaggaaacatatcaccccactggtggtcagtacaataatgagcaaatacaaagaactcttgtcccaaaatatataaagatatctcaaaactccacagtaaggacaagcaagttaatttaaatgggaaaaagacctgaacacacatttgaccaaagaggatatgtagacagcaaataagcacatgagttgttattgaaatgtaaattaaacctatggtgaagattactgcacacctattagaacagctaaaataaaaaaccagtgacagcaagtgtgagcagcgttggccaacgctgctcacaaccgcctgtttctttcgcccacgcagggagtcatatagcccagaaaaaacttcccgggacttttagcctgtcccaaggaaaaaaaaattggaaacatacccacatgcaaacagctggaagagctaaaatcagaaaccactaaccgccgcgggagcgcagtgcacgaaagggtttagttcagtttatttcaagacacttcatttagtagctctttggcgtgtcgtatatttgcta

SEQ ID NO: 179638 - DNA, 289 bp, Homo sapiens
ccccttccctccctcttttactttttctttctcttctctcatgctcacattcacacttatggcctaccacagagctctggataagggaagtcccttgtaatctgtgtaatctgcttttatcacaaaatatgttccagattgggttggagacatgaggagcataaaatacaaatttaaatgtataaacacattttgcaaagtcttatccatatcttcattgtaagactatagaatttagacaattgtaggtttgttttattgtgattgcttgaatctagattaaaatttg

SEQ ID NO: 179639 - DNA, 388 bp, Homo sapiens
catgactatcaaagcatgattaatttcagccacattcataaaatagaataaaactacattagatttacaaatattaaaaattaacccattctgtaggcaagggtgagggcaaagagagactcctatataacatggacggaagtgtacactactaccatttctttggagagtaatttggaaataactgaaaaatatctttggctcagaacatctccttccaggatttttcttccaggcatgttctcatatgtgaacatgaatattgcagagttgtttctaacagcaacagactggacacaatttaaatggtcaccaagagggagatggatatataaagtgtgacatattcatacagcagaacactaaccagttattaaagcaagagagg

SEQ ID NO: 179640 - DNA, 333 bp, Homo sapiens
gtggcaaaacctgtctctaccaaaaaatacaaaaattagctgggcatggtggtgtatgccttgtaatcccagctgctggggaggctgaggcaagaaaattgcttgagcctgggaggcggaggttgcaatgagttgagatcgtgcaactgccctccagcctgggcggcagagcaagactgtctatgtatatatatatgtaaacagtttttaagaattttaagaacagttaaagctgttcttagatatttaagaacagccttaacagaaaatatgagaaactcttatgaataaagtttaggaacgttaagtataaatttataaatactaatggag

SEQ ID NO: 179641 - DNA, 693 bp, Homo sapiens
atatcacatggaagaaagctattacaaagtgcttttcaatcaatgagatgttattatgagccatagatccaatttcttttgatcaatgggtgtttttactacatttactaagagatattctatggaattcttataggatattcttccccaggctaaaggtcatgcttccctttttattcagattctatcataatgtctagttttactcctattaaaatatactttttacttttcacaatttttttatctaaagatttattgaacactatgctttaagaaattatttgaataccaactatgtgctaggaagtgaactagggtggggtattaaaattccaaactctcgaagacgttacagaattatggagaaacaaacattctcatccagcgtcattctataccacactttgattatcttttctctggaagtgagtaattcattcttctgggacaagggtgggtgcaatctacaggaagccaggagggtggagggccaggaatacctcaagagaaggcaaactttgccagattttgtcaggtttaaaaacggccaaaacatcccacacagggcacccctatgaatgatagaaaagcatacattttatttatcttggtttcccaggtctgcaagattgatatcctttatggtcttctgataatgcatcattgactctcctttgcctaagcttcaaa

SEQ ID NO: 179642 - DNA, 330 bp, Homo sapiens
aaggtgctgactttctgaattttgttaaatgccttttctgccttgttgatgtgaccacatggctcttcagccagttaatatgatatcagattagtgcaaaagtaattacggtttttgtgattactttcaatggcaaaaccacaattactttcgcagcaacctaaatagattttgttaacaattctgaaatgtcagccttggattcctggaataaatcttacttgatcttggtgtagaattctctttatataccgataaatcctatttgctgaagtttggttgaggatctgtgtgtatattcatggggaatatagtcccagtttccctttc

SEQ ID NO: 179643 - DNA, 204 bp, Homo sapiens
ccaagcgtgtttgagctgtgccgccctggagtgtggagaggtcgaggacctgagatagggagtccggagtgtgctgttcttttgcactagagtgaccttgagaaagacactgattaatccgatctgctgccttagttcacccatctgtaaagcaggcatgaaactttgcttggagctaagaaagttcttggacctttcacactt

SEQ ID NO: 179644 - DNA, 253 bp, Homo sapiens
ataagctgttttaagtcagatgttgcttgggacttaggaccttgaaaatatcttactctgagtacatacaaatctttatccccaaatgtacactctaatcccttagctctacctccctacagaagaacttttcctgactccctacagaagaacttttcttgaatttttaattatggtttccaactaaacataactaaaatcaaactttgtcttccttctcaaatgttctttccaaccaactccctatttctat

SEQ ID NO: 179645 - DNA, 169 bp, Homo sapiens
aactgtctgaatttagatcctagctctaccacttaaaaataataagcaaggtatttaacatctcaaggtctcagggactccatctggaaaaagcttaataagagcacctaccctcacaggattatggtgaagactaaatccatgtaatgcacatagtgtagcgcctggc

SEQ ID NO: 179646 - DNA, 310 bp, Homo sapiens
ttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgt

SEQ ID NO: 179647 - DNA, 555 bp, Homo sapiens
tgagggtgaggagaagtgaggtcaggtgaggctgggtttccaggcccttcagcagcacatggccgtttgaagtgcatctcaggaggcaagggatccttccctgggttcaagcaggagaaacctggggttcgattagcagctgttaggacctccatgttgtcatattggtcattcggggcctgttgttgaacaggaacagctgcattgctggtgggggctgtaccatggaggagagggggagctgtcaatcaaccaccattgcagactctgcagcacccgagtggcgacagagatggtgtggtgagaggttggtgggactgctgaggtgcccaggaccagaggggctcagcacagaggggtccaggccgggtctgtccccccaggacagagacgcagtttgggtctaggtgggggtctgtccatcagccttgggcttgtggctggggatggctgagatttgactgttgtttctttgcagtcttggggtttgggagtagattttgaatttgagcaggtctagagacaagaagttttcaagagtttcagaaaaaggag

SEQ ID NO: 179648 - DNA, 324 bp, Homo sapiens
tgtgcaggctgacagcacgagtccctccctgcacctctcagctctttttgttgccagggcctccctgagcacttgaagttgctgctgcaagagctgtgagggttagatcaggccctgtagctccctgagcttcctcaggcagggcctcccactgttcttggttcccttcctgggcctgaggactccccttaccccttccacacccactgctgcacctgccacaccctcctcctggcctagcctgtgttcttctctatgggggtccaggactactttctccatggtggtggctcatagccagggctgcgtaaatgacctctaagg

SEQ ID NO: 179649 - DNA, 808 bp, Homo sapiens
gtggtgaaggggcaggaaacttggaggaaaagcagaaggattaaatcattattttttacagttgcttcttacccaagccccaagctgtattctgacccagcagcagatacttccagccaccatgtacacatcctggaagagaagcttcctatatttaaggattctctattttgatttttttttggtttgttttcattgttgtaatttttagctagcttcagaaagctgtatttccctccatagtttatgcaggtgttgtttgaagaacagaacctgtgtctttttgccatcttggcacaggtggctgtggaaggagcccttgctcagtcattgcaacctaagatccattttctttgtgccttttcagtgacttaagtggcatctccaaacaactatgcttttatcactcatatttctttgaaaggattatgtgagaatttctaagtcccacctgctaaaatatgaatcacaacccttgctacagctgtacaaatgattgtgctgtatgtgaacttccctggagcacaggaatcccaggaggattatatgccttcatggcctcatgcacctaaacacactacgcagccatttattcttgggtgtcactatcgtctgtaaatacagttgtctgtctaactactttcctagtgactccccagatgagtatagtcttgttccactgatcatagggtttcccaaagattttctctatggtatacgctctatattcattgagatttaaaacaaacaggctattcttatcattgattttttttttctgttctgtacacctaaagcaagaaacaca

SEQ ID NO: 179650 - DNA, 239 bp, Homo sapiens
tttttcaagttgattgttttgtatttccttaggtagatgtatgtatgtactgagtgcctacaaactccctggatgatttacctttatgacaagggaggcaggaggcctggaaggatgggaggtcaggcgggactttccgaaactgccccagtcatttacatcaatgtgtggattaaatccataacttaaagtgagaagaaagtcaatgtaaaaatattgtgaaataatttatataaata

SEQ ID NO: 179651 - DNA, 187 bp, Homo sapiens
tgccaaatcacatgaaaacctcaataataaggtgttgactacattgcaatggaagttgtcttagaaacttgcttttcaagatgagaacattctatacttataggttcatttttttaatcttatttttgttatacacacacatccaaacttttgtttcttacaattcctttttaggaaaaatctatct

SEQ ID NO: 179652 - DNA, 757 bp, Homo sapiens
caaagcaattattttagaatgcagtgttagaatagctcttatattctggcacttagtttataataatatgatgtttgtcttagagaaaatattgttttgtgacctggatatattagaagagatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaa

SEQ ID NO: 179653 - DNA, 645 bp, Homo sapiens
gctgggtgtggaagagtggaggttggcataagaaaggctgtccaggcaacgtttagcacatgcagtatacctggcatagtcaaggaaccaaagataattcaaagtagaaacgggtctggcaagtgaggcaagggccatgtctaatggtcttccaggagatttgacttcgtgaaggtgatggggaaccagaaaataccatgtagcaactaaaattccttcatagataagggcactaagactttgatgcccatggtaatacagtagcttgggtagaacgggggttagaacgtaggtctcccttggactccggaactcacatctctcctaactaggattgcctcagccaggaaatgaggaggggaagaagtgagagaaggcaaagagtttaactttgggtgcgtttgagataaaagagaagacagaagcagcaaccagcagagtcataaagtctatgggaggagttttaaaatggacagagaagttaacgataaatgccgaggtgagggcgagattaaaacagctgccagtcgtatttagtaacaagcccttcataattgtagccagtgagctcttcctgggctgttgtaggtagaggcctcagcactggaggtggatggacatcgtgtgtgtagcccgcattgagta

SEQ ID NO: 179654 - DNA, 621 bp, Homo sapiens
tccaagtgtttgcatgtgtatgtgtgagagtttgtatgtgagtgggggtgggtgtgaatgtgtgtacatgcgtgagggagtggggtggctgtgaagagtgtgagagtgcatgtgtgttgtgcgtgcacacacgcttcaggaggatggtttccactgagagagtctggggatgagtggagagaaagttccggtgggatcagaaggttcctgcctctcagactgcaagtttcagccctgtgtatttaatacatttcacttcctgtatgaaatacacacacattcgtgataaatagctgaacaacctctgctggtggacggctcccgggtttgggggatttttaaaatcagaaactgaggctcggctgggcgcggtggctcacatctgtaatcccagcactttgggaggccgaggcagatggattccgaggtcaggagttcgagaccagcctgaccaacatggtgaaaccccgtctctactaaaaatacaaaaattagctgggcgtggtggcacgcacctgtaatcaagcaggagaatcgcgtgaacccgggaggtagaggttgcagtgagccaagattacgccattgcactccagcctgggcaacagagcgagactccgtctc

SEQ ID NO: 179655 - DNA, 732 bp, Homo sapiens
cctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacag

SEQ ID NO: 179656 - DNA, 1026 bp, Homo sapiens
cctgtgctctggggaccgctgcatcctcaggctgtggactaggaagctgagggtcacccagacaagaggaggtgctggaggtcacacagtgaatatgcctcgctggccttcctgtctggcgtgtcttcctctgcccccatccagggaggatcacctgagcccaggaggtcaaggcttcagtgagctgcgatctcactgtcaggcctctgagcccaagctaagccatggcatccccggtgacttgcacgtatacgcccagatggcctgaagtaactgaagaatcacaaaagaagtgaaaatgccctgccccgccttaactgatgacattccaccacaaaagaagtgaaaatggccggtccttgccttaactgatgacattgtcttgtgaaattccttctcctggctcaaaaagctcctccactgagcaccttgtgaccccccactcctgcccgccagagaacaatccctttgtaattttcctttacctacccaaatcctataaaacggccccacccttacctcccttcgctgactctcttttcggactcagcccgcctgcacccaggtgattaaaagctttactgctcacacaaagcctgtttggtggtctcttgtgagctgcgatctcaccactgcactccagcctgggcagcagagcaagaccctgtctctaataaatcaataaacatcctctcagcagttctatgagtgggtgctacttttatccccacttcacagatggagacactgagctcatgcaggagagactcctggcagcaagttaggggcaaggcataaaccaagatctcagccccatcagcgggtaaggactggcgcaggaggcagtcctggcattttcaggcccactcccttcagaaagtcaagtgtgggctcctaccaattgacaatgccagggcctagtaggaaagaatacatgggccaggaactgaacgttgcgaggaagaaaatacagaaggcgctgggcgtggtggctcacacctgtaatcccaagagtttgggaggcca

SEQ ID NO: 179657 - DNA, 507 bp, Homo sapiens
cccgaacatgtagaggctaatttttttcgtatttttagtagagacagggtttcaccatgttggttatgctgatctcgaactcctgacctcgtgatccacctgcctagggctcccaatgtgctgggattacagatgtgtgtcaccacgcctggctagtttttatatttttagtagtgatgggctttccccatgttggccaggttggtcttgaactcctgacttcaagtcatccacctgcctcggcctcccagagtgctgggattacaggtgtgagccaccgcgttgccagttatttacattctaagtgtcttttctccattacatcaggctttatttatcctctttttcctgtaatgcttagcacattgagtggataattagtaaaaaattttttaaaggagagtggccagattcattcaacaaatgtttattaaatgtcacaatgttcacagcatgattctaggccctagaattggaaggtcgcctcaaaaacatgaaacagcaggt

SEQ ID NO: 179658 - DNA, 523 bp, Homo sapiens
actacataaaaaaacaagttacaaaatagtatgtgttatataatcttatttacgtaaaaacataaatatgggttttttaaatcaattacttaaattttaaatttttttaggagacagattcttgctctgccatccaggctggagtgctgtggcacaatcatagctcatacagcctcaactcctgggctcaagtgatcatcctccctcaacctcccaagtagctgggactacaggcacatgccaccacacccagctaattttttttttttttttttaagtttttgcgacagtctccactgtattgtctaggctggtcttaaactcctggcctcaagtgatcctcccaccttggcctcccaaaatgctgggattgcaggtgtgagccaccatgttcagccatcagttagttttctaaacaaacaaacaaaaaacctcagcagcaacaacaacagatttccttgtagtttactttgttcatttataacttatgctgcccctatcatccaaggctgttattaaaaaa

SEQ ID NO: 179659 - DNA, 396 bp, Homo sapiens
agataggttatgcattttcacattcatttcattcactgtttgaaacgaaagaaattgatctataatgaattcttcctgatttatttatagaaaagacaattctgctacactctttaggagcataatattcctagtgatagagcatttcatgttaaaatgaattatttttgaccaagtgaggtacatttctattgatacaagtcatgcccctaaaagatagatgttatacagagtagcagtgaattaagaaatgtttcctctaaaagataaatataaaatttccaccatttgataccctaaacagtttaattttaattatagaatgttcatctacaaagtatctagaggaggcttttgctttattccatttctgccaaacaagagaaaatgtactga

SEQ ID NO: 179660 - DNA, 610 bp, Homo sapiens
ctcctcgaatcgacggtttctctctctttcttttgaattgagacagagtctcactctgtcatccaggccagatggagtgcagtggcatgatctcggatcactgcaacctctgcctcctgggttcaagcaattctcctgcctcagcctcctgagtagctgggatcacaggtgcctgccaccacacccagcaatttctgtatttttagtagagatggggtctcaccatgttggccaggctggtctcaaactcctgacctcatgatccgtccgcctcggcctcaaaaagtgctgggattacaggcatgagccaccgtgccagcccataactgcctgtttagaaaattaactttgctacttcattcaacctcaggggacaagaactacaaagagatcagtagagcttaaaccccattaatggagtctctctgaatctattctggttgggggatggaaggagtgtctgattcaaagtaataatttaaaagacaccttaacaagagagattactgaaagagaggaagaaatggatccccaggagccttgtgagatgggaacaaggctactattcacttatctctgaaatgctacacaacactgagaaggacctggg

SEQ ID NO: 179661 - DNA, 663 bp, Homo sapiens
agggcagagtgagccgtgtctctgtttgtcacgctctgcagggctggcaggatctacgcattgtgtatctttcagtgttctcactttcagtatttgagtaaatgagatggagttactgctctgttctgattgggtagtgcctgctgggaagaactgcccctgaagccatcggggcctgggtgtgccttggggaagaggtggcacctccataatttgtcgttggcccaattctacgtcaagcagcccaggtgccgactccagatcagcggcttagttttcctgagggacagaccgcagccatatcagctaccaaacaaagaaaatctaaaatatgaaacaatactctcaaattaagtaagttgtcttcagaacagccatgtgtgagctcgccactgtacacaaagcaggtggcttttcttcctctgagaaactccatggagggctgatcttagtgttcagtcacctgatggtgatatccccgggtatacaaggccgcagcttcccagacagatcatgaaatttgaatgcaaaaattaacaaaacattcaagtatgtaaatcagcgtatgattcatggggatgccagcgctcctccgctgaagtatttcagagcttacgttctcgatgatcacgtgttgctctctcccttgttctccttgcttcc

SEQ ID NO: 179662 - DNA, 235 bp, Homo sapiens
aatcagatacttaaatctagggtttcttttggaaagactcagggagaagtttgggacttgaaggtgagaacacattaactgtaatttcaaaccattaatgcttatgtttagttagtcaaatatgaattttacttatagttctggatgcttctaaaatatggtatttataaagtcaaatttgtttattactgcagtttactggggaaggatttcaacatttcacaaatgagtatgg

SEQ ID NO: 179663 - DNA, 362 bp, Homo sapiens
aaacttcctctcactcccatggattgagaaacagtatgattagattatagttattattttccttatgaaagacagaaagggggctgggtacgggggctcacacctgtaatcccagcactttggggggctgaggtgggcaaatcatgaggtcaggagtttgagaccagactggccaacatggtgaaaccccatctctactaaaaatacaaaaaactagccgggtgtggtggcgtgagcctgtaatcccagctactagggaggctgaggcaggagaatcgcttgaacacaggaagcagaggttgcagtgagccaagatcgagccatggcactccagctcgggtgacagtgcgagactccgtctc

SEQ ID NO: 179664 - DNA, 552 bp, Homo sapiens
cgaacatctcgtggctttgaatgcagccactctatctgccaacttgaacacagttttgttctcccctgaggtgacagattgaatatgtcacacaagtaagcaagtttttttttttttttcgagagagtctcgctctcttgcccaggctggagtgcagtgaaaaatacagataaaaaagaagcagagctgggcacagtggctcatgcctgtaattctagctactcaggaggctggcaggagaatcacttgaacccggagggcagaggttgaagtgagccgagttcacaccactgcactccagcctgggtgacagaaactctgtctcaaaaaaaaaaaaaaaagaaatcatagtttactttagggaattctagagattcttatgaaatatttgtttttatgtatgtagagtttaaacatgtaaattacattaaagatagtatactccacccttatcccagtgaaatgatttcatatttttcttattatggaaacaattattacatttctttgctcctaaagaaaataaacacttgagaccacataccccacata

SEQ ID NO: 179665 - DNA, 302 bp, Homo sapiens
gaggcatctgctcagtccgggtatgggaaggtggagaatctggcttgagacctttctgaagaaaggagaaacaagtattacaccaagaatcttagctggcatgacagattgcaacagtaaaaactgaacccaaaacatagagctgattcttcctagctgctgattgtccccatgggacttttgctgagtttccagaagaagcagtacaggaagctggaggtggggttagaaaggcagagagagatttccattaactcctggtgcttaaaatccaaagtcaagctagaagaaaaagcctataa

SEQ ID NO: 179666 - DNA, 910 bp, Homo sapiens
  misc_feature (3)..(3): n is a, c, g, or t
  misc_feature (7)..(8): n is a, c, g, or t
ggnacannatcatcaactgggcacaaagtaagggactctgtgtttctgaatcagaagctaccactacatgccagatttgtgacctctgccaaaagttagcctatttgtctcatggtgaaagaggccatattgcactgagtgttgactggctgcagagtgttgactggctcctggtaaattggtgacatcagacctttgacctcttccaagctattccactggtatctcattcctgttgactttttctcaggtaatggttttgctgttctagtctgatcagccaattgtggccacatcattgtggcccttgaaactaatctgtgtcatgattttggctttctggatggtgataatactgcattttttagtgcaaaaactcatcaacaatgggcttatagtcaaagtatttggtagccaattcattatcttcagactggtggtaccattgagagatggaataaacttttaattaaaaaacagcttaattgagatgtaattcacatatcataaaattcaccctttggaaggtttttagtttattcacagagttgtgcaaccatcctacagtatgtagtctttgtggctggcttccttcacttagcaaaatgttttcaaagtttatccatgtgggccgggcgcggtggctcacacctgtagtcccagcactgtgggaggccgaggtgggcagatcatgaggtcaggagatcaagaccatcctggctagcgtggtgaaaccccatctctactaaaaatacaaaaaattagccgggcatggtggtgggtgcctgtagtcccagctacttgggaggctgaggcaggagaatggggtgaacccaggaggcagagctttcagtgagctgagatcgcgccattgtactccagcctgggcaacagagcgagactctgtatc

SEQ ID NO: 179667 - DNA, 501 bp, Homo sapiens
tgctttagaaggccaagacaggtttctatgtatttgtggtgcttggggaagttgtcagctgacctcttctatgttcccatcatccatggcacctaacacattggcttgtacatagttggtcctaattaaatattaataaatggctgactggcaatcaataaaagttatacacagctctatttgattcattacacatagtcagtggattctttcccatttattgctttttattttgtaagatcaaaaggatctgtaatctgagacactgtaagcagttgtgttgcttttcatcttcaggcctgcacttcctataaagccagatgctgtgaatattgacccttttcacagctatgcttagaaactgatatatatatacagtttgcatgtgcagaaataatgttctacttcaaaagacagcaaagaagtgcctttctggtccatatttagtttgttttgttttctctgtagttgttgaggcttactccttcccccgacagttga

SEQ ID NO: 179668 - DNA, 274 bp, Homo sapiens
gtttcctacctgtgctgactggtcagtgaaccagacctgcagatgaaagaaggatgaacccgtaactgatgtcaaagccctcttggaggttttttcttccagcatttgagtcaattcagccagccctcgctactctcttggcaaatgaactctacctgcacattagtagatacataaaagaaagagaaaaaagatagggagggaagctacagactcatctatgttagctgaacattttcaaaggaccttagcacaagatacaaaacaaaaatgc

SEQ ID NO: 179669 - DNA, 387 bp, Homo sapiens
cgctgcatggtacagggtttcctgagaaaaggcgcccatgtctgccccgtctcaggcaccacccaaaagtttggaactctcagggatctctgagcagggcctcagagattgattggggttggatcagtttagcccagttagcgatgcagacgttcctggaatctggcctccagggtgacaaaggagagcttttggcctggctcccagcggccgccttccttctgagtcatcccctaggacaagagtcagtttccgacaaagctgcggctctgacaaggggcccatctcctgttgactccaaagccgctgacccacacccctggagggaattgtcccagaggttaaggactcacagtgaggacacaacagtatgctcacaggtcctat

SEQ ID NO: 179670 - DNA, 307 bp, Homo sapiens
acaggaaaatgcacaaattataaatgtacagcttaatgaatgtttacaaatttaacacccatgtaatcgccaaccagaataagaaatagatcactggaaccgtagaaacaagcgtgagtttctttccccactgccttacaccctcgaaagtaatcattattctggcttctaacatcatatattagttttgcctgttattgtgctttataaaatggaatcatatagcatgtactgttttgtatatagcttgttttgtgtaactttgtgtcagtgagatacatgttgcaacgtgtatggtatgttctca

SEQ ID NO: 179671 - DNA, 717 bp, Homo sapiens
tgtatgaatatgtgtgtgtacacacatatactaaacattctgtcaatcagatttttcatgaattcagactagcctactcttccaatccattatttttaaaatgcatgttcagaatacattgtttcattttttgttttagtttgatttcctcacagcttggtgtaagtgaatggcacacaaagcatcctgccttccagagacctattattatcaaacatctgcattgtcatactaaattttagtaagttctaaaccaaaaagcattcaaggatagattcaaatggggatctaacttagatgcagaagtgggctgaatggtatgtgtctctgtgtaggtcataattaggctgaaaaaataatcagtagagttaactaggcaaagagagagagagagagaaataaatgtctaggcagaggcaaaagcatgtgaataccctgaggtgagaaagatattggactgttcaaaaaaccaaagaacacaggtgtgcaggagtgaagcatgatgagaacgcagaggtgggcaggaaccagctgaacttgtgggcctggctgtttatgttaagatacttggattttattcaagaaaaatcattctggctgctgtgaagatactgaattagaggaaatcaattgggaataccagttaagatataaaattatcatagttcaaacaagagatgatggtggcttaaataagggtggtggcagtggagagga

SEQ ID NO: 179672 - DNA, 316 bp, Homo sapiens
ggcagataggatccatacgttataatccaagattaatgatagctggactatgagaaagtgaaggtagacatagttaattaagaagagtaacatccatagcattatatttgacatagttacagttgatagatttatagacttctagagttcaaggaaccgaaaattaatctaattcttttctccccaactaggtgaggaaagtctgctggttcatcatgactattccttggcaattaagagctgagtatataaccaacgaaatccatagatccaaacaagttccctaaccatttagcatcccctatcaaaagtataa

SEQ ID NO: 179673 - DNA, 435 bp, Homo sapiens
caacccccttttccttacagtcaatcactgtccagcccccagatcccagcctcaaaatctctcccttaaatccatccatggctgcaaggctagtatgggagacagctttgaacctgactcctatcgccttgcttggctgcctggcaataaactttctcactgcaaaaacacagtgctttggtgtttggctttccattgcttgtgtgcagacagacacagtttggtttggtcacaacgtgttagtaattttcagcactttattctttgccctttcccatattttaactctatactttccatgagctacttcccaggggtatgctcatccaattgccaaacttaactgctctaactattctatctcctgcatgctaatggatctcaactctgcatttctcaggctctaagctacagcttcaatcaccttctcaatat

SEQ ID NO: 179674 - DNA, 688 bp, Homo sapiens
  misc_feature (382)..(382): n is a, c, g, or t
  misc_feature (395)..(395): n is a, c, g, or t
  misc_feature (483)..(483): n is a, c, g, or t
  misc_feature (528)..(528): n is a, c, g, or t
  misc_feature (545)..(545): n is a, c, g, or t
  misc_feature (603)..(603): n is a, c, g, or t
  misc_feature (648)..(648): n is a, c, g, or t
  misc_feature (650)..(650): n is a, c, g, or t
  misc_feature (653)..(653): n is a, c, g, or t
  misc_feature (663)..(663): n is a, c, g, or t
cagcagcagcggcgtggtcagagcgagcttcggagaagcagtggtgggttccatgtgatggtggagtaggaggcaggtctccgcggtcatttaccatgctgtcctccaggttcaacagtatggctccaaatgatgaaatttcattctgattttctggctgaagactattctctttgtgtatgtccaccacagttactttatcccttcatctgtggatgggcagtctcgctgttttgcccaggctggagtgcagtggcatgatctcagctcacagcaagctctgcttcctgggttcacgccattctcctgcctcagcctcctgagtagctgggattacaggcacccgccaccatgcccaggaaagaaaaaagaagaaaaaaanctccatacgagantgggtctaaaggaacttcccaaactccatgattttgcaggaaacaagataaagctggttggtggagaatttgaactggagatgaactntattatccaggatgctgagagtataatacgcatgacagagctttnagagcactgtgatgtancatgtcaagcagaaatagggagcatgttacaggcattctatgaaaaaagtgtttggantgtacagactagcaacagaaggttgggctaatttaaacaagtatngntgnaaatgagtgntgtaatgacatgagaagaggtatgg

SEQ ID NO: 179675 - DNA, 905 bp, Homo sapiens
  misc_feature (599)..(599): n is a, c, g, or t
  misc_feature (612)..(612): n is a, c, g, or t
  misc_feature (700)..(700): n is a, c, g, or t
  misc_feature (745)..(745): n is a, c, g, or t
  misc_feature (762)..(762): n is a, c, g, or t
  misc_feature (820)..(820): n is a, c, g, or t
  misc_feature (865)..(865): n is a, c, g, or t
  misc_feature (867)..(867): n is a, c, g, or t
  misc_feature (870)..(870): n is a, c, g, or t
  misc_feature (880)..(880): n is a, c, g, or t
cagcagcagcggcgtggtcagagcgagcttcggagaagcagtggtgggttccatgtgatggtggagtaggaggcaggtctccgcggtcatttaccatgctgtcctccaggttcaacagtatggctccaaatgatgaaatttcattctgattttctggctgaagactattctctttgtgtatgtccaccacagttactttatcccttcatctgtggatgggcaggtaagtttattccttatcttggcgaatgtgaatagtgctgcagtccacataggatggctgatacctcttgcataaactgatttctttggcactgaaagtatacttagtagtagaattgttagatgaagtggtagttgtaggtttaatttttggaggaacctcccactggtttctgtagtatgtatactaattaacattcttttttttttggatggagtctcgctgttttgcccaggctggagtgcagtggcatgatctcagctcacagcaagctctgcttcctgggttcacgccattctcctgcctcagcctcctgagtagctgggattacaggcacccgccaccatgcccaggaaagaaaaaagaagaaaaaaanctccatacgagantgggtctaaaggaacttcccaaactccatgattttgcaggaaacaagataaagctggttggtggagaatttgaactggagatgaactntattatccaggatgctgagagtataatacgcatgacagagctttnagagcactgtgatgtancatgtcaagcagaaatagggagcatgttacaggcattctatgaaaaaagtgtttggantgtacagactagcaacagaaggttgggctaatttaaacaagtatngntgnaaatgagtgntgtaatgacatgagaagaggtatgg

SEQ ID NO: 179676 - DNA, 684 bp, Homo sapiens
gctcctgctgcctcgtttccccagagacccagtccaagctcttgcaagagtgctctctggggttcatgttttataaacgcagagtgaaccccaggtctagcgccagtgtgcccattctgtcctgagatcatttatttctagtcaccgaagcgttcccgcctcgttcctttattcactcactcattcagcaaccctgaacaccgccagtgcactgagccccaagctggatgcgggaactcagcggtgaaacatgattcccttgccttgcggcagccccgtgctcacagagaggacttgagtttcgggtgccagttgtctctgccaagttaggagtcagggactgacctctgtgacccccacaagctgcagccctggctgtgttttccacactggcctggggcccatgttcattggctgaggaacctcttggacctcatctctgaggagcaccgcctggggccctgggtgtgtgtcccgcagcatggcgcggggtgtgcacgtgcgtgtgtgcgctcacacgagcaccggctgccgcctccccgcctgtctccaggtgccatgtgtggaggggagaggctgggcgtcgctgcctgcagcactggctctgagccgttggccaagcctctccattttccttccccatcactctgtagaccctcctcactctttctgttcctgttctgt

SEQ ID NO: 179677 - DNA, 261 bp, Homo sapiens
ttccccagtggcatagagaagatatactgttcaacctaagctttgtaatgaacaaggtaatattttacaccaacccttggagtgcattactaacagtaaacaaaacaaaatcattcacttcttttttggtaaagaatgtgcactgtggttaaattcacaggcatcccacagcttcatgcttcagggttgcaccctaaacatggaatcatacaaataagaagaaacaattgtcactgtgaaaaattcaatcttcaatataca

SEQ ID NO: 179678 - DNA, 871 bp, Homo sapiens
ctggagccctgtgcagtgaagtagcaggcagtcaaggatattgaaaggtgtgcaggctgtcccagaccccacgcccagaaggccattcagagaccaaagaacatgactaactccaaaatgaagataaaaactacagttcagctatgaatgttttccgtctaaacactcaacaccatactactactttgtgctgtttacaatttcctagcctgctattaaataaaaggttccataaaagggggcaacagcccagaaaacaaaccatattgttgaagttgaacctctgcccatcccagaaaaccagcttgctggagaaacctgtgccatgtcccactgcagcctgggggtgccacggtgtgtgtctggtgtctatgcatactgtatccctagcacctcatggcactgggcatctaacaagagcccagggactagagacaggttcccgcatctctctcacggatgcacttgctgttgctagctcatgtggcctcctgaccctcgatttcttctatcaatacactaggctttctctgccgggaataccttgttctccaagacactccatctggctaaaatctttccttcaaaaggctttccgtgtgtcctccatttttgctaatttcaagcctgccttgggtggctttcccaactgttgctgtggccagaatttgccttatcacaatcacagggtatctacttaatgctgagaaactagatgctttccccctgcatctggaacaagacaagcatattcttactactctttttcaatcatacttcaagtccgaactaatgtaataagacaagaaaaggaaatgagagaggcacagattgggaaggaagaaataaaactgcctttgtgggggctgcg

SEQ ID NO: 179679 - DNA, 572 bp, Homo sapiens
ctggagccctgtgcagtgaagtagcaggcagtcaaggatattgaaaggtgtgcaggctgtcccagaccccacgcccagaaggccattcagagaccaaagaacatgactaactccaaaatgaagataaaaactacagttcagctatgaatgttttccgtctaaacactcaacaccatactactactttgtgctgtttacaatttcctagcctgctattaaataaaaggttccataaaagggggcaacagcccagaaaacaaaccatattgttgaagttgaacctctgcccatcccagaaaaccagcttgctggagaaacctgtgccatgtcccactgcagcctgggggtgccacggtgtgtgtctggtgtctatgcatactgtatccctagcacctcatggcactgggcatctaacaagagcccagggactagagacaggttcccgcatctctctcacggatgcacttgctgttgctagctcatgtggccactcaatacctgtgtagacacagttaatgtttctggttatgacagataagtttgctcaaaaaatgtggatgaaccggtaccgg

SEQ ID NO: 179680 - DNA, 381 bp, Homo sapiens
gggaagcaggcacacttggtgtaactttacagaaatacatcataatttctgtctgacatttttgctttttcattcctctaaaaatatttccagagcaggatgcagtggcacacctgtaatcccagcttcttgagaggatcactcgagttctggagttcgaggctgcactttgctgtggttgtgcctttgactagccagtgccctccagcctgggaaacatagcaagaccccatctcttttaagaaagtgtttctggccaggtgtggtggctcatgcctgtaatcccagcactttgggaggccgaggtgggcagatcacctgaggtcagcagttcaagaacatcagggctaacatggcaaaactccttctctactaaaaata

SEQ ID NO: 179681 - DNA, 166 bp, Homo sapiens
ttcctcagcaggtctctgagtggagtaggcagggccatggattggtactcccaccaagtgaaaggaagagcaaagggcagggcagttcccaaatggaaaaaaatcttgggcagacagaataaatgacagatatctgctaaaagagaaaccagtttccaatatggaa

SEQ ID NO: 179682 - DNA, 283 bp, Homo sapiens
gaagtctgagccagtgtttcatcatcgttcttgctctgcctcggtctgtacatctgtgaaatgggactccctctctgttgtggaggccctggggacagctgggaggactggaggggtggtggggaggttgtggtccttattagacattcagatacccaggtcccaaatctggtccagccctggtaatcctgatgcagagggtccacaaccacatttgggaaatgttgacctaatgcacagcaggaaagcactttcatttgctaagaagtttccatatgaaggg

SEQ ID NO: 179683 - DNA, 221 bp, Homo sapiens
tggcctgacctagagttaccacgtagcccacctggacatgggggtctcactatgtgttgcccaggctggtcttgaactcctggcctcaagtgattctcccacctcggccttccaaagttctgggattataggtgtgagccactcactgcgcctgagctgttttgctttcgggaaaattttctctgatgcaaccgaaatcttcatgagagcaggggacactt

SEQ ID NO: 179684 - DNA, 136 bp, Homo sapiens
aaaccacctcttctctgagctaccgtaacactgccttctgggtggtcatgtcatccacatgggtacccatgtcgtccactctctgtttcaggtaacagatctagttgtcctgaccacctaacagtcacctaccttg

SEQ ID NO: 179685 - DNA, 443 bp, Homo sapiens
tctaaaaagcaatctacagcatttcaagtatgtgggatgctttttcatgtttaattcgtaaggaagaattagcatgtaaataggtaattaagaaaaggcataaaaggctatgattgaaactaatacatttagaataaaaataaaagttttttcctatttcttgcagcatagagaaataactaggatagaacatttatatatctgagaaagaaatcctgaggctgtgaatttgtaagttgtgtttccttacagcttacaatttcccctttaaaacacaggaagaaaattaaatgatcccttcaaaatctcagtaagactgaatgtacatctgatgtgtagcaaatgtcattacattgataggcagatacatgtgactggctgtgctcattcattccatacaggacttgctttcttccataccagttttgcaggacctgtgattc

SEQ ID NO: 179686 - DNA, 555 bp, Homo sapiens
tgtcaccaagccactctttggggatctgctccatgacctaaacacctcccacttcaggactcacctctaacactgggaatcaagtttcaacatgagatttggaggggactattatccaaactatatcagtggtgtagcttaaaaatccatgctgtcttagacttaaagaatcacaactacctagaaaaaagggtaattaggagaaatcagagtaattacttatgattgggaaattataaaagattccatagagtggacatttaattgtccctcaaagatgcagaggaatatgaagcacattgtaagtattaataaatgagattcccacagaacctctggtcagtaaaaacaaacatcagccaaagagcatcggtaaatgccaataagaactcctgcataagaattgatttgcaagtttagaatcctattaatcaaaagaccaagaagccacttacctaaattactgtttttatagattgtttctttgcatcctgtttgttgtgtcaacaaaacttttctcccagcctggcacgatggtccacacctgtaatccct

SEQ ID NO: 179687 - DNA, 467 bp, Homo sapiens
ggacagtgccagggagatttacacaaagctacatccagccctaccacgaagatcacgggcacacggtcacaatcgctcctgtgctcatacttgacctgcgctttggaggaactcaagataatttactggggatatattttactttcagaggcatctggtcatctctaagagttgccttccttaaaatgtcctcttctggaatacggggcgaggtgcttggtgcttacaagctgaggtcagcatttttttgggagatggaacctgaggtcaatttaggagcaggggtctcatcctctgctaaccagctccatgacttcggataaccctcttacctttcctgagcctcagtttcttctgtaaagagacaggtgctaatcacctaacagctcataggttctgtactcatatccaaagatggtaaaggtgaaactgttttgtaaagaaagaggatattcagaatgttagtt

SEQ ID NO: 179688 - DNA, 247 bp, Homo sapiens
gtcattctccactaaaaggaaccagggatccctaaatggctgattacagaaccaaggcatggaaagtacaagatgagccaggaacaggttcttgtgccaaaaagtacaaagttgttctcaaagagtgatggggatgtaccataagaacacagaagccagcttgtacaactctcattggccatataaagaacaatttgaacatcaaaataaataatgctatagtctgaatgtgtatgtcccctcccaa

SEQ ID NO: 179689 - DNA, 233 bp, Homo sapiens
gcctatctatagtaggagaaggctgtggtaatggtaatttttaatgttactgccttttaataaaattctttccttaaaaatatctcacagacttatttttctgaaaaagcttgactcaaatacatttgtgttatgataaaatttataaaccaataatctttttttttcttttttttgagatggagtcttgctctgtcacccaggctggagtgcagtggctcaatctctgctca

SEQ ID NO: 179690 - DNA, 147 bp, Homo sapiens
gcagactctcctccctcctctgaggagcacacctcagctgccctacatattctctgctacaactcttctcctcatcatgtaattaagtctccattaattcaaacactctgtaagggtttggcattcacttgtttgtaacttcacata

SEQ ID NO: 179691 - DNA, 364 bp, Homo sapiens
tggtgatcctagtaaaagacagcaacattgatgggggagagcggcacttctgttaagaagtatagtgcagcaatgtgaggaggcatctaagagaaataaaaaacaacaacaacaaaaatgcctacattccactgaactacaaatattattcaagagaaaacttgacagtctttgcctcataaataattagcaattttgtcacccatttttgcatgttatcattaattaggtattgtggattgaatgtctgtgttcccccaaaattaatatggtgaaatcttaaccccctatggtttttggagatgaggatttgggaaggaaattaggggttatatggggtcataagggtggatccctcatgatg

SEQ ID NO: 179692 - DNA, 372 bp, Homo sapiens
cacacacacacacacacacacacacacacacacacatatatatggagagagagagagcgagagggagagagagataagtaaagcattcagaacaatcctggccagagtagatgcttaagatttagttgttatttgctgttctacattaggcctgagctggtgggaatgtcacattcctcatctttggtctgattctctgtggcaggcacttgccttcccaggaagcactaagcatttggctttgcagagattttacctcctatctctggagaaggcgccgccttggattctgggccacctggattgctaaagcctggggttaggtgctggagaggagaataaacatttatggagcagctaccaggaggcaga

SEQ ID NO: 179693 - DNA, 603 bp, Homo sapiens
  misc_feature (568)..(568): n is a, c, g, or t
tacacatttataaaataacaaaattattttcaagctttgtataatttctttttgctatagtcaaaattgattccatatttctaagaagtcatgtaatctaataatgtataattactattcagatcaagtatattatcaaatagcaaacagcagttcatagattttaactgcatttggggaagggaacttttttttttaacattaactgttggctacagattttaaaatgcaggtcaatttccaattatctagataaatttggaaataaattacatgaagtgtaaacacaaataattcttacactttaattcatgtactggcttttttttttttcccccctgagacagagtttcgctcttgttgcccaggctggagtgcaatggcgcgatctcagctcactgcaacctccgcctctcaggttcaagcgattgtcctgcctcagcctcccaagtagctgggactacgggcgcccgccaccatgcccggctgattttttgcatctctttcaaaggaaatcccctgttctttcaatgatgtgcaaggccctaccttctctagcccctatccntatccctaccccttaactttctgacctcagcatca

SEQ ID NO: 179694 - DNA, 648 bp, Homo sapiens
ccagatgacttgcatgtttagctagatccagggtcccttctcattctgcatcttaacgtcacctggcaacggagttagacagagttgatcgctttgcctcctccttgaaacatttcctcctcttagcttccaggataccacatcatcttggtgtcttactacctaactggtcattcctttttagcatcctttcctgggtcctcctcttcagcctgagagtgcccaaggtggaattcagtgatctctcatcactgtctgtaaatagcatctctgtgctgatacttacatctccagccagacctctctctggagcttcaagctcctgtaatgcagctgctcactcagtagctccgctggcatatcttaaaagacatttcaaacataacgtgtccagaaccgaacagctgatcttcctgcacaaccccgccccaaccatcgttttcctcacctcagctgatggcagctccatcctcactctgacaacccacattgactccatcctgaaatcagactgtgccacttctcaaaaccttcccgttttaccatgaatacaagccaaggtggccatgccttgccactgcaagctctgtgttctcctcacttcctcctggctccctccacccttcccgggtccttgctgccactgga

SEQ ID NO: 179695 - DNA, 556 bp, Homo sapiens
attttccggggcttcaaagcaggcagtctttgtgtgagtaaatattgagccaatgctaagagtaaaatgagctattaagttctatttgctactttcatccccaggctcataacagagcgtaagctaaacaaagaaaaacagcactccgctggacagaatgatattcagcaggtagactcatttctgtaggcacttctcacatcagtgatttgcttctccaacattggcaaatatttgccacttacgtctttcatgtaatgtgaagaaagtacattccactgtcttccaaagctatcttaactgccttataaaaacaggcaatttactggcgatgttttctcttgctactaaatacaaatgcagtcatcgtttaactttgaaagctctgcatttagctttttggttttagatttgatatttacatagaattataaagaaagaaaaaaacccacagtcccctcaacctaacaaaatacttgatttttacgtgctaaaatctagccctacatactcccatcttcctacaagtcttgaaagctttacttttaagtgtgat

SEQ ID NO: 179696 - DNA, 254 bp, Homo sapiens
ctccctattcgcaataatctgcttgtgataaattctcaaaaaccttgttaatgaaataatctgatgatcaaaggcaatctcatccaattgtgtaaactgtatcatcaatcacaaaaacatctaaatgctatcaaaaagagctggaaataaatgtaagctagcagagaaaaaatgcttgaaataaatacgggatgtatgacaaatgttacactttaacagatatatttcattttaatgtatatgtatcttctttt

SEQ ID NO: 179697 - DNA, 302 bp, Homo sapiens
gactttagccaagtccgggaggacctgcctttcaggggctgctaaagaatggtggagacatacatggtaagactgaaagcatttggattttcttcacaattcaacacaattctcctatagtagtcattaaactctgaccaggttaccagattggtagttttcagcacactgaaattcttagttgctgagatttatgaaagccatattgaaagacattgaggtatggatttgcctatagagcaattattaatatatggagatttctcttatagtaggcctgagtcctcttctgacgcacagag

SEQ ID NO: 179698 - DNA, 4308 bp, Homo sapiens
  misc_feature (1571)..(1571): n is a, c, g, or t
  misc_feature (1699)..(1699): n is a, c, g, or t
  misc_feature (1978)..(1978): n is a, c, g, or t
  misc_feature (2010)..(2010): n is a, c, g, or t
  misc_feature (2154)..(2154): n is a, c, g, or t
  misc_feature (2313)..(2313): n is a, c, g, or t
  misc_feature (2458)..(2458): n is a, c, g, or t
  misc_feature (2926)..(2926): n is a, c, g, or t
  misc_feature (2961)..(2961): n is a, c, g, or t
ctaaagcaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179699 - DNA, 4336 bp, Homo sapiens
  misc_feature (1599)..(1599): n is a, c, g, or t
  misc_feature (1727)..(1727): n is a, c, g, or t
  misc_feature (2006)..(2006): n is a, c, g, or t
  misc_feature (2038)..(2038): n is a, c, g, or t
  misc_feature (2182)..(2182): n is a, c, g, or t
  misc_feature (2341)..(2341): n is a, c, g, or t
  misc_feature (2486)..(2486): n is a, c, g, or t
  misc_feature (2954)..(2954): n is a, c, g, or t
  misc_feature (2989)..(2989): n is a, c, g, or t
ctaaagcaggagttctggacactgggggagagtggggtgacatgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179700 - DNA, 4198 bp, Homo sapiens
  misc_feature (1461)..(1461): n is a, c, g, or t
  misc_feature (1589)..(1589): n is a, c, g, or t
  misc_feature (1868)..(1868): n is a, c, g, or t
  misc_feature (1900)..(1900): n is a, c, g, or t
  misc_feature (2044)..(2044): n is a, c, g, or t
  misc_feature (2203)..(2203): n is a, c, g, or t
  misc_feature (2348)..(2348): n is a, c, g, or t
  misc_feature (2816)..(2816): n is a, c, g, or t
  misc_feature (2851)..(2851): n is a, c, g, or t
ctaaagcaggagttctggacactgggggagagtggggtgacatgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179701 - DNA, 4223 bp, Homo sapiens
  misc_feature (1486)..(1486): n is a, c, g, or t
  misc_feature (1614)..(1614): n is a, c, g, or t
  misc_feature (1893)..(1893): n is a, c, g, or t
  misc_feature (1925)..(1925): n is a, c, g, or t
  misc_feature (2069)..(2069): n is a, c, g, or t
  misc_feature (2228)..(2228): n is a, c, g, or t
  misc_feature (2373)..(2373): n is a, c, g, or t
  misc_feature (2841)..(2841): n is a, c, g, or t
  misc_feature (2876)..(2876): n is a, c, g, or t
ctaaagcaggagttctggacactgggggagagtggggtgacatgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179702 - DNA, 4408 bp, Homo sapiens
  misc_feature (1671)..(1671): n is a, c, g, or t
  misc_feature (1799)..(1799): n is a, c, g, or t
  misc_feature (2078)..(2078): n is a, c, g, or t
  misc_feature (2110)..(2110): n is a, c, g, or t
  misc_feature (2254)..(2254): n is a, c, g, or t
  misc_feature (2413)..(2413): n is a, c, g, or t
  misc_feature (2558)..(2558): n is a, c, g, or t
  misc_feature (3026)..(3026): n is a, c, g, or t
  misc_feature (3061)..(3061): n is a, c, g, or t
ctaaagcaggagttctggacactgggggagagtggggtgacatgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179703 - DNA, 4176 bp, Homo sapiens
  misc_feature (1439)..(1439): n is a, c, g, or t
  misc_feature (1567)..(1567): n is a, c, g, or t
  misc_feature (1846)..(1846): n is a, c, g, or t
  misc_feature (1878)..(1878): n is a, c, g, or t
  misc_feature (2022)..(2022): n is a, c, g, or t
  misc_feature (2181)..(2181): n is a, c, g, or t
  misc_feature (2326)..(2326): n is a, c, g, or t
  misc_feature (2794)..(2794): n is a, c, g, or t
  misc_feature (2829)..(2829): n is a, c, g, or t
ctaaagcaggagttctggacactgggggagagtggggtgacatgagtgactccaaggaaccaagactgcagcagctgggcctcctggtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179704 - DNA, 3900 bp, Homo sapiens
  misc_feature (1163)..(1163): n is a, c, g, or t
  misc_feature (1291)..(1291): n is a, c, g, or t
  misc_feature (1570)..(1570): n is a, c, g, or t
  misc_feature (1602)..(1602): n is a, c, g, or t
  misc_feature (1746)..(1746): n is a, c, g, or t
  misc_feature (1905)..(1905): n is a, c, g, or t
  misc_feature (2050)..(2050): n is a, c, g, or t
  misc_feature (2518)..(2518): n is a, c, g, or t
  misc_feature (2553)..(2553): n is a, c, g, or t
ctaaagcaggagttctggacactgggggagagtggggtgacatgagtgactccaaggaaccaagactgcagcagctgggcctcctggtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179705 - DNA, 4286 bp, Homo sapiens
  misc_feature (1549)..(1549): n is a, c, g, or t
  misc_feature (1677)..(1677): n is a, c, g, or t
  misc_feature (1956)..(1956): n is a, c, g, or t
  misc_feature (1988)..(1988): n is a, c, g, or t
  misc_feature (2132)..(2132): n is a, c, g, or t
  misc_feature (2291)..(2291): n is a, c, g, or t
  misc_feature (2436)..(2436): n is a, c, g, or t
  misc_feature (2904)..(2904): n is a, c, g, or t
  misc_feature (2939)..(2939): n is a, c, g, or t
ctaaagcaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179706 - DNA, 4236 bp, Homo sapiens
  misc_feature (1499)..(1499): n is a, c, g, or t
  misc_feature (1627)..(1627): n is a, c, g, or t
  misc_feature (1906)..(1906): n is a, c, g, or t
  misc_feature (1938)..(1938): n is a, c, g, or t
  misc_feature (2082)..(2082): n is a, c, g, or t
  misc_feature (2241)..(2241): n is a, c, g, or t
  misc_feature (2386)..(2386): n is a, c, g, or t
  misc_feature (2854)..(2854): n is a, c, g, or t
  misc_feature (2889)..(2889): n is a, c, g, or t
ctaaagcaggagttctggacactgggggagagtggggtgacatgagtgactccaaggaaccaagactgcagcagctgggcctcctggaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179707 - DNA, 4032 bp, Homo sapiens
  misc_feature (1295)..(1295): n is a, c, g, or t
  misc_feature (1423)..(1423): n is a, c, g, or t
  misc_feature (1702)..(1702): n is a, c, g, or t
  misc_feature (1734)..(1734): n is a, c, g, or t
  misc_feature (1878)..(1878): n is a, c, g, or t
  misc_feature (2037)..(2037): n is a, c, g, or t
  misc_feature (2182)..(2182): n is a, c, g, or t
  misc_feature (2650)..(2650): n is a, c, g, or t
  misc_feature (2685)..(2685): n is a, c, g, or t
ctaaagcaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179708 - DNA, 3604 bp, Homo sapiens
  misc_feature (867)..(867): n is a, c, g, or t
  misc_feature (995)..(995): n is a, c, g, or t
  misc_feature (1274)..(1274): n is a, c, g, or t
  misc_feature (1306)..(1306): n is a, c, g, or t
  misc_feature (1450)..(1450): n is a, c, g, or t
  misc_feature (1609)..(1609): n is a, c, g, or t
  misc_feature (1754)..(1754): n is a, c, g, or t
  misc_feature (2222)..(2222): n is a, c, g, or t
  misc_feature (2257)..(2257): n is a, c, g, or t
ctaaagcaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccagccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatctnatacatgcaaacctaccatctgttcaacttccacctaccacctcctgcacccctttgatcggggacttactggttgcaagagctcattttgcaggctggaagcaccagggaattaattcccccagtcnaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagncccggctaattttttgtatttttagtacaganggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttantgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctnggtgaattgtgcctctcctggctctttgacatgtgctagtgagatttcttccttttcctttcggattccccatttcttttgtaggaatggtctggactagggttctccttccccgcagcctgtagtattcatcgtggtggcccancctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactcnactaaaagtacaaaaattagctggcgtgcaccacngcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagactgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaaaaaaaaaa

SEQ ID NO: 179709 - DNA, 248 bp, Homo sapiens
tgccaaggggctccccgccctgggccccatggccagcatcttcctcccactcaccaagcactcttctcccttctcaacccccttctctctgagtcctgctgagggcttgccttgtttatgaaagaacttaggccacgtggttagagaaaactcccagcaaacaccaccagggctcagtccccagggagggaggttcccagccacagttgcagtgctgacacttacctaccttgttctgtcttcctttc

SEQ ID NO: 179710 - DNA, 497 bp, Homo sapiens
cgatctctgtcttcctgtagttagacaataaaaattccttcatttaggacctactgtctctgaatctgtactcctgtgggcattcgaaattgagatttacctattaagtcaagaattacagtaagcaagaaagaagccaaaagccctcttcaaatgcttagtcacatggtttgccattttttttaatatgttaattacaaactactgatccatacctactcaattagcttttaagcactgaaaagtactttgttcaacatacttgcacatattccactgtgtgcctggtttatggcttttgaataaacaaataggtgttttcatacttccaggcaaagccagcagtggggcttgggtgggggcagagggtggcgtgtatgtgtctgcgtgtttaatcacagcgaagtataatacacaactgcctctctgaaatttacaaaaatgctcagacaacctcaattaagctgatttctaaaatacgcagacaaaaggaaaca

SEQ ID NO: 179711 - DNA, 757 bp, Homo sapiens
  misc_feature (22)..(23): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (44)..(44): n is a, c, g, or t
ataaaacagtggttccccgggnngcagaattcggcncanctncnaaaaaaaaaaaaaccaaaaaaaaaaaaaaatacaaaattagctgggtagggtggcgcacacctgtaatcccagctacacgggaagctgaggcaggagaatcgcttgaacctggcaggtggaggttgcagtgagccgagatcgcaccattgcactccagcctgggcaacaagcacaaaactgtctcaaaaaatagtaataaaaattttaaaaattagctaggtgtggtggcgcatgcctgtagcctcagctactcaggaggctaaggcaagaggatcactcaagcccaggagtttgaggctgcagtgagctaggattgcgccactgcactccagccttggtgataaagtgagaccctgtctctaagaagaacacagaaagagagagaacctagttctgactgcagaatccctggagcacagatgctcgctagaacaggagcagcacagccacagaatctgccaagctccagacacaggcagggttatgtgggcagagccagcctcagaggagttagtgtgattttgtcctcctggccttgttctcctggccaccctgcgagacacatggggtcatcccagttcacagatgtgaaaactgtccaggtgcagtggctcacacctataatcccagcactttaggaggccaaggcaggtggatcacttgaggtcaggagtttgagaccagcctggccaacatagcgaaaccccatctc

SEQ ID NO: 179712 - DNA, 698 bp, Homo sapiens
  misc_feature (22)..(23): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (44)..(44): n is a, c, g, or t
ataaaacagtggttccccgggnngcagaattcggcncanctncnaaaaaaaaaaaaaccaaaaaaaaaaaaaaatacaaaattagctgggtagggtggcgcacacctgtaatcccagctacacgggaagctgaggcaggagaatcgcttgaacctggcaggtggaggttgcagtgagccgagatcgcaccattgcactccagcctgggcaacaagcacaaaactgtctcaaaaaatagtaataagctaaggcaagaggatcactcaagcccaggagtttgaggctgcagtgagctaggattgcgccactgcactccagccttggtgataaagtgagaccctgtctctaagaagaacacagaaagagagagaacctagttctgactgcagaatccctggagcacagatgctcgctagaacaggagcagcacagccacagaatctgccaagctccagacacaggcagggttatgtgggcagagccagcctcagaggagttagtgtgattttgtcctcctggccttgttctcctggccaccctgcgagacacatggggtcatcccagttcacagatgtgaaaactgtccaggtgcagtggctcacacctataatcccagcactttaggaggccaaggcaggtggatcacttgaggtcaggagtttgagaccagcctggccaacatagcgaaaccccatctc

SEQ ID NO: 179713 - DNA, 1002 bp, Homo sapiens
tctctcaatcgctgcgtgcggggtgttgtcgctctcgcgtgtctgttattctcccccccagtgcgctgcttcttgttcttgcgtcctctctctatacagtcgccctctcgttgactcatcacagtcgtctcgccgccttggcggctcgttctctcccgctgtggtctacattagtacgcgccgcgcccggcctctttctagttttttctgtttcttttgcttgtttcttctgttttgttggtaatgtctgtgctgttcttttcttttctttcgttgtgtgtttggtttttttttgttttttttgtctttttttttttttttttttttttttttttttttttttttttttttttttttttttaagcaaataaaggattttattttttaaagaagtggcagtgtgagaatttaaaatcaatcacataaaacaatcaggaaaggggtggggagagaagtgtccagtacaacctggacaaccttgctttctgcccttacttaaaaagacagacggttcaaatctttgctacctcccttaagtatctccataaatgctcttccaagaaatcctccaaaaggcacttagctccatacttatgcattgaattgtttcaccttagcaatcagtttttaagactccaaggtaacaagaaagaaaagatctgattcttttactaaaagctagtgaataggactgttttttttcaagaggcatcacttttacaagaactagctagaccaccattattcctttatcaagaaaaagtttcttttttaaaaaataaataaaactctggctatacatagtacaaagttcatacataatacatctggaaaaaaaccgaagagtataccctgaagcaaaaggtttattggagagagaaagcctcttccattataccaagtctgaagatggcagttttcaaagttcagagggtggcagtgatatataattaatgccaaactgtttgctcatgggtatggcaggatgcaatgaaggaccaa

SEQ ID NO: 179714 - DNA, 742 bp, Homo sapiens
gtcttgctctgttgccaggctggagtgcagtggcgcaatctcggctcactgcaacctccacctcctgggttcaagcgagtctcctgcctcagcctcctgagtatctgggactacaagcgcccaccaccatgcccagataatttttagagacggagtttcaccatgttggccaggatggtctcgatctcttgacctcatgatcgcccacctcagcctgtatcttgcccattatcaaactatttcttgctgccatattcttttctagtatttgacatcttgattttcagaacctggtcaatcttaccataaaaacctagctgccatttcacacctctgctctgactggctcaaggcctgctcttctttaatgcctatagctgggcagaatgaagcaggtatttaaatactgatctctaaatattttaatagaatgatgtatgtgttcagcttatctattagtggggtaaattgtaatgcgagaagagaaaatcaagttacaatacctacattgcagattttcagtgaggcttaaaaggcatgaaaaattccctaatgttagtaaatactcaagaaatgctggttaatatttctacttctggtcaattgctttccaagtcgaaacagctgataaaattctatacattatacattatgttattcatattatgaaaatgttaagtctttcatttcacaatattattagccaagagaataaaggtttgtagtgacttaaagatcttga

SEQ ID NO: 179715 - DNA, 516 bp, Homo sapiens
gacacacgaacatacacacaaccgcacaccgtcccatgcacgctacatcatccatcactggggcatgacacacgaacacacacataacctcgcagcaaattgtcacagaccaaattgtggtctgaggcaatttgagatttctttacaggaaaggttttaggtagcattctggctgggatagtgacaaaactgcaaatgcatagcaaatgcactgtttttatgttgatagtaatgttgagtggctttagaggggaactgatgtagcagctaggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgcaacatgaggaagtcggacaagatgagcatcactagaacttagatgc

SEQ ID NO: 179716 - DNA, 329 bp, Homo sapiens
gagatgctttgacagatatagaggggctaccatttcagtctgggtggccttgcctagagccctctaaactgcacaatttagtggcgcctattcagtcttccaaagactgtcatgtaacatgttttgcttatacaaatgatctcaatgaagggagattatgaaatgaggcaatatgttaaatctagaaagacaagggaaatacattaaaagtaaggtcctggaaagccacaggctaacagctaccaataatattttttaaatggtattaccccaaagtgaatgtcatgagaactgagggggaatgcaattttgatcacgtgtgttatcag

SEQ ID NO: 179717 - DNA, 141 bp, Homo sapiens
agtgttcaaccgtgagaatttagagttttcttgcataaactatgggcataagaattccagattaggtttctttaaaatggagtttaaattttaaaatgcccataaacaatccaagtacagaattctttcccccatatttta

SEQ ID NO: 179718 - DNA, 589 bp, Homo sapiens
ggtgactctaaggacccctcgaatcgacggttctctaacgtgtatctaatgcaatgattaattttttttatttcattgcttactttttcatttctaaaagttccatttggttctctctaaattatgcctactaatttttaaatactttcttatttcttgttcatttttgtgattctgtctttaagttcttcttgtatttatgacagtttttgtattatatgtatttatttatgtgtataaatttatagggtacaagtacaaaacgtgacatgcatagattgtgcagtggtcaagtcaggactacattgtacccattaagtaatttcttagccacccgcctcctgcccctctacctttccggatctccgttgtctctctgcccactgatagactacatccatgtctatacatttttatttttattttatttttatttattttttagtttttgaggcagaatctcgctctgtcgcccaggctggagtgcagtggcatgatcttggctcactgcatgctccgcctccctggttcacaccattctcctgcctcagcctcccgagtagctgggactacaggcacccgtcaccac

SEQ ID NO: 179719 - DNA, 365 bp, Homo sapiens
tgagtttgccacatcagagacacttccgagaccctttcccatatacaccaagtaataaaggattgatgtttctttaaaggtctgaaattatctgtgatgtttttcatataatccgtgacagctaggtggtaaaattcaggaaggttttcctggtaattatccttaaactggggaaaaattatgacccctttctctcattgtataacatgacaaactatagatcaaaattaccttgcattaggttgatgacataaaagttgttcttggccccgtggagtatgtcagtctcattttgaaaatacagatgaatgtctgtacacttttacttcacggtaattatctcctgataaattaatggagttagt

SEQ ID NO: 179720 - DNA, 349 bp, Homo sapiens
gacctgaggacccgcccaggtagattctttccagaaaacactaaattatactaaaatatgtatttataattggtaatgttctatatattaattactctcctcatccacttataagattttactattaaaattcttgaagggaggccgggtgctgtggctcacgcctgtaatccagcctgggcaacaagagcaaaactccgtctcaaaaaaagttcattcagagttaatccctacagaaacctattttgtaaaaagtataaagacagaaaacaagtctaaagatggctgaggcatgacaaagcattcaaacttaactatcagattaacaaaagatttgtatgtggagggg

SEQ ID NO: 179721 - DNA, 361 bp, Homo sapiens
aacatatcccttccagaagctgcaacgaacgatgatgcaatgcagctagctaaatagaaagcggtcactctctgtcacatagacactttccataattacctgacttctctgataagacagtggcactcacaggaagctcacactcacatggggaagaaaataaatgcccccctgcccctggggacaatagaggccaatctctgaagaacccagataccatggtgtagataattaacgccacgaggacgtggatgacattgtcagaggccacgctgacccagagttctcaggaagggacacagctagtcaccggaccgtaaagagtgaaccacgcctgtcagaagtcatttcatggtaggca

SEQ ID NO: 179722 - DNA, 128 bp, Homo sapiens
acaaacccagaccaaccatgggggtctccctcctgttaacacccctccctaacagccctcctggtggttccctgtctgcccctcccctttatgggtcaagcctgctggcgtctgtttcattgtgctgt

SEQ ID NO: 179723 - DNA, 449 bp, Homo sapiens
gccgtcctaggggctggagacactgcatgaacaagacaaaaacttgggcccctggggaggttataatctagtagaaggagacaaaatgagtagatggattattaaaagcatatgcattgtgagaaaattccagcaggtgcagggaatagagaaagggagtggtagggcctgtgatacttcaggttgagctgcttagcgctttttttttttttttttttttttttgccctgtgggcccctctgatagctggtgaagcccgcacacctttctcagaacaatgatatttttaaggtataaaatcaaatacaaagtattacaatagaaaccatttctattaaaacatagcaaaatactttaaaaattgtggtaaatgtgctgctttattcaatgtattaaataagatctagcattgggcctaatgacaaccatggttttgaagttgtgatgag

SEQ ID NO: 179724 - DNA, 629 bp, Homo sapiens
atattttcatgcacggcgcatctgaaaatatcttattcttgcctttaaacttggaaagaattactccattgtcttatagcattctttattaatggcgagaaggctagtatcagtctgtttccaactttgttgcagacatcctgtcactcttccctgggaagttttgaggattatttttactttatccctagagttataatatatcagcccaatatgtctaatgtgggcatatttgtgccagtcatcattaagcatgtactttcaatctgaagactcacatgttccattaacacagaaatattcacaaggaaaatttgatttgctacatctttcactgttttctctctctttttctctaagttggaactcttagtagacagatgataactggaactatttttttaatttaatttttttgaggatatagcaggtatatatatctatgaggtacatgagttttgatacaggcacaaaatgagtaataatcacaccatgtaaaatggggtgtccccccgaagtatttatcctttgtgttataaagaattcaattgtactttcagttattttaagatgtacaattattattgactacagtcatcccgttgtattaactttctgttttaagagca

SEQ ID NO: 179725 - DNA, 239 bp, Homo sapiens
gcacagatacgtccacagcacatgaatgatagtccctctgcagtataaagcatcatgggagatgattagggaaaaagtgtctgaaaaggttccttagaggggaaatgatgaaaacatttgagtagcaccacaacccatctttgaccccgaccagtctgctctgaacaggcagcagggcaaagcagattcttgatgacaccagtgctcagcacagcccagcccctcgccccagcacctcg

SEQ ID NO: 179726 - DNA, 294 bp, Homo sapiens
aaaatgaaggaggaggccagatatttttgacttttagagagatcagtgataataggctgtcttcttttcataagaacaattcttatgaaaactttctctgattttctgcaacatgatgtgttacttcatgttaatttgtgtgatcaaagaaacatggcagatagaaaataatggaagatccaagggtgtgttctgtttggcttctgctgcatggcatagtgaaaagagcatgggcttgggtgttttcgagctgagttcttccttttactgacgttgtggctgggagcaggtttt

SEQ ID NO: 179727 - DNA, 292 bp, Homo sapiens
gtggggcatggagggctggctactggggtcagcgtggagctgtgtggacggttctggttatagggcctggtgtgaccagaaagaagtcacgagtgacctgggagctgaaagaccacctccctccaaaatcaggaaggccccttaagaacaagttgttggcatatttggaaggctttcttccagaagaacattcagccctttggcactttgtgctgaagctgtgacgccctgatgctccagggcctgagtcagtgtcctgaggatgctggcaccctccttcagagcacgtttc

SEQ ID NO: 179728 - DNA, 570 bp, Homo sapiens
ccctcacggttacctcaactttagcctaaattttatctcactctttaaaacttgtctgtcttggccaagacaaacaataccagtgggagatgtacactgggattccatattaagctttaaattaaggaccagagtaaatattaaataattgaaattctcatcattcttgagagatgcttttcacctcggttttttggcaaaggaagaaggagatgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaatc

SEQ ID NO: 179729 - DNA, 472 bp, Homo sapiens
agctgcacagaggccttcttcctgggcctgcgcgtcaagtgcctgccgtcggtggcagccgcgtccatccgctgctcctcgcggcccagccgggactctgacaggctccagctccacacagacggcatcctgtccttcttgaagaacaacaagccaggggacgcgctgtgtgtgctgggcctcacactgtctgacctgtacccccatgaggcctggagcttcaccttcagcaagttccttccagggcacggtcacgtgccacgagctctgccaccttctgggcctggggaactgccgctggctccgctgcctcatgcagggtgcgctcagcctggacgaggccctgcggcggcccctggacctctgtcccatctgcctgaggaagctgcagcatgtcctgggtttcaggctcatcgagaggtaccagagactctacacctggactcaggcggtggtggggacgtggcccagc

SEQ ID NO: 179730 - DNA, 299 bp, Homo sapiens
cctaaacagaggctaacccccttttccttgagctctgttttcctaggctcctgcattcctgctctctgcagtctgatttcttagaatctgagcattagctgctgatacttatcagctgccagcctgaggtctcaatgtaagggttcaagtttagaacatagatcttttttagacaaagaccactctttttcataagattaaaacctaggacccttcttccatttatgacagtgattcgaaggcgtatctaaaaactttttttttttttgagatgcagtctcgctctgtcatccagactg

SEQ ID NO: 179731 - DNA, 1079 bp, Homo sapiens
aggttgcagtgagccgagattgcacctctgcactccagcctgggtgacagagcaagactccatctcaaaaataaataaataaataaataaataaactgacctcctgaatcccagtgctggcttggctgctatactcttgcccttcactgaacctcagttttcctcatctgaatagttgggagactcattcctgcctttctcatgtccctggctatttggtaaaccagccagtaggaagacatcgtgaaatgtattaaagtggtcttagctagacagagtgggcatgccagggtcagcagagattctgaagtctagaccagttccctgggtgggccgttgtcagtcctagcagatggccaggtcagccctcaggctggaaattttagggcagctattggtaggtgtctcctcttgctgtgctgagatacggtcaagatcatacttaggcttttgttggaagaacatacaagacgagagaaaaaaaaagatcatacttaggggctcccggaatttgctctgccctaggttgctgagacctctagaacctgtgcaggctaaaggaactcagtcggtagatccgagagaggtggtcagggagaccaggagcatgtctacactgccagcagacttttgcctcctcccccaagccagcaggatggcccaaaaaggctcccccagcagatcatctttgcagctccttttttagctccagtggcagcagggatgaggaagggaaagttctatcatttttttctaatttaaaatgacatttaaaatcactagcctagtgggggccaggtgtggtggctcatgcctgttatcccagcactttgggaagccaagacgagtggatcacttgagctcaggagttaaagaccagtctgggcaacatagcgaaacgccgtctctataaaaaaatacaaaaattagctggatgtggtggtgcacacctgtattcttagctgcttgtggggctaaggcgaaaggatcacttgagcccaggaggtcaaggctgtagtgagctgtttgtgccactgcactctagcctgggtgacaaagcaaaaccctgtctcaaaaaa

SEQ ID NO: 179732 - DNA, 400 bp, Homo sapiens
tcgagctcgcacccatagttacaccgtacctatcaaaattgttttgctgaaaaaacagcagatttcaaaacagaatgactcaatttttataacaaaaatactgtgcaaggaaaaaacctaaaatgctgtacacaacattgtccacaatcatgttgttcagtgttggtgagaaggggaaagcaagcagttgaaaaatgaggaattacagactatccttataaataagtaatcacaataatattttattttatttcaattttttgagacaggctcttactctgtcacccaggctggagtgcagtggggcagtcatagctcactgcagccttactcttgggctcaagcaatcctcccacttcagtctcccaagtaactggggctataggtgtacggtgccaca

SEQ ID NO: 179733 - DNA, 412 bp, Homo sapiens
actggatgcccagaagcacagtggcctcatccttaaagcagtggaggtggggggtggtaagaacagggccgatcttgcagggccgttgtgaggattaaaaatacaatgtatgataatgatgcatcaaagtaggttcctcagtcctatcaaatgtgccactctggtgggggacgctgatgatgggggaggctgtgagtggtggggatgggaactccagactctccactgcagcttttttttttttttgaaacacagtttcacttttgttgcccaggccagagcgcaacggtgcgatctcagctcactgcaaactccacctcccaggttcaagcaattctcctgcctcagcctcccgagtagctgggattacaggcacctgctaccacccccggctaattttgtatttttagta

SEQ ID NO: 179734 - DNA, 652 bp, Homo sapiens
gtcgtggcttgagcctgtaatcccagcacgttgggaggctaaggtgggaggatatcttgaactccaggagtctgagaccagcctgggcaacatggcaagactttgcctctacaaaaaaaaaaaaattagctgggcatggtggcacacacctgtcattccagctacttgggaggcttaatcaggaggctgagacaggagaattacttgaatcagggaggcggaagttgcagtgagctcaaattgcaccactgcactccagcctgggtgacagagtgagactccgtcttagaaaacaaacaaacaaacaaaaatgcttcatttcagtgacaccctgagctgggagggagtaaagactcataggcaaaagggactaatacatgtatataaaatgcttcatttcagtgataccctgagcaaggagggagtaaagactaggaagtactgttaggaagtgacaccacttttatttttggagctgtctctgacctgtgaatcctacagtgaatactcttaaatattttagtatctgtccagatgatattggtacccagatcctttaactatacctctgatattccaactgttttgctcttacctgaatttatgctgcctatcttgaactaggatcttaaatttaaaatggcacccaata

SEQ ID NO: 179735 - DNA, 783 bp, Homo sapiens
ggaccattgtaatcatgtcatctgaccagcctgggtaatccaggatgatctcttgacctcaagatccttaacttaatctcatctgtgaaattctttttgccaagtaaatttacatattcacaggttccagagattagaacctaaacatttttgggaggggtgaggaggtattcagcctaccacagttaatgaagagtgagtggcctgagataaggtcttagagattggcagggaccagatcatgataggtcatgatagggagtctgtttttcagtcatagtgctgagaggtttcagtaggggaatgataggatttgatgtgaaaaagtctccctggccgctggatggcgattagactgttgggatcgagagcagaaggcctcagctttttattcataacatcatacggtggatctcaatcttgctgtacgttatgatcacacctcaaagcaattatatctgaaccactgagggctggacccaagtatcagcctttttttgtttgtttgtttgttttttaagaaaaagcattctaattgtagccagggttgagaaccactagtctcatagatctgaatccattttaccttttcagccttagctcagtaggagcttctcgcatccatcacttactgcatgagctacttgaccatttcttagacaaacttcctgtattcccacctgtgcctttcaaaatatacctagtctagggaggcctacgcggactgtcagggcccagctgacaaactctcctccagaaagcttctccagtgccctgtagtag

SEQ ID NO: 179736 - DNA, 352 bp, Homo sapiens
tctcacctgactacccggcctctacctgaggcaggacttaggactgtcctgagatctttcctgttttgccaaacagctttgctgcatgtgaaccctggagcactctgtggtctggctcacctttccctgaagctgagagcaggttggaaatcaactgtctgtcagcatgtccaaaggtggctggatcctgggtcccagagagatcatttcttcctgaaggaggacaggaatggcgttcaaagattcatgcctgtagttacaggaacaagatgctgaaagttgtaggtaatttataaaaccacgagaggttggtcatttcaggcctcttcagcctatgattttagatagttgt

SEQ ID NO: 179737 - DNA, 213 bp, Homo sapiens
tacacgtaccatttcacttaaaaataagaacaatcctgtgggatagctattataactatctcccactttactgatgaggaaaaagaggtgtagagagttaagtaacttccccaaggttacacatgggagaatactggagtctggatttgggccccagggaactgatctcgaagacctcattcctatcattatattttactatccctcttctat

SEQ ID NO: 179738 - DNA, 348 bp, Homo sapiens
acaatctagtctccccatatccccaaaacaaaaacaaactaacagcaacaacaaaaaccctttccatcaggccaactagtggctttggaaccaattacaaagtactatgagatgactctttaaatgaaaactcttaagctattcaccaagtcaagtacattgtgggagctgaactcccacttcaaaatttgggttctgaccacggcctccaatccaacctccctcaaattccaagagagttaatcctggcttcccgtcaggaagtttgctctcacaaacttgtagaagtactggctattaaaaagtgtatgggttcttttagtctttctgtgccatggtcagtaaggg

SEQ ID NO: 179739 - DNA, 299 bp, Homo sapiens
ctcctaccccagtgcatagtatcatcttgactaatccagcgagagattatacacatactcctccctgcaatggccagatgagggatgacaattggctccatctgagcaactgtcttcccttccacttcccaaaacctctcttcccttatctctccctatatttaactggctccactgctttcctccatcagctcctactattttatgatgtacttgcattaccaacacattgcttaattccttttagcctgattttttttttcttgagacagggtctcactctgttgcccaggctggag

SEQ ID NO: 179740 - DNA, 398 bp, Homo sapiens
agtggaggctgagccaggatggcccttggtccatgtggccccaagcctggtgccacacaccacacactgccaagaaagtggcctgggcccccactggggcatgtttagcttttgccttccctgcatactaaccccctgggttaccccagatgtgccattcacatagttactgactggaacttagtttctttggcagggacttcctttttagtagttgttgaattacagcgggaggaagtgcctggaatctgctggtagaaaggctttggtgaaagagctctccagaggagcggaagttggtcaggaattaggttgtgtggctgtggtggaaaggaggccagtgtgggcagaagccagggtgcagttccccatggcctggaggctgtgagttccacgac

SEQ ID NO: 179741 - DNA, 203 bp, Homo sapiens
ctaacctgcattgctacctcatgcaaacctctaggccatgaacccatcttcacttctcaactagacttcagcttcaaggacatgctcatccgtgtattgctgactctcgtgcatccaatgccaccaaactcatgctaattcccacccagaatgcacttgatctttcaagcatctatagcagcacacaaagagacaatgtctag

SEQ ID NO: 179742 - DNA, 615 bp, Homo sapiens
tgatttctccttcagtcactggatttctaattactctcttgcactgcaacgagttgctcttgctacaagtacttcttaaattttgccagagcgtagaaattacccagtgtgtttataaatattcacactcctaggtttctcctgatgattctgtcaataaatctgaaatggtttctgggaacctctttttaataatagcctcaggtaactcttgtatccagcatgtttaggaaactgtattaatatatctgaaaatggcttcatttttgttgctagtaagggctcactgcaaacaaatgtagttggggcaagaagaagcagaagtcttggtgaggaaggcttatagctgtggtaaactgaacttatttaggatttttttccctgggaagttaaaactttaaataccttatcttttccatcagccttcttgtcaagaaggtaggttctgagcattttccccatccttacaatagggatggtaatcttgatttgtccctaacatggtggcagtacagagaaatgaatcctgggtttcctgttcctagtgtagggtttttaataattagaccagaatggccatgtttcagaatcagtatagtgaaggagatgaagtat

SEQ ID NO: 179743 - DNA, 389 bp, Homo sapiens
gcgaacgacacagcggccatcttggtaaaggaaaaggaacaaggaagaaagtggaaccaattagcaagctaagggtcttgcggtgtcacccaggctgtcacaggagtgcagtggtgtgatcatagctcactgtggtctccaacttcagggctcaagcgatcttcttgcctctgcctcccaaagtactgggattactggcgtgtgccaccgcacccagatgagactaacgttttaatgtcaaaaaacctataaaatatttggaaaaaaagcgtttaatctctaagagccgctatgcaaaagcagtggagacacaaaaatctgtatgacactgttcctgccctgagaccgggacaaggtggttttatgcatcaaatacagaatggcacgtt

SEQ ID NO: 179744 - DNA, 457 bp, Homo sapiens
ttccaggctcagagaggttgagggcttgtgcggagctgtacagccagtgaaaggtggagccggcctcaccccaggcaagggcagtagaacctttgctctccaccatttcccagccagactctgccctagatttcaagacactagtgtcctaccttccagtctagggttggcctgactccattctagaccacttgggcagggatggggaacccctcattaaggacaagggactctaggatgggctctcacaagccctgattttgtcagatccctccttggctctagaaactgctgtggctctccactgtcactaggagaaagtctggcctccttggctggtcctctgaagccctccctggccttgtccctctgcctttcccctcctgcctggagtgcagcagcaggttggatgtcgggagggagaaatacaaggctgggaaaaatgagcttctactat

SEQ ID NO: 179745 - DNA, 467 bp, Homo sapiens
ctgttgctgggtcaggtgctgacagactttctccctgctgagccctctggcatgcttggagctcagtggtgataatccagaacttctcttcccttggagggctcttgcatggaggcagagttctagataaggacctagagctttgccctttcttccggcccaccctcctcctttcctggggacttaatgaagaacaccagggacggaagtagtcactcttgggcagggacacttggccgccctaatcagcctgcctacttcctgccctggctcctgctctgagattaagaaaaacaacaacctcttaaatttagacaacttctttgccatacatgggggatgctcacatacatgcccttattaaaaatgtttttacccaatcctcacaatttggatgacaaattatgatccccattttacagataaggaaactgaggctgagcaagatgaaagatttaccctggcct

SEQ ID NO: 179746 - DNA, 592 bp, Homo sapiens
actcacttgaggtcaggagtttgagaccagcttggcacatggtgaaaccccatctctactaaaaatacaaaaatcagctgagcgtggtggcgcgtgcctgtaatcccagcactttgggaggccgaggcgagtggatcatgaggtcaggagttcgagacccacctggccaatatggtgaaaccctgtctttactaaaaatacaaaaattagctgggtgtggtggcgcgtacctgtagtcccagctgtttgggaggctgaggcaggagaatcacttgaacctggaaggtggaggttgcagtaagccaatacagagccactgtactccagcataggggaaagagctagactccatctctacaaaaaaacatagactttggagtcaaattgcctggttgttggatcccaggtctgagttttactgtttgtgtaacctgggataggttatttcacatctctgagcctcccttttctcacttatggaatggagataataactgtatccatctcatagtgttattgtcatttaaatgaggtactatacataaagcttttagagtagtgcctggtagatagtaagtgatcagtaaatgtt

SEQ ID NO: 179747 - DNA, 381 bp, Homo sapiens
caggtaagggtgggcagacctggcagaaggctggttcaaggcatgggggtgtgcgtgggggggctccttttgggggtggggggcggacgggattagttccaggatgggagaagctcggttctggctgggggagatgcccttagctgcaaaagctccgggcggccaggcagagtgctggcctcggtgggctcacagggcggagaagggggtcgggctgcaggaggaggcgcctggacctccggagcagagtcgggtagcggtccgtgccgggacgggggacccgtcggcgccggggtgtgcaaaggagcgtgtgtgcggctggagggcggcgatgcgaacaacaatgcgcccgcgcccggggccaggctgcactggcggccg

SEQ ID NO: 179748 - DNA, 231 bp, Homo sapiens
tagacaaaagtaccctattctgaaaaaaaatttctgcaaaagacatttattagtaaggaaggaaagtgaccgacaagatttaaggcaggaacagtaaccctgctttgtgcaattgcaattgggtttatgatgaggagtgcccttatctataaacctttaagccctgagtcttgaaaggaaaagaaaaacacctagtttttatcttgctaatcttctgctagtcttcttgtt

SEQ ID NO: 179749 - DNA, 609 bp, Homo sapiens
tggggcacattgctttatctttttctgagttgttaagcagttagaaaattattttaaatagattttttttgatacacttgatgatttttatcagtaaacttgaaaacggctgtttattttggtcacaaagaaatattttaataatgcttttgacaagatatctcaaaccatctgaatagagaatcttaaatagctttaaaagaatcatgaacttattagcaaaaataatgaagttcagtataacatttaagttgacattttgagatagtagataaagtttacttgggacacacatgaaattaaaggtgattcgttagtgtttagtaactgtctttatttcttcatttttttgttttatattttatttagcaaaacatcttaatattatttttagtttggagtgtttgtagaatatttaaataaacattaaaaaattcctaagggaagggacaggtgaaatactaatacaaacaaaaactgttacaaaatcagaaatgtcaagattttggggggctactgtgtatctgtttatctacttgatcttatatgcgattttgtctttcatttcattactcttcttcattgggaagaaaaaatcctctcaaggtc

SEQ ID NO: 179750 - DNA, 399 bp, Homo sapiens
tttaaattctattgattttatgatgcatttggaatatggggagtgtcaatgccttccccttcttttggtgttgcattctgtctgcatgagaaactatttttcataccttggggataacatggatccaattatggagaaaaatgaaaggaaccaagcccttagctggatgccttagtgttcagatactgacactgcacccttccttttatctaagctgttgcttcatatgccattttactgagacaatgggagaggctaatggaacgtcataaacatcactcagaatcctaatttggtattgatgcaattcctattgaggaacagagagaaaaaggattcagtatttcagagagagaaaaggattcagtatttctgctgaataagaaattatttctgttg

SEQ ID NO: 179751 - DNA, 179 bp, Homo sapiens
taacagaaataatgcaaaggagagtgaggtcagctgccagcagcttagatgaagcggggagagtggatatgatacaaatgccagtggaacaggcagccacacaccctgccaacgtcttggagtcttagaggtcctcagccctttcctgtggaagcatccactttactcctcactgcttg

SEQ ID NO: 179752 - DNA, 188 bp, Homo sapiens
accactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttgg

SEQ ID NO: 179753 - DNA, 565 bp, Homo sapiens
tgatgggcacttgaataatttcaactcagaagactgcagaataatcatattttaaactctaaaaaatagtcagcataaaaaggatcaactaccatataaaatatttcctgtatatagtttttcctaattgatcccattttgttctgattattaaacttactatatgcttggcattcttctctgggatcttttcctcgtgactaaatccacaagaaagtatttgcttactttgcacggaagactgttctgtgttcttgtttgttttctaaatgtcttaaacgcagggttctgattttctctccacatagcaactagtatacaatgaattcccagaatgttgttgcctgaaaatagtaaaaggacttttgcagtgattactattctagaaaaacttgcaaagaatagtcttttctagtgattgcagaaatataaagtttgacagtaatgcaaatggccactgaattatatttgaatgtattttagttatcaaacaatttgttctctatgtagaatgttttgtattgattacttgaaaggcagatagctgttatttattaagacactt

SEQ ID NO: 179754 - DNA, 499 bp, Homo sapiens
ttcagttaaaaggtggaggagataagatttgggtttgtagacaaatacaaagttactctcaggctaacattttctttacttctcccactgcacagtgtgtgtcatgagtactttatacaaagttaaggtggtttgcccatctatttcagttggtaattatagaattggagatgcgaagttgaagctgttagccttctaacatacctccatcagtggactctaaggattttacccagaagttctatgttctacagtttcagacttaaccactttacttatacctgtccatctcttcttttgatatttttaataaaaataatccttgttgacctctgttcctatagggttatagaaaccaaactgctataagctgggcgtggttgtgcacacctataatcctagcactttgagaggctgaggcaggaggattgcttgatcccaggagactgcagtgagccatgatctcagcactgagcaccagaacaagactctgtctcca

SEQ ID NO: 179755 - DNA, 198 bp, Homo sapiens
atttctggagacctttagtctatagactaatctgagcaaggcattgtgaacagtagtgtcataaagatgaatggtactgaccattagggaattgataggctggaagatgagatggaatttgtatgtaaatctcttaatacagagaaggaaatggtaagtatgataatagaggtgagcacccaaaaaactgtggtccca

SEQ ID NO: 179756 - DNA, 524 bp, Homo sapiens
gtctggattgctgcagtggcattctaaatagtctccttgttgccacctttgtacccctgcctgtcatcctctgatgtgaagtcagattctgtcactgtcctgctcacatccactcaagagcttccttctcttgagagtgtaagcccaagtcttatcagtggcccatggggccttccataatgtggcttctggtgtctctcaggctcatctccagcccacacttcattgtttccctccactctggccacactggcctccttgttgcccctggaatacagtaggcatgcggttatctttgccctactgcactttctgtctggaacattcctcccctggatagacacattgctcacttcctttgggttgtgttcatgtgtcccctggcaagaggggcttccctgacctccctatgtaaaacagcaactcatctctactgctcatctctgatccctttccccttctttattcttctttattggcccccaaaccgtctcacagagttgatatgttacctgctcactcta

SEQ ID NO: 179757 - DNA, 339 bp, Homo sapiens
attgagcaacagcaggtagatttccacaaaagaacaagacaatgatatgctctcatatcccaaaaaactaatgggagctggggactttagagtaacataccataggtttttttattttaaaacatgacaggctgggctcagtggctcacgcctgtaatcccaacacaatgggaggccaaggagggcggatcacctgaggtcaggagacaagcctggccaacgtggtgaaaccccgtctctactgcaaatacaaaaaaaaaaaattagccgggcgtggtagtgggcgcctgtaatcccagctacttgggaggctgaggcaggagaatatgaaccgggggc

SEQ ID NO: 179758 - DNA, 214 bp, Homo sapiens
aaggtgggaggatggcttgagcctgggaggcaggctgcagtgagatgcaattgcatcactgtattctagcctggcaacagggcaagaccacaccaaaggaggggaagcgaggggaggggaggaagaaggagaggaggaaataaaagaaaatcaggagtctatctttcaagtactcaagtcaaaataattggagtcatcattggcccctctcttt

SEQ ID NO: 179759 - DNA, 387 bp, Homo sapiens
aaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcct

SEQ ID NO: 179760 - DNA, 200 bp, Homo sapiens
ctcggcctcccaaagtgctgggattacaggcatgagccaccatgcccagcctctttatgctctttataacagaaaatgaatgtaccattttttacttgggtctcagaaaagacaagtatgagttggtgtttaacattagactaggttgtaaattgacaggagagccatccacatacatcagaaaaagaggagcagagaag

SEQ ID NO: 179761 - DNA, 509 bp, Homo sapiens
ttcacttactatttttaaaggatattctcaatgagtgtgaatagtgagtcaacagctttctttcaccatttcacacatcctgagcctccattgttttgagtcagctgtcgttcatatctttgttacctgtgaatgcacaaaatttgctctgtatgatgactatgatgtgtccaggtagggttttctttacatttatttttatgaggggtttatgaactttttgaatctataagttgatgttttttcactacattttagactatatcaactttttttttctttcatcttttccagccatttcttcttggttctggttccgtgtgtaccgcatgatattgtaccacgtgtcacggagactcgcttccttgttttctttcagtttcattttcccttgcacttcagatggaatgatatctattgatctcttttcaagttcactcattctttcttctgtaatgttcaatctctcttaagaaagtccaaataaatttttcatttcagagagtgga

SEQ ID NO: 179762 - DNA, 863 bp, Homo sapiens
cttcttctcaaactaattgtcagaaagtcagaaacttcctggcccggtgtgatggctcacacttgtaaacacctgtaatccagcactttgggaggccaaggggggtggatcgcttgaggtgaggaggttgagaccatcctggccaacatggtgaaaccctgtctctactaaaaatacaaaaattagccaggcatggtggcacatgcctgtaatcccagctactcgggaggctgaggcaggagaattgcttgaaccctggaggtggaggttgcagtgagctgagattgcaccactgcactccagcctgggtgacagagtgagactctgactaaaaaaaaaaacaaaacggagaaagtcagaaacttcctgaatatactacatctgtcttctcactcctctatttccacctctcctactttttccatatgtgaaagggacatggccctcttataagaacagacaggaaccttccttcagaggtggaaatgcacaaacagtaacagtagggttgcccaacaaaggagtgtccttgttagaaagcaggtgagaggagtcagatcatgaagaagtgcaaagatttgagtctaagaaagcattcatggaccagactggtggggaatgcatccacatagacctgccctgaccctaggcctcaagcaccccatttgtccatcaccatctggcttctctcctcaccaaaaagcaatgtcaacatgcaggtacgaaacatgaacagttgcttttttcccattctccattaccctcatgtgcagaaccaccaatacacattacggaagaggtgtgcaggccattcctgggtacagagaagtccacatttttctgcatacatcatttcaatgaac

SEQ ID NO: 179763 - DNA, 263 bp, Homo sapiens
gggattacaggcatgagccatgacacctggccaaactcagcattttcaaaagtcaaggaagcattaatatattttagaaatactttcatttaaaataaatttcagaactctgtattatttttgcaatttttctacaaatctaaaactattctaaaatttaaaggtttctgtttttaaaaaaataagtttgagtcttctagtaagaccaggcagttcctcctataggatcaactctgcctatcataacagctataacttccaga

SEQ ID NO: 179764 - DNA, 112 bp, Homo sapiens
tgctgggattacaggtgtgagccccccgtgcctggcctgttctttcttctattttgaaggtcacttgggatgcattttcatgctattaataaagaaatgctgacccttgtta

SEQ ID NO: 179765 - DNA, 456 bp, Homo sapiens
ggcccggcgcacccaagcgagggtgtccaggggtgtctgggttcagactaggtcctgttcaaggaagcaggggaggaaggtcactcgtgggtcacatgtggttggaggagcagcaggaaagccctggagccctcgtctgcatacagaactcacactggcttgaattccacatcagcgcgcagcttccaaaactcctatatcctagcacacacaggatctatttaatctaatcctcacagcaacactacaagataggtattaatataatcgctagggcacagaggaggaaacgcctcagatgattgagcagtgcgctcacacagccggtaaggtggtggaaccaggaccggggacttgagcccaggcttagggagaggcctggggagagaatctgagctgagtgccaagtctgacttttcttcttcaacactcactatctctgacactggacaagtt

SEQ ID NO: 179766 - DNA, 182 bp, Homo sapiens
gtggagaggacgcgtaggacgtctctggagagcagatttgaaactggcatccaggagagaggaggcccaccagtcactccaaggaccactgagattaggtgtgaaggcagaactggaatgtgggagggatgcgtccatccaaaagatgagcttgagtttactgttttccattcattgcatgt

SEQ ID NO: 179767 - DNA, 1838 bp, Homo sapiens
ggcacgagggcctttgctcctgagaagttactgacaggtggaacctgaggcagcaggacagcctggcattggccacgggacatcggccacaaccatagcaacttcggcatcaaatggggcaggagagagaacattaaggcagccatgagctccagccaccccgagccgggtccctgggcacccctgagcccccgccttcagcccctgtcccagagctcttccagcctgctgggtgaaggccgggaacagaggccagagctccacaagactgccagcagcaccatgtggcaggcccagctgggcgaggccagcaccagaccccaggccccggaggaagaggggaacccgcctgagagcatgaagccagcacgggcctctggccccaaggcgcgacccagtgctggaggccactggcggagcagcactgtgggcaatgtgtccaccatgggcggtggtgacctttgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggccctgcaggcctggaaagggacctggctcctgaggatgagacttctaactcagcctggatgctgggggcgagtcagttgtcggtgccaccactagacctgggggacacaactgcccacagcagcagtgcccaggctgagcccaaagctgctgaacagctggctaccaccacctgccatgctctgccccagctgctctactctgtggcatgagggagatgagggaggtgggggctggtggctgctgccatgccctacctgccacagggatcctggcctttcccaaactagtggcgtcagtgagcgagtctgggctgcaggctcagcatggggtgaagatccactgtaggttgtctggggggctccctgggcactcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggcgccgtcccctgtgcgggatgtgcgatgggatgctgagggcatgacatgggaggtgtacggagctgcggtggacccggaggtgctcggtgtggccatccagaagcacctggagatgcagtttgagcagctgcagcgggcgcctgccagcgaggacagcctgtctgtggagggccggagggggccgctgcgggctgtcatgcagtccctgcggcgccccagctgctgcggctgctctggcgcggcccccgagtgaggagctgtggcccttggagctggcctgggcccactgacttagtcctagacctgggccagggacagtgggggctccgtgccccctggacccaccggcagctgggcacatgtctcacccgaatatcggctgcctccagaccacaggactgcagcctggggcttccggccccacacagctgggctgttttcttaagggcttgatttccaagggccacatctctgcaccttccaggctctgaactttgagacagggctttagcactgtgcagaggggagatcctgagttttctttaaaaaatgaccttttgttc

SEQ ID NO: 179768 - DNA, 1986 bp, Homo sapiens
cctccaaaccctccctttaggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagagttactgacaggtggaacctgaggcagcaggacagcctggcattggccacgggacatcggccacaaccatagcaacttcggcatcaaatggggcaggagagagaacattaaggcagccatgagctccagccaccccgagccgggtccctgggcacccctgagcccccgccttcagcccctgtcccagagctcttccagcctgctgggtgaaggccgggaacagaggccagagctccacaagactgccagcagcaccatgtggcaggcccagctgggcgaggccagcaccagaccccaggccccggaggaagaggggaacccgcctgagagcatgaagccagcacgggcctctggccccaaggcgcgacccagtgctggaggccactggcggagcagcactgtgggcaatgtgtccaccatgggcggtggtgacctttgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggccctgcaggcctggaaagggacctggctcctgaggatgagacttctaactcagcctggatgctgggggcgagtcagttgtcggtgccaccactagacctgggggacacaactgcccacagcagcagtgcccaggctgagcccaaagctgctgaacagctggctaccaccacctgccatgctctgccccagctgctctactctgtggcatgagggagatgagggaggtgggggctggtggctgctgccatgccctacctgccacagggatcctggcctttcccaaactagtggcgtcagtgagcgagtctgggctgcaggctcagcatggggtgaagatccactgtaggttgtctggggggctccctgggcactcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggcgccgtcccctgtgcgggatgtgcgatgggatgctgagggcatgacatgggaggtgtacggagctgcggtggacccggaggtgctcggtgtggccatccagaagcacctggagatgcagtttgagcagctgcagcgggcgcctgccagcgaggacagcctgtctgtggagggccggagggggccgctgcgggctgtcatgcagtccctgcggcgccccagctgctgcggctgctctggcgcggcccccgagtgaggagctgtggcccttggagctggcctgggcccactgacttagtcctagacctgggccagggacagtgggggctccgtgccccctggacccaccggcagctgggcacatgtctcacccgaatatcggctgcctccagaccacaggactgcagcctggggcttccggccccacacagctgggctgttttcttaagggcttgatttccaagggccacatctctgcaccttccaggctctgaactttgagacagggctttagcactgtgcagaggggagatcctgagttttctttaaaaaatgaccttttgttc

SEQ ID NO: 179769 - DNA, 495 bp, Homo sapiens
cgttggggcggctcagaggcagccacttctttcttcctcatcactttgctgttttcggaaagcagttagtagttattcgctgtatgtggcttttgagccagatcggccctcttcattatgctaaacggcggaatcatctggagcgagatacccaatgaactacattgagctcaggagagttttatgagcagaagagcaaaaatacacatattggccgagcgtggtggctcacgcctgtaatcccagcactttgggaggcctaggcgggtggatcacttgaggccaggagttcgagaccagcctggccaacatggtgaaaccccgtgtctactaaaaatacagaaattagccgggcatggtggtgcacgcctgtaattccagctactcaggaggctgaggcaggagaattgcttgaacccgggaggcggaggttacagtgagccaagatcacgaccaccacactctagcctgggcaacagagtgagaccctgtctc

SEQ ID NO: 179770 - DNA, 592 bp, Homo sapiens
tcatagtctgctacgtacataatgaggctcaaaaagactgagtttgggaaaagttaagatcctcctatagttcctcaatgtgatgactgggtgttcacactcattggcgagatgtgcctctctcaaaccttgttcagatgctgcagacacattacccatcagatgtgcaaaaaaaataaataaataaaaaagggaggccaggcgcatgaaccgagatggtaccattgcactccagcctgggcaaaaagagcaaaactccatctcaaaaaaaaaaaaaaaaaatgagctggttgtggtggcacatgcctctaatcccagctactccagaggcagaggcaggagaatctattgaacctgggaggtggaggctgcagtgagccaagatcgtgccactgcactccagcctgggaaacgagcgaaactctgtttcaaaaaaaaacaaaaaacaacaacaaagaaaacaaagccagcctgggcaacatagggagactccatctctataaaaaaatgtaaaaattagccgggagtggtggcgtgcacctgtagtcccaggtactgaggaggctgaagcaggaggatcacttgagtctgg

SEQ ID NO: 179771 - DNA, 484 bp, Homo sapiens
gaataactattacagcataaactattacagcataaactattacagcatacaagtccacttaaaaaatatccacatataagggctgggagagagacatcactacaggtaattttatatttggggttaactcaaatcaaaatgactagaatatacagtaaatgtctttgattaatattattaactgataaaacaaattagtggatcataggattgcttattcaatattctaattatcaattcaaaaatgattttcgtaagccctttgtgactatctctttaataaaacccaaataatagtttatgctgtacagcataaactattacagcatatttaaaggattattcaccatgagaacatggagtttactcttagaatgcaaggtggttcaacatatgaaagtcagtgcaatgcaccacacattaacagaatagagggggggaaccacttgatcaactcatgcagaaaaagcattctgacaagata

SEQ ID NO: 179772 - DNA, 321 bp, Homo sapiens
cagggacacagtttgagaggtgagttgaaggagtattgagtatttcatgaatagagccttgggttattggttaggagcatggtactggtcatacaaggcccatggtttgagtctctcctgggcaggtgctctttgaccatagattgcatcattcatcccaccagccattttataaatgatgtgttactatctgtggtaaagaggaccagtatgtggctgacaggtacaaatctatcacccctgttgaaaacacatctctctcagattactcagcctctttccttcattgtctttattacagtttgtactgttggtagtttt

SEQ ID NO: 179773 - DNA, 242 bp, Homo sapiens
gatacatccagccagggcaggtgtttgttcgtcttacaaggaagacaatagatataaattttttttttctacagcctcgacctcctgggctcaggtgattctcacacctcaccctcccgagtagccgggattacgggcacgcaccaccatgcccagctaattttttgtatttgtatttgtatttttttgttttgtgtgtgtgtatgtttaattttttttgtatttttagtagagacggtgtt

SEQ ID NO: 179774 - DNA, 686 bp, Homo sapiens
accttttcatgataaaaaaaattctcaataaactaggaatagaaggaaactcccttaacataataaaagccatatatgaaaaatctacagtgaacatgcccaatggtgaaagactgaaagcttttgctttaagatcaggaacaaggcaaggatgcctgctttcatcgcttctattcaacatagtactggaagtctatccagagcaaagttgggcaagaaaaagaaataaaagacatccaaattggaaagcaagaagtaaaattatctctgtttgcagatgatatgttgttatatgtagaaaatcctaaagattccaccaaaaaaaaaactgttagaaataattcagcaaagtagcaggatacaaagtcaacacacaaaaatatggttgtatttctacacactaacaatgagcaatctgtaacgaaaattacagaaacaattccatttatgatagcatagaaaagaatgaaatacttagcagttaaccaagcaggtgaaagacttgcataatgaaaactataaaacatggctgaaataaattaaataagacataaataaatgcaaacacatcccatgttcatgggttagaagacattattgttaagatgtcaatactacccaaagcaatctacagattcagtgtaaaccctaccgaaatctcaatgacattttcttcagaaatagaa

SEQ ID NO: 179775 - DNA, 312 bp, Homo sapiens
aaaggaggaaggagttttggtggatgaccagcattttccaccacagctgactcatccaaggtggcctcagccactctggtttgttcattgaagaaggtggtaaaagtaggggctcataaaccaataacacagacacacagaaacgattgttctcggccgggcgcggtggctcacacctgtaatcccagcactttgggaggccaaggcgggtggatcacgaggtcaggagatcgagatcatcctatctaacacggtgaaaccccatctctgctaaaaatacaaaaaattagccgggcgtggtggcgggcgcct

SEQ ID NO: 179776 - DNA, 409 bp, Homo sapiens
tctattccaggatcttatgatctgtgtcctaactacatattatagggccccagtggtccctatgcctctggttctattgtcatcacacacttcctgtttcattcctatagacagatttattcatgactagggaacagattatgctagtaaaggtgttggttaacatgagtttaaggcaagaacttaaacgtaaatatctctagggattggacaggcaatatgccttaaatagtaaagctatcaggtagggattgactgcatgcctgcagaggaaactgctgcctatttagccacagaagattattgccatgtaaaaatgtgagtatggtttgtcacatatttttaaagaaaagtcagaaatccaaaaatttgtatgaaatttttaaacattttatattgtcaattcaat

SEQ ID NO: 179777 - DNA, 545 bp, Homo sapiens
tattttctaatgtgtttgttttaattttaaaattcttttaaaatagcaaaataagtaactcacttgatttgaaaaaggagtctattttttcacttggggaagctcaggggaattactctcctaactccagggttttggtttttgctcttttataggttatcaattgttataaaaatcataatacgtgattctcaaatatagcaaatcaaaacctgctctagagtatagtttataactttttatgtactatgccatcttgtatgaagagaaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttattaaatgtataatacagtgcatttaaaaattagttttcctatgtaggtgtgaggaatgatatatttgacagtaatgctatccttta

SEQ ID NO: 179778 - DNA, 835 bp, Homo sapiens
ttttttgtatttttagtagagacgggcgtttcgccatttcgcccaggctggtctcgaactcctgagctcaggcaatccacccacttcggcctcccaaagtgctaggattacaggcgtgagctagcgcctggcctatagttacgttactttagatgcctggattcaccagctaagaagttttttttttaattaaatttttttttggccccagtgctactaccaaagcagtcaggaagttgaagataaggcagacaactggattgattcaggtatatttaagtgggttgagggttattgatgaaatggttaaagttattaaagaccaaaggtggagaggggttgagggagaccaaaagtagagtctaactgggtaaagaaggaagtaaagaagaaaagaacagagaggacaaggggctgcagtcttaggttcaataacgggtgtaactggaatgtgagtgagagctggaagaaacaccaaaggttgtggccagagagtgggatgtctgaatttcctatttcagatgtagagcaattccacatcatgatagggtatatggtgtggccatgataaggaatggtgaaggttgctggaggtaaagaagaaactggaaacctaggtgtagctgggttgtccacatggccactgaggccatgcagtataaaggcttgagcagaagaaagtgagccaggtgttaaaccaaaaccatatttcccttctttgaaatcagttaagaattgaggcacaaaagctgaaccagcattatatagcagtcatttgtagaatctgctttgggtgaagtcacgtcagcctcaattagaggtttggcagttgtca

SEQ ID NO: 179779 - DNA, 231 bp, Homo sapiens
aaccaaatatactttagtttcacacgaaacagcgtgatagattgatttctttcccttatcttccataagaagatcctaaaggcctcaacaatggatcagaacagctgtgtcttggttataatccaatatcagctgtaagtctttgacatgtcagagttttggagtatctgacttaatgtggcacttacgttttttagcactttgcttttgagaaattagactatgttttaa

SEQ ID NO: 179780 - DNA, 333 bp, Homo sapiens
ccttcctcctcccctcaaggtatgtgtgtaagcatgatatttgttggtggtagcagtgaaggagtggggagtgaggatagtggacagaggttaattaaatcacccaaatatgatttgtagaatatctcctcttctggtttaattcttctttccaagtacaaccacaggagtcaaaagagcaccttaaaattttccaacaacctccatttgggaggaatgtgaatttcacagaaagagaaatttttgtgggttttatgtctgtgtgtgtgtgtgtttgtttgtttgtttgtttgtttgtttgttttttgttttttgagacaggcccaggcggct

SEQ ID NO: 179781 - DNA, 440 bp, Homo sapiens
tgtcacccctctttactcctcgctcaccatgttagttgtcggtgatgctcacctcttcccccagtccccccttcctcacactcggagaggacttcctccctgccctcatcaaagtaacaacggagcatctctgctctgggtatttatgtaccggtcttagctcctctatgaaagctgagtgtacattctttaggaacagaaaaccacagctgtctagttgccataattatacaattatgttccaagggtctaacatatagaaactgctcaatcaatctgttaaacgagtgtcaagcaggtgtgactctgtgtgccacagggcaagcgcagagaggaggcttactgattaaatatgtgcatctctattacatgcacgctaaagcttctttcactgcagcacaaaagacatttttaacagcacctgattaaagaaaaactta

SEQ ID NO: 179782 - DNA, 672 bp, Homo sapiens
tgctataattggattctccctctccccctccctccactttaaaagaccaaaatgataacactgagttcaggctaaaaatggtatgcaagttttggaagagacctaggcacaaaaaattatatttagtatattcgatgcttatcaattcaacaaaaatcagctacaaagggcctgttccagaactttagcaatcatcccaccaaattaggtcaccatatactaaaatctgacagaggtttgtgctgtatttttcttaaatggcaaagagagaatatgatcgagagcttaatagaaaacacagcccacaacataagaacaaaaggtcaagtcatattttgcaaactccaagatttgtaaatccatctccctgccccacttcactaacatctaccattctcaagaaatcacattacactaaaaaaacatgagttttgctctaggtaagaatgactaaagggaaatctcccttctgtccttccaatcacacagtaaatacagcacaagatttaattgcagtttataccatcatacatcccagtggggtggctcatctgagagctgaatcagtgacgccctttaacttagactccatgaccttctgggttgtggtaattaccctaacccagaaaacagtcctcagagggaaatgtcatcagtggataacttgtgcca

SEQ ID NO: 179783 - DNA, 576 bp, Homo sapiens
tggaaaacattcacatcaaagtgccacatcatgggtatgcatacatgtttgtatatcatagactatctggatgtttttaagtttcttatcgagatataattcatataccataagtgttgccattttgaagtgtacaattcagtggcttttagtatattgagaaggttgtacaatcataattccagaatgttttcatcacctccagaaaagaaaccctgtacccatgaacaatcagtccctctctctcacccccattccctagcaaccactaatctgctttctgtttctatggatttgcctattctggacatttcatataaatggaatcatccaatatgtggccttttatgtctggcttctacttagcatcatatttttgaggatcatccgtgctatatcatggatgggtaccatgttcctttgatggctgaataatacccccttgtagggatggaccacgtttagtttatgcacacatgagcttgagtggctgctctttaaagggtataaaagaaaccagttctccctggaggggaccagggaaatggggctcatggatggcaagaggttttttca

SEQ ID NO: 179784 - DNA, 191 bp, Homo sapiens
tcccttatggattactttttgtctataactaatcaaatgcaacctctactgcatattgtaggcaataaaaatcattgaaaagcatttacatttaattatacactgacaatacaattttaatataattaatgtaatataattgacgtgtgtctaaaatcacattctggtgaatgatgctgcttggtggggga

SEQ ID NO: 179785 - DNA, 392 bp, Homo sapiens
gctttcaaggaaacaggtaagaattgaaataagtgccagttatgtgagagaatacaaaagaagcaagccagtaaagaatttcatctaaaagtatatataaatagaagatgagagaatgaaagacttaaaagattaaatgtagaccatgaagcattgatattaccaaatgtaccaaaatgtaaacttaataagttaaaatatgtaagttcgagaatctagatagtgaaatgacttcagataatgagaaggtttgtataaaatgcaaagtgacaggctaggtttggtggctcacacctgtaatcccagcacttcgggaggcggaagcaagtggatcacctgaggtcagaagtttgagaccagcctggccaacatggtgaaaccttgtctttact

SEQ ID NO: 179786 - DNA, 372 bp, Homo sapiens
agcatgctcctgcacacacctctgggtgtctaccccagaaatccacacaaagagataaaatccagctaagttttcttcctcttccaagaaacaattgttgtggaaggagaaataagtctagatctctgtgccttacctcacaccatccatcacccacagaaatgatgcagggtcctgatgagcacctccagttttggagctaagagatttaaggtggtgcggccagcccatcagttctgccacctccctgtttggttccaaggtggtgtgggctgcagagcctatggaagtagggttgggacctcagaggaagtgacacttttgatgcttgtcccgggccccagctcaactctctgctcaccgtggtgtgac

SEQ ID NO: 179787 - DNA, 367 bp, Homo sapiens
aaaagatgtaacaataccaggggtcttgatagaagatagtgtagtctcctaagggtacaggaggaaaggggtttttggctgccaggcctccatcctcccagccttgccaaggtgtgatctactgggaggagttgtttatgcctatgctggcagccagacttcctgtgctcctgctcccttgactttcagatgttatcttacaccttggcgtatggcatcctcagcttcctgagcagatgggtttcttccccagtctttggaagagcaaagctgagtgtcgtgttggatggggtattaggttcctattgctacacacaattaaaacaacacaaattttttatcttgcagaagatcagaagtattagaa

SEQ ID NO: 179788 - DNA, 534 bp, Homo sapiens
cggacctgaaatgctgtctcatacataacacatacatccagttccacacaagagtccatcagtcatagtataaaatgtgtgtacaaattgctgaaaggcttggacagtaagattctcatcataacatgaagtacaattcttgctctgtatgactttaagcaaaagaacatgtactgaacactaataggatcataggctagacgctgtaaacatgatttactcgcccacacgcatgtcacagtacacatatgacactagccatttcttttacccataaaatgcatgccattacatgtatcttatattacaccaacacccatgatgtcatgggaaaaccattctgccctttcctgcactctattctttggatgtggaaagacaaaacgagcctcacaaatcaaccttgaactgtgtgtgtaacagggcccaagagcttgacaggccagtgtgatggggaccagaaaagtgattttaataatcgcaccaaagacaaataagaacaaggataacagcactggcctcctccctaactgc

SEQ ID NO: 179789 - DNA, 498 bp, Homo sapiens
aataaatcatacatacattccaaaatactggtatacataatatttaaatgtttttacaaattcagaaaggtttgttttttaaattttatcatttctgggtcatgtttacctctggagggcaagaagaagttgggctcagacaggcaaacacaggtaaccttcaatgacactgttttaattcttaactcggtagacaagttcaagaatattcatattagtatgctttttaacttacccataaaatgcatgccattacatgtatcttatattacaccaacacccatgatgtcatgggaaaaccattctgccctttcctgcactctattctttggatgtggaaagacaaaacgagcctcacaaatcaaccttgaactgtgtgtgtaacagggcccaagagcttgacaggccagtgtgatggggaccagaaaagtgattttaataatcgcaccaaagacaaataagaacaaggataacagcactggcctcctccctaactgc

SEQ ID NO: 179790 - DNA, 301 bp, Homo sapiens
tgttactgatcttgtcaccatttccatttttgataatgcgttcattctgacactgctgactttaattttgattttttacaatattgcattgagtattaacttaccttgatgactgggtgttagtatccccttaagttttgccctggagattagtgccttacttgcattgctcaagtttgggccctgcctcatgctcccaaacttccaccctgtctctgttcttccttgggccagtctttttgtccattcctccaatgactccattccttgtcaaattgagtcctagtaacttgcttgtaca

SEQ ID NO: 179791 - DNA, 258 bp, Homo sapiens
  misc_feature (1)..(1): n is a, c, g, or t
ntctttacatatgaattctgaaggctacccctttcccatttggatggcaagtatcttttcccaggctgcgtgtgagattttgctttatgttatgtgccgtttgtagaacaggggtttctaacttttatgtggtcaaagagaacagcaaaaaaatgataaaattggtaaaacatattgataaatctgaatcaatgtactgattggaaataaaataaattggtagaaaatcggggtagaactaattctagaagatgatat

SEQ ID NO: 179792 - DNA, 218 bp, Homo sapiens
tgagcatagtccattcccaatgagtgaaactatgttgctaaaatttaagcagtaagaaaataacatttagagttagaaaagacattcgatttagattggttcaaccctttcatttttacaccgccaccatattgcctctaaatctgggagtagacacatttaaaaagaagtcagtgttttatggctcatctttttttttccaaaggagaaaagttgat

SEQ ID NO: 179793 - DNA, 373 bp, Homo sapiens
caccatataatcttgtaggtttatgtttttgaaacatgattttctgtagttatgccagtaagtatagccaaacttcctgggcagactcagtagcaatccctgaaaatattgaggaggaagagaacttaacagccttcataggatgaagaagaatcagagggcattgtgcagatgaggcagcaggtcgaggggatgttgacgtcttggcagctctgagatatccgcttctaaatacagaattgcctgaggacgtagaagggcctccacaactgcaagtgatttcataaatgcagtgtatttgtagtctctcttctcttgacccctgcctttttttttttttaattctttttggttgtgagcaggggtaccgaac

SEQ ID NO: 179794 - DNA, 748 bp, Homo sapiens
ttattcttaccagctctatttaacatatgtagtcaatagccatgtgttgttgtggagtataataatagattagcctcaagaaaactataaattaacaaactaagtgacctgctcagaatgacacagcccacacatggcagagctaagactggaactccagtcatcaactcctttgcacactcacacatttcacactttaacacactgtctccttcaggcatggagatttgagaagtcccacggatcagcatcaagaacagatttcaatctctacagagcgacagtatctccaggaatctttcaagattcaccaaacaaaattcatttccattcgtcttcatattccacgaaaacacaccaaagctgccttagggagagggtgtcgccccatcagaggtgtcaaggaccatgcaaggccaggggtcacactggcctcaacaatgtttcagacaaaaacggctcccttgggaggctccgaggctgtcatcgatttgctaaaggtcagtacggatcatttgggaatggatttgtgtaggcatggcctaagacacatggacttctgccaagcctatatatttttttcaaaacatctgcactgtcttcacccttgataaatagcagccaggctacagaaatatttccattacgcacaaaagcctgctttgccaccacaactcattgaaatggatgtttccaacttgagaagaactcttcaatgaaaacatctaaaaacaccccaatcttccag

SEQ ID NO: 179795 - DNA, 224 bp, Homo sapiens
gagggtctcttgttggatttttactgctgtgttgtttgttgattatattttccctccctagggataaatttacaaagaagaatttagatttgagctgtttattgctgccttgtcatcagatgtatgaagcccagttgggggtgttatgtgttaaatgccagtagttagtatcttactaaggagtgttcaaatacagttgttcggtgggattctggtaggtatag

SEQ ID NO: 179796 - DNA, 203 bp, Homo sapiens
atcgtactaccacactccagcctgggcgacagagggagactccatctcaaaaaaaaaaaaaaaaagtcaccacacatttgaggaaaaattctgttaaaataaaaactttagacaaattaaatttagcagagtttatctgagcaaagaacaattcatgaatcagccagcatcctgaaccagtagaggttcacagagttttacca

SEQ ID NO: 179797 - DNA, 207 bp, Homo sapiens
atactagcacaatacgatatccttcatttcatgtttgactttcatagtcttatcataaaaatgacaaatttttacaaaaatatttgagggcttcatcaattttccctaggcccctcttaaccctttgatacacaaaccattatcttctgaagcacttatatcatcatcctgagcagtatttttcctcttcatttaagttaacaagat

SEQ ID NO: 179798 - DNA, 457 bp, Homo sapiens
ctggtcccatgcaggtgtgtttctagaattatgggcttaggatcataatattgctgttttacattttgcctgaaagtgttgttctcacactaatgtctaaaaaaatgccactgagctccttaacattttgtagagggaaccatttataaaacactctctagatgtttctgtcccaggtaatagaacgcccagcacttgattacctgtagttgttacagaaaatgcatgtgttccatggaatgttaattatttctattcactgcctaaattggagcagttggcaataattctctttgaattgctattcagggaaagctatttaagcccaaacacaggagtaacttttaactcctttgccaaacagcttgcaccttttcatgattagcttcccttatgcagtctgttttcaacaactatcattgaaaatggaaaaagtaagtaagtggaaaggaagtaa

SEQ ID NO: 179799 - DNA, 737 bp, Homo sapiens
tcgaatcgacggtttctctctttgacttatagatggctggtcttcatgtttacatggggctctgtgtccaaatccaactccactcaccccccgacttttttttaaattgagacaggatggagtgcagtggcgtgatctcagctctcgcactgtcttctgggctggagtgcaatggcatgatctcggctcactgcaacctctgcctcacgagttcaagtgactcttctgcctcagcttcctgagtagctgggattgcaggtgcgtgccaccacacccagctaattttttttttgtgtgtgtgtttttaatagagatggggtttcaccatgttagccaggatggccttgatctcctgacctcatgatccgcctgcctcggcctcccaaagtgctgggattataggcgtgagccaccgtgcctggctcaaaacatttagttttaataggcattttagggtatgtcttagtccatttgggctgctataacaaaataccacaaactgggttcttacaaacacagaagttgatttctcgcagttttggaggctgggatgtccaagatcaggcactgatggattcagcatctagtaagggcctgctgtctggttcatagatggcaccttgtgtcctcacatggtaaaggaggtgaagaatctctccctggcctcttttgtaagtgcactaataaggacacttcccaagttcccatctcctaatacagtcacattggtgattagg

SEQ ID NO: 179800 - DNA, 286 bp, Homo sapiens
ttctgcatttcagactctaccaatttaacttaggctctcattatccctccctcaaaaagtagccaaacatttctgtatagccaatctaatcctccaacaaacatcttaatcataatactcatgtattcaaaattcatccacaagcccatcatagaattcaaacactttttttctggctttcaaatttttcaaccatctggctctgatccacctatctcataaaatgatactgcattgctatctattatctttattctaccttcaaaattcagtaaaatataaatct

SEQ ID NO: 179801 - DNA, 416 bp, Homo sapiens
aggtcgactgaccgtggcccatggcagccacttgccagtctcgtcgatgctctttctgtcaaggagggggagagcgcctgtgtttcatttccaaatgactagccacaaaagccctttctggcggaaatgcatctgtttggctgtttatcatctctcagtggcgtctggaagtccctgagacaaaagaaacacaggccggcatgttctttgtttcccaatgaaaccaaccaaaatggatttctattttgattcagttcctgcgacctttactaatgcagccagtagcttgattggcaatggccctcttttgtggtgttgccaggaatctgtctttacaccattgttctaacattgggtgggttgtcaggttttgctgggagcccctcaagcctcatgtgcactagaaatgagctccc

SEQ ID NO: 179802 - DNA, 319 bp, Homo sapiens
aaagtcagactgattctaaaagaaccaagcgagtgcttttattgataccttgccctttgcagagtgtgtcagtgagtaggtgacatttgcttgaggcttagctccatttgttactgaagggatactctgggtactggcagaacagaaattgataaatagaaaagaggctttgggttgaatgcggctcttcttacaatcattaatgcatccaggtgtttggaattgtagtctggttagtaaatactggttgagactatatttccatctagattaatggtgttttccagcaaccaaggcaggtgttctgtgcaactgtagt

SEQ ID NO: 179803 - DNA, 355 bp, Homo sapiens
tatagcaaaagagaaactgagaagcacccccgagagacctgtattgggaccaggagtgggcagcctatagcctgcaagaactgggcagggctatgtgctatgcactggggtcatcaatccagttctcaactggagtgcttcttggcaacctggcatgttgtctgagggcaaagaaaagagggcaggtatcatggagggttgatgtcttgtggtgaaggatcaaacctaaatgtgatgctgctagactcaaggggcacccattggtacttacaaagtcactcaaaggcttggactctatcttcaacccagagtacaatctctaaggccatctctgcccctcttcccagtatattca

SEQ ID NO: 179804 - DNA, 348 bp, Homo sapiens
atctcaccattgcactccaggctgggtgacatagtgagactttatctcaaaaaaaaagaagaaacaaaacaaaacaaaaattagctgggcatggtagcacatgactgtttaatctcagctactcgggagactgaggcaggagaagctcttgaacctggggggcggaggttgcagtgagctgacatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagttt

SEQ ID NO: 179805 - DNA, 253 bp, Homo sapiens
tggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagttt

SEQ ID NO: 179806 - DNA, 622 bp, Homo sapiens
cagaggtggtgataagcggtggatgccacacacgctttgaaggtagagaggacacacttgggcctgtgggatgggctgatgggttgaatgtggggtatgaaagaaaagagcaatcgacgatgccacccaaggtttgaggcctaagtaatgggtcgatgttgttgagctttactgagatgttgaacacaagcagtaacaggtttggagctggggagagagtgcactaaagacgtggattctgggcatgctaatttcctgtctatttggcattcaaatggaggctgaatctggcactcagaagagagtcagggggcgggggggcagcggagatgaggcagaggcctgagtaattatcagaatatggtcattcttgcctggatattcctgggcagctcagctaacctgctggatttgcacatccttatgtgtaaactggacatagcaatacactttccaagccagacccctatgagtccctcacgccttagtttccagtacacctcaagggacaattctgaaatccagttgttttctccttctatgataattaatttaaaaagatgaaaatctgacctgcaagccattaacaaaacaatcacagattgacttcatacagcctaca

SEQ ID NO: 179807 - DNA, 684 bp, Homo sapiens
agatgaataaaggaaaaaaatgagaagatccaagtaaacataatcagaaatgacaaaggggactttaccactaaccccaaaactagcagaagacaagaaataatcaaaattagagctgaactgcagaaatcaagaaattctttgaaactaatgagaacaaagatattacataccagaatctctgggacacagctaagggagtattaggaggcaagtttatagtgctaaaggctcacttaaaaaagaaagatctcaaagtaacaacctaacatcacatctagaggaactagagaaacaagagcaaactaaccccaaaactagcagaaaattgaaactagccactgtccttacaccatatacaaaaatcaattcaagatggattaaagacttaaatgtaaaacctaaaagtataagaaccctggaagataatgtaggaaatactattctggacataggccctggcaaagatttcatgatgaagatggcaaaagcaatagcaacaaaacaaaaatggacaaacgagacttaattaaatcaaagagcttctgcacagcaaaagaaactatcaacagagcaaacagacagcctacagaatgggagaaaatatttgcaaactaggcatctgacaatgatctagtaacaagcatttataaggaacttaacaggcaaaaacaaagagcttca

SEQ ID NO: 179808 - DNA, 727 bp, Homo sapiens
acacaacctggcaagcctggatcatgaagaaacagaagacctgaatagatgtaacttctaaggagactgaacagtaatttaaaacctccacacaggctgggcgcagtggctcacgcctgtcatcccagcactttggaaggccgaggcgggtggacacgtgaggtcaggagttcgagaccagcctgcccaacatggtgaaaccccatctctattaaaaatacaaaaacttagccaggtgtggtggcaggcacctgtagtcccagctactcgggaggctgaggcaggagaatggtgtgaacccaggaggcagagcttgcagtgagccaagatcgcgccactgcactccagcctgggcgacagagcgagactccgtctcaaaataaataaataaataaataaataaagtaaagaagtgaaagaatagctattccataggcagagcatggcattccaaaaaataagaggaggaacgtgcccacctaggtacaatgcttgcttatatataacaaaaatcatggaggagatgtgctctactacaagggtttgtgatacaggattgctaatctttgtgtaactactgtctttcatgagagcctttattattatctattttttttttttatactttaagttctgggatacacgtgcagaacatgtaggttagttacataggtatacacatgccatgatggtttgctgcacccatcaacccatcatctacattaaa

SEQ ID NO: 179809 - DNA, 820 bp, Homo sapiens
tccccctcccccccccccccctcccgccccccgcctacgagagattatagctcgataccggttgttaattcgtccggggactaggctaatcgtaatacatggcctgtgatcctagatatagcaaacagaagacctgaatagatgtaacttctaaggagactgaacagtaatttaaaacctccacacaggctgggcgcagtggctcacgcctgtcatcccagcactttggaaggccgaggcgggtggacacgtgaggtcaggagttcgagaccagcctgcccaacatggtgaaaccccatctctattaaaaatacaaaaacttagccaggtgtggtggcaggcacctgtagtcccagctactcgggaggctgaggcaggagaatggtgtgaacccaggaggcagagcttgcagtgagccaagatcgcgccactgcactccagcctgggcgacagagcgagactccgtctcaaaataaataaataaataaataaataaagtaaagaagtgaaagaatagctattccataggcagagcatggcattccaaaaaataagaggaggaacgtgcccacctaggtacaatgcttgcttatatataacaaaaatcatggaggagatgtgctctactacaagggtttgtgatacaggattgctaatctttgtgtaactactgtctttcatgagagcctttattattatctattttttttttttatactttaagttctgggatacacgtgcagaacatgtaggttagttacataggtatacacatgccatgatggtttgctgcacccatcaacccatcatctacattaaa

SEQ ID NO: 179810 - DNA, 326 bp, Homo sapiens
agtagagactgtctcttcagttctcttggccttcctacaatgggaagtctggtgtagaacataccctaggagccaactaaatgtggtagtggcctgccaaccctgcagagggctagcaaatcttcagggagtctgctgccggtggaaactcaccagtactagaatcccaggctccaaagaagtctagaaaagtacgtcttttaaggagctaataagaggttcaagtttccacaaatcctatctgctcttggcctagttcttttgggatcagtgtgctagtctctcttgtcaaactagttactgaccagcaagactaaaaaaccagg

SEQ ID NO: 179811 - DNA, 203 bp, Homo sapiens
aagactgcactttgttttgtgttcattgtatttgttttcacggctagcctctgcacgtgatgccaatgctggcttgctctttcagggagagagggagggagagaaagtgtcttctgaaaataaatgtatttcggtaaacaaacaatgtgagccttttaacttttttttttcttattttttttttttgagacggaatcttgctc

SEQ ID NO: 179812 - DNA, 377 bp, Homo sapiens
aactcttggcttccaggttctagcactcattactaccatggacagcagcttccttttaattcagtgggattctgccaggcaggcttccaggggagctgtggggtctagtacaagtttctcccctgttgctgcttcagtggctttcaccctgcccaatacatatttaatatgacaccatgtgtctctttgtcagtctcctcatattgagcctaggaattggcaaacactccatgaatatttacacattgacttttttttaagctcttaagagaggaatatcccttggagtcctctttggagatttccagtgtctcatcatcaagcaacatgtcctttcagctaataagatctttatgtttcataatcattgcttaata

SEQ ID NO: 179813 - DNA, 652 bp, Homo sapiens
  misc_feature (25)..(25): n is a, c, g, or t
  misc_feature (60)..(60): n is a, c, g, or t
cagttcaaatctcgttactaggctngagaagaagaggcaaaaacctcccccattcctatnggagcggtggcaggaattcacagcacaaaaatagctccttaaagaaattctcggccaggcgtggtggctagaagaaaaagagaatttggaaatcacaatacactttattgcttttcaaaggctaaagtgcagaaattatgttgaaagactaattatccttggcatataggaataatggttggtggcagcattagaggtcactgtcccatcaataactgcacatttgaagtaattcaccaaggctgttctgaacatatgcagaccaagaagcactgggacccaagttatggaatgaatccatctatcactgactattacggttgagggaaggtcatttaaatctcattgtatctcaattccttcaaaggtcaaatctctttgtgtcttaattccttctaaggccctaactcccacagacagtacagaggaaaatgcacctgcaaacattttggacagcattttgtactatgcacatataaataagttaaagacctggtggaattccatgattttactcattatatactcagaaaaggctagaaaggaaattaaaattatatttgctatcttgggaataagttcagtttctttt

SEQ ID NO: 179814 - DNA, 514 bp, Homo sapiens
aacacagagtgcaagtaattatatctgagtaattagcctcaagtaatactgggaaggcaggcattatcttagcttcactttggaggtcagccaaaatccctattcatcccttcgtgggcctctcatttaaggaggacttttcccaactgctatcagagaacaaatatttggaggtgatttttctgcctccagtgatgaatgaggaaatacctgctccccgtctctgtaatcagtccatcaacactctgagatcttggggaggtgtatgtttaatttatatcctacctctttccaaaaaagatttaaggtagcttacagtaaaggctcatatgcctagggcaatgtaaaaaaaaataagaaatatctaaatacattatagtaagaagagatagaggagggtgctctgaagtagtagcaggttggtcttgcaaggaagcaccaagtttggttggaagtatctggcatgcacagcgaggtgagaggcagaaagaagtcattctgactgcccttgcca

SEQ ID NO: 179815 - DNA, 257 bp, Homo sapiens
agctacggggcgggctgggttggggggccgctatgccgagatgaaggaaagtcggccttggcttcagaggtggatgcatgttgctttctctggagtcatctcagctgagaggcagcttctccatccttgcctggtctagttttaggtggcttattctagagacaggcattcatgttgtcatgatccactagaagctcgaggctggaatcttaggtgtggaagtgatagtaggcctcttgaagggagagaaggcacta

SEQ ID NO: 179816 - DNA, 152 bp, Homo sapiens
agctcctgtggcagttatggtcttcatgcaatatagaagttgttaactactatgagtagagtctctttcatgagaatactaacattcttcctacttgttaacttttcttatggctttacagttcatggtatataaggtgcttctgttccttt

SEQ ID NO: 179817 - DNA, 230 bp, Homo sapiens
tgcccggttaccaggcggagtacagtgacatgatcatagctcactgcatcttcaacttgcctgtctcaggtgatccttttgcttcagcctcctgagtggctgaagctcacacctgtattcctagcactttgggaggctcaagtgatctgtctgccttggcctcccaacgtgctgagattataggcatgagcccctgtgcctggccaaaatcctcattttttaacaccagg

SEQ ID NO: 179818 - DNA, 612 bp, Homo sapiens
tggcaggtgtctcattattcagctccacttatgagtgagaatatgcggtattggtcttctgttcctgtccccatttccaacactggggattacatttctatataagtttccaataattttggaatacatactaataatatatttatgaaaatatggtccaaagtagacaaaacaccattcactcttctatttgaaagttttccttctattctaatgtcacaatctccagcgttattaatcagaatcctgcatttaagggcatctgttaaattttatagctgattataaaaccatcatttaaagaggaccaaaatgagacaacatctgtctgtggatgacaaaaacattaaaggcagccacagttgaagacacgaacaacaacctttaaagtagaatttgctgtagagcctattatgagggggacatttctagttattacctcttttattctaaaccatggaaaaaggacctatcaaataaagtccttctagaagagtgaagggctcctggcaatgttctctttaatccatgatgtgggataaggggagttttgactgattatgaggcaatgtagatgccactaaagtttcaacaccctaaaaggaaaaaaaa

SEQ ID NO: 179819 - DNA, 574 bp, Homo sapiens
gctcccatggaccagccacctcccagcaggacccatttccaacactggggattacatttctatataagtttccaataattttggaatacatactaataatatatttatgaaaatatggtccaaagtagacaaaacaccattcactcttctatttgaaagttttccttctattctaatgtcacaatctccagcgttattaatcagaatcctgcatttaagggcatctgttaaattttatagctgattataaaaccatcatttaaagaggaccaaaatgagacaacatctgtctgtggatgacaaaaacattaaaggcagccacagttgaagacacgaacaacaacctttaaagtagaatttgctgtagagcctattatgagggggacatttctagttattacctcttttattctaaaccatggaaaaaggacctatcaaataaagtccttctagaagagtgaagggctcctggcaatgttctctttaatccatgatgtgggataaggggagttttgactgattatgaggcaatgtagatgccactaaagtttcaacaccctaaaaggaaaaaaaa

SEQ ID NO: 179820 - DNA, 445 bp, Homo sapiens
ttcagaggatcccaagtcagttacacaaaaaaaacagtaaaaaattgaagttgctattattccttgaaaggagaggtgaaagacattaagtgtctaagatgtttacacacataccttatctatgtaaggctgtaaagatttgtgatataaatttccccatatgaaatggcatgagagtatggctttcttcttattgttggatagtttcactagtttacaacagtttacccatagaattattatcttctaaaaaatgtttataaacatcaagcaacaagataatgctagtagtacctttatcttctactctgataccctttcctcgtcgtcacatttttacttcactaagatgtgtgtattttagtgccaggtatactgtaatcctatgaaaaaaaaaatggaggagaggaactatgttgacttttatattgtgtaaataggaatc

SEQ ID NO: 179821 - DNA, 604 bp, Homo sapiens
ccacaccaccgaacatggaggtccaatgccgattcatgaccctgagagctccatcctgagggggcgggcccggaacttatcatttactctgatgctttcctgaaagcacttgcaaatcgctatgacacaaaacttcaagagattcataaaaaaaagactcaagcacaggtgtctgataacttttaaatcacactgttgaacccattaaactggggttgttcttagccttacagccctgtgaatgggagctggatgacttcatagagacttcagagaaattgctacaacagtttatacctggacaaccttggtgcctgaggctgtgttggccacacagaaagttcaccagaaacctgatgatatcaccagagacatccaagctgcaagccgggaacacccatcggattgaaactgccacaccagaagaagaaaaaacaaatgctatttctatatgaatacatcaggaatagatgcccaaatctgggatctttagaaatataaaaggccaggtccaggtgctccaccagacgtgggaaataccgtcgactgatctagttaaatcaagagattaaatctcggctcttggggaccctagtttcagggt

SEQ ID NO: 179822 - DNA, 377 bp, Homo sapiens
tgatgtagatgtaggcatttagagctatgaattttcctcttagcaccacctttgctttgtcccagaggttttgataggttgtgtcattaagttcgaagaatttttaaatttccatcttgatgtcatttttgacccaatgttcattcaggaccagattatttaatttccatgtattttcatggtttggaaggttccttttggaattgctttccagttttattccactgtggtctgagagagtgcttaaaataattttaattttctgaaatttattgaggctcattttgtggcctatcatatggtctatcttggagaacattccatgtgctggtgaatggaatgtgtattctgcagttgttggatgaagtgttttgtat

SEQ ID NO: 179823 - DNA, 120 bp, Homo sapiens
gccccccagattggccgagatcttcgtgatggtttagtatgaccctattactagaccattatccatccttagcaccagcaacggctgtgatttttgtagtgttcctagatttactgaatg

SEQ ID NO: 179824 - DNA, 259 bp, Homo sapiens
aatgatgttagtattttgacaggatttgcaccaaatctgtagattgggcaatgtggtctcttccatgatattgattcttccaattcatgagcatgggatgtatctctgttcatttgtcatccatgatttctttcagctgtgttttgtagttctccttgtaagagatctttcacctccttggctaagtacattcctaggtgggttggttggttggttttgtagctattgtaaaagggattaagttcttgttcttgatttg

SEQ ID NO: 179825 - DNA, 323 bp, Homo sapiens
caacctaaaagcccatcaacagaagactgcataaagaaaatgtggtacatatacaccatggaattctacacagcgataaaaagaatgaaatcatgtcctttgcggcaacatggatggagctggcagccattatcctaagcaaactaacacaggaatagaaaaccaaataccacatgttcttctcagttataactaggaactaaacattgagtacacagggacacaaagaagggaaggacagacactggggcctacttgagggtgggaagagaatgaagactaaaaacctatccatcaagtactgtgtttatttcctgggtgat

SEQ ID NO: 179826 - DNA, 259 bp, Homo sapiens
taaatatatgtgaaaaaaaggaaaactattgaatttgggcttttattttatgctgacatatggaaaagagagtaaatgggttaatttagtagaaataaagatcaacctgcatgtgaaaaatgctgttctactatgtccttctctttccccagtacagcctgagtaaaagcaaaagggctctgccaggcttattaattccacagcactcccttctgtcctgtgatgcagcacagaataaccctacagcgattgcgggaga

SEQ ID NO: 179827 - DNA, 330 bp, Homo sapiens
ccattcatcacacttgaaacttggcctcaggtctatggtattttgaaattttttgttgttgttttgagagtgacatgagtgcaggcccagcttcatggatatacaaactatacattcacatgggttccacacctagatgggctcttacatcatgtagctggtcctacctgggagagagctaaaaattaagttgcagtcatcaaattactgatcagatactgaaattaaacctgaaagatgttgagaacccagagaaattctcaatcatgttaataatactttcatgcatttgacatttcttttttcctgcctcttctctctacctgtaga

SEQ ID NO: 179828 - DNA, 168 bp, Homo sapiens
aaatgcatgtggcagtggttcccaaacactggtgtgcagatggaacacagcccgtgaagttttcagcggtccttgttaaaaagagataaaggaaagagataaaggataaagtgctgagattctcgtgaagctaaatgaagctaaataaacatccttcaatgagaatat

SEQ ID NO: 179829 - DNA, 403 bp, Homo sapiens
tccatcaaccccacattatttcctacataataagatggttgtgtaagtacaatgcaaccatcaaaatcaggaaataaacactgttacattactattatctaatcctcatacccattcaagctttgccaattgtccgactgtcttttacagcaaaagaatatagttcagaatcacgtgttacatttagaagctacatctttttagtgtcctcggtctttccttaactttgataaccttgacacttctgaagattacaggccaattattttgtagaatatcagataaagcaggtgttttatagaatgtcatcaccagtcttacgttatgcttctttggtagtaaatattacagaactggtgctgtattcgtttcattgcatccttttagatggtagtggttttgg

SEQ ID NO: 179830 - DNA, 160 bp, Homo sapiens
aaggagttctgttagaattgaaaaggtaggaagctggaggcgcagtgtccacaaatgtaacagagtgtcttggtgtcaggaaaacacagcagggcacaggtcaggcatgtggtttgggcagcagcagtgggagcagggagcagctcagtggtagatggga

SEQ ID NO: 179831 - DNA, 295 bp, Homo sapiens
tctgattctaattttctctgagaggaattttcagagaggaaagaagtaacaagtatttcataggccaactctattgttaggacagaatctttcattctggacctcatgaggcccacgtatcttcttcacagggcccaggccctccctgttttccatagcatctaacacttaccctcatacttttgtcatctattattttcagacaaaatcccaactctaggattctaactctaatctactttttaatgatcccataagtcagtgttgttggtttgacattcccaaatatctcaca

SEQ ID NO: 179832 - DNA, 185 bp, Homo sapiens
gatggacccagaactggagatctaaagtcactttggtcgtgggcagggggcttgcacagggggttgacagcactgaaggcttacagaacacttttacagtccccagttttcagcttcccaaactctcgtttgtttttggttttgttttgacatggagtctcgctctgttgcccaggctggagtgc

SEQ ID NO: 179833 - DNA, 298 bp, Homo sapiens
gactctcgaatcgacggttctccttctaaacatgtgtacaggacaggatcatgcataaggcgacttgggctatgccgtgcccgcctcaggccccggtattgcagctgtccagtcatggggtgcaggtgaaacaaattcacgtgccgcttgtgtgcttgggctagttttgtagtcacttgagaaagatgggtgatcatacagtgtacattccacttatgtaaaagtcaacattagagaaactacgtgctctgcttcaggaaggcgaacgtaagtgctaacactcggaaaacaaacaaag

SEQ ID NO: 179834 - DNA, 204 bp, Homo sapiens
taccattacccagcaaatacctgtgatgtgccttgtataggatgtttgttatctcaagcctcataacaaacttcccagtttacagatgggaagctgaggttaaaatatttaaatggcttgcctaaggtcacacagctagttaagttgttaagctagatttgaatccagtataccacaatgacgcaagagaagattaaacctgca

SEQ ID NO: 179835 - DNA, 286 bp, Homo sapiens
ttgagatcggcctgggcaacgtaggtgcaagattttatctttacaaaaaattgatttaaaaaatagtctggcagccaggtgcagtggctcacgcctgtaatcccaacactttgggaggccgaggcgggtggatcacttgaggtcaggagttcaagaccagcttggacaacatggcaaaaccccatctctactgaaaatacgaacattagccagacgtggcggtgtgcacctgtaatcccagctactcaggaggctgagacaggagaatcacttgaacccgggagct

SEQ ID NO: 179836 - DNA, 644 bp, Homo sapiens
gcattggtgattgggcatcatcaagttattttcaccagaaagcaaacactatgggtagggatcaaaattgagcttcaccaaaaaccatcaagcactctgtacgcacccccaacccacatcagcttgcagaatgacagcagagtctaaaaatgtttttaggaaacatgatgtaaagcaaaatctgcagcttctgcataatgaatgtgcagcataaacaaatttgtcagtcccctcatgcaaaacagcaagtcagtacatgctggttaaacacagcaggatcggcctggggctcggagaagtctatgcagttcctaaaacagttttaatttttgattagttttgatttgagcatttatttgttgaacttccagttctttgcaaatagaaaagtgaaaatagaggtatcaccttctaaatgatgggtttttgttttgcacctggctaattggcaattttaaaaaaagcaagctgtctctttaaatgttttgggtggagtgcctcttcctctctgtcccctggtttctcctttaatcaccctgatagttccagctgctttccgagctcccttctgggccgtgcgggtgggttggagaagcctggcagaactgtggcagtgactgcgtgagcaactgagaggcctgtag

SEQ ID NO: 179837 - DNA, 332 bp, Homo sapiens
cagaataagcaaatccatagaggtagaaagtggattcatggttgccaggggctgagaggagggggaattgggagtgactgctaacaggtacaggggttcttcttggaatcatggaagtgtttgtgaattagatagtggtgatggttgcataaccttatgaatatattaaaaaacactgatctgtatacttgaaaaaggtgaattttacggtatgtgaattagagcttactaaaaatgaaagcagataagctaataagaaatacaaggaacagttttatgccaatacactcgaaaatttaaatggacaaattcctagaaaaaaaatgcaactt

SEQ ID NO: 179838 - DNA, 411 bp, Homo sapiens
ccactggtatcgaaggacgcctgagcagagggaagcactttgcgagtgtgtttacccctagtccacagaggcagaaacagatatgctgtccaggatcccgaggcagcccagtcattattacatctttattgaggttttacaaagtgccaggcaccatgctaatggatctgcatatgttatctcatttcctccttgcagcagccgtgggaagtaggtgttatcattatccacattttaaagacgaggaaactaaacctcattacttatgacttacgtatttaatgagttactgaaatcgtaaagtaacttccacaaggtcaggcagctactaagctttagagtttcagctgtaacctggtcttgcaactctgaagtgggtgcaactgcctcccaaacagcattacctttcac

SEQ ID NO: 179839 - DNA, 390 bp, Homo sapiens
agaaaaatgctgaggaagaaaaacaaaaatgagagacaggcgattgagggaaggagagcacagctaaggtggagagtggcggtagccctgcacctgcagctgttggtgcagctgggtggtgggtgggcccagagcacacgcgtgtgcatacagaagtcgagccgctgagccactgtcagtgcaagaatgtcagccctgggatggggatgagccggcttttatctcttccggctgtgcaggatttacaagcttttgaaacgcaggattaataagaagaggccggtgttttaatctataatggaacagaaagtatcattattgttaaataatgcacagcctgtcgtttattaagaattaatggtttatcgagtgctcaggttgctgcagccg

SEQ ID NO: 179840 - DNA, 413 bp, Homo sapiens
attctaatctacacaagtgacacaatttgttagaactacacagagagtgcatgtaaaactgataaaatccaagtaaaatctttcttgaattaataacattgtctcaatgtcaatttattggtttcaacaatgttctatggttaagatatcaacgtcagggaagttgaataaagagtacacaaagaactctgtaccacttttgcaaggtcttgtgagtctgaaattatttcaaaagtaaaaattttttttttttttttttttttttttttggagacagagtctcgctctatcgcccaggcggcatcctttccaaaggcggtatataatgattgtaccatagttcatcggacagtggcagggctatccataactggcggtggcatacagcatggtgcacaaacattctttggggg

SEQ ID NO: 179841 - DNA, 298 bp, Homo sapiens
caggtctgagccagcacccccaatcgatatactgatttcatttcctttggatgtgtatggtagttcaatttttaattttttgaggaagctccatactgttttccatgatagttatactaatttccattcctaccaactgtgtagcaatgtcccttctctccacatttccttattggtgctcagaagtcaaaatttgagggaactacagtattagtataaaaatgttaaagcacttttatgggaattgaaagaagacagctgcaatttcaggaaactgattaagaaacacttggtcatg

SEQ ID NO: 179842 - DNA, 181 bp, Homo sapiens
cagtgtccattttaattacaaatcaaagtaacatgcaatagatgaagtgttttaaaaaagtatacatggattctattgaaacctgctgtcacccaaacctgaacactaaagtgattcaagattactttttgaaacagctgaggcagacatttctaacttaatccaacagtgaaggtaataa

SEQ ID NO: 179843 - DNA, 597 bp, Homo sapiens
  misc_feature (586)..(586): n is a, c, g, or t
acactaacatcagacaaaatagacttaaaaaaaaatgtgccaggtgtggtataatgactcatgcctgtaatccaagcacttcaggaggccaaggtgggaggatcacttgagttcaggagtttgacaccagcctgggcaacatagtaagacctcacctctgttaaaattcaaaaaaattagccaggcgtggcaacacacacctgtagtcccagctacttaggatgctgaggcaggaggattacttgagcccaggaggctgaggctgtggtgaactatgattgtgtaactgcagtctagcctggacaacagagtgagaccttgactcaaaaaaagtaaaggggatttattagtttagtatgtaaaaatccagtggtagggtgggattcagggttttttgatgaggattctgactccatttttctgtgattatttttgtcctgccaccttcttgagtcagctttgttctgaatcttgctttcctcatggaggtaaagtgactccagtgattgcaagattccatcagcaagctgcatattgtaggagagagcatctatgttcctgaattcctggctgaagtcctaagctntgagctgatta

SEQ ID NO: 179844 - DNA, 171 bp, Homo sapiens
accagaagtctgaaaggtgggcctattttgtccttaaaacataggaagagcctgtagtatcatttttaggttgagacaaaagaaaatcaagatatgggccactcattgcagatgatcttctctgcctccccatctcctgcttggcccaaaagcagcctgctgggagatgca

SEQ ID NO: 179845 - DNA, 503 bp, Homo sapiens
acgtgaggtcaggcacaacagtctcttgagtcgtaactgcaaactaggaatgaaacgagtatcaaatcataaatctgaaacgtggtgtgcacgtcaccattctgcctacctaaggcaggagatctgctggctctggggagtgtacatggggccatcagattgtgtattcttggttttcacctaaaaattgatgcagagggatcacaatgttaagattttcccagggtagtgtggtgcgtactttttaactgtttgcttaaagtgtatcacagtaaaaatattacttaagcatagtctctgccatcttctgacttaatagaaatccctagacaggtacatgatgttacttagagtgagccacctaatctaacaaggcttccatttcctcacctgcaaaaattgggagtgtcagaggtgtttgagccagagttactccatctttaataggggctgggtaaaatacggctgagacctactgggctgcattcccaggaggttaaggc

SEQ ID NO: 179846 - DNA, 492 bp, Homo sapiens
caggtcaaggggggactcctgggctttgttctgaggcagtgggcagccacaaagcttccaagcatgggagtgatgagggctgacgtaagtgctagaaaaatctcgatgctgtgtggagagtggacaggaagcggcgggactggaggctgtgactgtttaccttcatgggaacacctgcatacccgtgcacgcgcgccaagcccacccacttacgcatccagctgacgtgtactgtggccacaggagctggcccatggctcagatgtggcacctcagttcccccctacccaagcaagcctcatggggcccagaacccaggcccttccccccatctttctgaggagtccacaccaagggcctgacccagggctgaaccttaggcctggctttgaccaaaggttccaggcagccacccggccagccagactccagggcagctcccggggcacatgctcacagcgggaggctgggagcatgggtctgcaggggagc

SEQ ID NO: 179847 - DNA, 576 bp, Homo sapiens
ttgagcaagcccaactctcagccagggactagaagcaactgatggaatggccaaggaaaactggccaaggaacattctgcccagtctcatttgtcctgggagataatttcaacatccgtggggtgggtgtgctcacaattcctacaagggctgcccttaggctgagattaattttgtgagcacaggctttatttgctgagtattgacagatcaatatattgttgggcctgcgttctatagactactgaaaacatgagtgcaggaagagaggaatttcaggtgatggatgcactaaaagttgaagcccaagaaacgcaggagaactggctacacatggcccttgacttacaatggggctacctctcaataaacctattataaattgaaagttcaacttacgacattttcaacttacgatgggtttatgcggatgtgaccccatgggaagtggaggagcatactgaatgcgtattgctttctgccactgtaaattcgaaaaaatcattcagccagaccatcgtacgtcagggaccctctgtatttagagtgcgatagtgcagaaagatactgacatca

SEQ ID NO: 179848 - DNA, 380 bp, Homo sapiens
agacagatgttggtccagccagtgtgatgaaaccacctcaactgcatttgaggtatagtagatcctcagaatctcacaccccctctgtcaattctgatgaagttaaaatatgtggtagtagcagcagagctgctgacaaacatttgttacataatcctcaaagaatcatcacggctttgcagaactggagaagaaccaatgaatgctatgcacatcctacataaagagccaaggatgatctcagaaaaatccaatcactaatcccaccaaattattggcttcctacctcacctttccaaaggagcattttatctttcagcaaaactcaactgccactacatatggtgcagacttgctgtctcaaactctagaatcctcaa

SEQ ID NO: 179849 - DNA, 574 bp, Homo sapiens
cagccccatcctagttttatgatactgcaattatctaaaattattctaagaggcacacgaaattttcatgacaaaatgaatgtgacattggtttaattaaaaaaaaaatcataccatgttcagacaggaatggtctatgtatgtgacaagtattataataaaattaaataatagtagagtgtttaacacctcacataggttagtttttaacattccatttttagatagtgttcaggaaaataaaaagatacttcactggttgtgaaaccatctaaaataatgctgcctcatcacattttcacagatgctaaattttacgaaagctttatgacacagaagtcataaagactaccatacgtaacaggcagccagaattttaaaaatattattacaaaacaatacaatgaattaaagaaatactatttttttatagtagtataataggcattttcacttttagtagagatactccatttatacagcctaagtaaccataacatgatcaaagagaaagaccaggaaaaaagaaaatgaattcctttaaggattataatgtgtcatttttaattttatt

SEQ ID NO: 179850 - DNA, 251 bp, Homo sapiens
tatttgatgtccaacttcactatcagcctcacccatctcctgcctggatggagtcttcatcctgactgaatgattggcttggcccaaaatggcaggaaggggaaaaaagacattaaaaatggaggagtgatgtattcccagggtagagaacacaacagatttggtgaacgagctttctgagacaagatgtctgagaaaaaagttatgcctgcttaggcttattctccctgctgttccccgtacgaggccaa

SEQ ID NO: 179851 - DNA, 365 bp, Homo sapiens
caaggttacagtgattgtgccaatgcactccagcctggggggtgacagagtgaggccctgtgactcttaaaaaagtactcttcaagcaatgcccagcttcatttttatgaattttctctgtggacagtagtcattttctccagctctaggaaggctgaaggctgtaagtccaagccccactttacaagggagaaaattaaacataaagatagcgctttatcctgcaatgtgtgacctggagtttcaactggccacgtttttattccactctgctgagggctgagcctgtgctaatcccagatgcctacttgggacagttctgggaaccaacacatcagagctgatgggaaattctgcccccagag

SEQ ID NO: 179852 - DNA, 656 bp, Homo sapiens
aaactcacagctaatatcatactaaatgggaaaaaatgaaaaacttttcctcaaagaaatcaaacaagacaaggatccccattttcaacactcttgttcaactagcatgggaagtcttagcctgagcaataaggcaagagaaagaaagaaaatgcatccaaattggaaaagagaatgtcaaaatgtccttgtttgcagatgacatgatctcatatagagaaaaaactgaaaactccaccaaaaagtcttagaactattttaaaaactcttaacattgcacgattaaaaaaatcaccataggaaaatcagtaatgtttccacacaccaataacaaactagctgaagaggaaatcaagaaaacaatcctatttacaatagttacaaaaaagacacctaggaataaatttagccaaagaggttaaaaatttttacaatgaaaaccacaaaacactgatgaaaataattgaagagaaaaaaaacaaatgaaaaaaaattccatgtttatggattggaataattaatattgtcaaaatgcccacataacccaaagcaatgtacagattcaatttaatccatatcaaaatgccaatggcattcttcatagaaatgaaaaaaaaaaccctaaaatttgtatgaaatcacaaaagaccccaaat

SEQ ID NO: 179853 - DNA, 313 bp, Homo sapiens
acagcctcaaggacagaactttaccgaggtcatgtgcctaggaagtgatggaaccaattcttaaacctaggctttctgaccctcatccaatgttcaatttggtatattatgtctcactttttgtgagagtgaggtggtcacggagaataagcaaggaggctcacttaaaagttttaagaagtattattcaattcctttttcctttatatttttatttttaaggcttcattttttttcgactttttcatactttaatattatttctaagcatgttgaagagttgaagaatatcctattgaaaaagttcttaggt

SEQ ID NO: 179854 - DNA, 251 bp, Homo sapiens
attgttgttctttcctccaggagttaaagatgagccggtcacttccctcctgtgacagcgaatatatattgcgttgctggcgaatgttgagtgtagtggcctgagggacagctgagctttcccaggagctgcaggttagatttggtcatcctccttttgcagaggagaaaccgcctaggtcacacaataggtagtaagttggagaaccaggacttggacctgggacactctgactgtagtctgagctttca

SEQ ID NO: 179855 - DNA, 330 bp, Homo sapiens
ctcagctctgccagtgcagcaggtgttttcaaggggccggagatcaaagatatgggtctggtgtcagcctcctggggttacagcatacagcccaagtgtgctgagctgaactcaggcaccccaaaagtatctagaaaggaagccagttgacggaactcaacttattccacagtcaaaccctcaagggcatgaaagaatataaaagcaaaaagctgcatccaaagcatagcaacttccagcattaaaggaacatcagctcacacagatgagaaccagcacaagaactctggcaactcaaaaagccagagtgtcttctgacctctaaatgat

SEQ ID NO: 179856 - DNA, 486 bp, Homo sapiens
gagcacattgtttgacatacagcactttttgaaatcgtgtgagatgatgtctgtaaaatttctttcaaaccataaactttcctaacagtaggggttcccattcattctataagttgacaatacaactacttccctttttgctattttgtgttttcaaaacccaaatttgaaagtttgaaggactaccctaaggaataattacgaaatctgtgtcaaattgccatgcctgctttctaaaacgcatttttgtaagatgttctctataaaactgtagaactagcagtgattgaatcatttcagggaatgtatctttcctaaatagtgttttaaaaaaaaaaaaaaaaagaaacgagatgacctagaatatgagaaacttcaagaagtcttgaataatacctctatttatatctgtgtctatttttatgtctatgtctccctccctttgtgaaataactttgaaggaaaaactttgccttataggtaagg

SEQ ID NO: 179857 - DNA, 201 bp, Homo sapiens
aagatattgtatacattataaagcaggagatatacatgtacatattaatagcaggcaaggtatgaaatccaggtagggcatacatggtaagtaatataatatatattagaagacaggcaaagtggataatattaggatatatatacatataagtatctatagtcaagctataaaatagtgtgcagaagatataaaacatat

SEQ ID NO: 179858 - DNA, 494 bp, Homo sapiens
tctctgtgcttgtctggagtacctgcctgtgctctctgagcagcctctgcacctggctggtgggcggggctgagcctcaccttcaaggctgcagattccctggctttcggtgtgctgggggatgccttctgcatggcctggctttcctgggatttccagaccagatccacctctttctcccctttttctttgtctttctgcccccgaagagatagcagtgtacaaaaacaagccagcatttcttgttctcttgctatttgtaattgtcccgagcctggactgggtccagtccgctcatttattctgccagggcccagtctgcagatctcagccgaagccggttgtcctgcctggctcgctctgttcctggaaagctttgtcacgcacagccaggggccactttgggtgcatcctgtctcccccgtcgccgtatgtttgggagcagaagttggctctggtcagatatgtggatgttaatttatcctcattcttgg

SEQ ID NO: 179859 - DNA, 309 bp, Homo sapiens
aaacaaaacaaaacaaaacactgacatcctccctgaagtctaagacacacgtttatccatgtctgtctgtctctagtctgcctgtcctggtaaatgatgtcatggccaactcattccaaaacttcaaaaagttaactttatctgctcactgtcctacaactaaaatgcatgtgagtgacatccagctccacctggtggtgaggatcctgttcttttactagttgtctcttcagcttaaaatcctttagtggttcctgtagtcttcaggacacaaatccaatttagcacaagtgatcttgcctctgcttt

SEQ ID NO: 179860 - DNA, 285 bp, Homo sapiens
gaaaattaaaaaaagcaggtgtgatgaattttaataatatttttatttaaaccaatatatccaaatattatcatttcaactggtaaccagtataaaattattaagatattttacaaattccttttgaactaagtctttgaaacctgcagctccctgggcagcaagcgaggctccctgcgcagcgaggtgagcagcaaggtgggcagcacgggaccgccccttaaattttacacttaaatcacatcatttccattcagactagacacgtttcaaatgcttaatagc

SEQ ID NO: 179861 - DNA, 905 bp, Homo sapiens
  misc_feature (441)..(441): n is a, c, g, or t
  misc_feature (445)..(445): n is a, c, g, or t
  misc_feature (447)..(447): n is a, c, g, or t
  misc_feature (492)..(493): n is a, c, g, or t
  misc_feature (590)..(590): n is a, c, g, or t
  misc_feature (599)..(599): n is a, c, g, or t
  misc_feature (603)..(603): n is a, c, g, or t
  misc_feature (609)..(609): n is a, c, g, or t
  misc_feature (623)..(623): n is a, c, g, or t
  misc_feature (634)..(634): n is a, c, g, or t
  misc_feature (640)..(640): n is a, c, g, or t
caaaatagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaaggatccacgtttgaaatttccagtacatatgcggtcaaagacatctttaaaccccaatgaccttggccccttcctcctggctgggaagaaagaattcacttggatggccgancgtntnatattgatcataatagcaaaattactcagtgggaagacccaaganngcagaaccagctatactgtccggtgtccttactccagagaatttaagcgaaatatgactacttccaggaagaaattaaagaaactggtgatatcccnaataggttngaanatgaancttcacagaatacntattgaagagncctatnggagaatatgtccggaaaggacgatgtctaaagctagacggggtgggtttgaccccaggcaggctgacattgggggtgacagaaatgcttctcacggcaggatggtaccctattagccttggttctgcaccgacaaaccttgaaacctaaaaggcgtagggaactgctccccattgaggaggcacggcacatggcgctagtctcaccagtggaacacccacgtcgtaactagagtggcgcacatcaaaaacaacacagccgcaac

SEQ ID NO: 179862 - DNA, 455 bp, Homo sapiens
aatgttggttttcacagtcttaacatggaatagaaatttctttttgtaaaatacatgcctcttctttggccctcagtttaaagaatcagaggctgtggtagccattaatgattttttttggttataaagctgtattctggccttgagactgtacttgctgatgcccaggcaataaagtacttttggtctacgtacataatagaacagggccgattgactattcagcttgcttcagacagctttcagctaaacactgggtatatcgtagtgcttgcaaatactacttggtggtaagcacttgaacagttgaacctccctaagaaggtacagggagttagtaaaaatggcatggagatatgattcagcagctcttgtgtctggtcctcaagataaactcactactttacggtgacactttggagaagccgggttagtttttctaggtcctagtttcc

SEQ ID NO: 179863 - DNA, 432 bp, Homo sapiens
tcttttcaaggtcatacagctactaagtggaaaagctatgaattaaatgaaaagtttcctggctaagaagtccttgctttgtcctcaaaataggtttttgctaagcctacattagttagaatgggaaatatatatagagatatatgggctgggcacggtggctcacacctgtaatcccagcaatttgggaggccaaggtgggtggatcacgaggtcaagaaatcgagaccatccagggaatattgtcactgaggtggagtaaattaagcgtatataaaaatacaggttgagtaaggttatgatagctactgagtaaggttatgatagctggccaacatggtgaaaccccgtctctactaaaaatacaaaaattagctgagtgtggtggcacacacctgtagtcccagctactcgggaggctggggcaggaga

SEQ ID NO: 179864 - DNA, 265 bp, Homo sapiens
catgacacagaacgtgtttgggattcttctcctgcaagttgcttccagagcctcatagcatgttgttttcgttaccacttgctttgtggattggtacatggtcattttataaatattccatgtgtgctttaaaaatatatatttttttacatgaagttattctataaatatccattagattgatctttaatttttaatatcatgtatgtgctttactgtcttttttttaaaaaactccttaactttttagttactgagagtgtgc

SEQ ID NO: 179865 - DNA, 224 bp, Homo sapiens
ccaaccttcccaggtgactctaatgtgcagccaatattcagaaccattactttactctagcttctagaagttcagagcacaggggccccagcacgctcctacaaactcttcaggggcagaaaggacagcatgcctggccaggcaggccttgctagagatgggtctccttattcttccttcaaaacacacgcacactcacacccccccgagaagcaacctgcaaa

SEQ ID NO: 179866 - DNA, 385 bp, Homo sapiens
ttgcaagtaataacactgaatgcatgaagaaaataatatccaaagcagaaatcatccccacttaattcgcatgggattgctcttattactattctgtcatctgtgagaagaaccaatactttttccattcatttaaagcagcctgtttcctaaatataattgatagacttaaaattgcttcctgataaagtaacaacccgcaattttgcacaaggttttagttcccattacagtctagtttcatgcaattgcggttgccacatggagtttcatattccaccttcttaattggcacacccaatactttaaaagcaattctagcagcttcaggcactcaaaatttccattttcatcatttcatccaaggctttgataaggaagaatc

SEQ ID NO: 179867 - DNA, 237 bp, Homo sapiens
aaatatatatatatatatatatggctatgactgtttctctagagcactgatttagccctatcctattgattctgatatattattctttagatgttctttaattttggttttaatttgttctttgacctaaggattgccttaaaaagagttcttatagttccaagttttgtttgttgctttaaagttttacttttattacttaatttgtccagagaatatgatttgaactatttccct

SEQ ID NO: 179868 - DNA, 210 bp, Homo sapiens
cttactttgatattttaggggatcattctttgagtaactttctgaaagagatcgcaggaggtaaactttagagaggcagcatgtctagaagttctcctgcttggcggattagctgggcacaggattctagtttggaataagtttgtccctgggatgttgaaggtattttagagctgtttgtgacagatagtgttttccacaaatagccaa

SEQ ID NO: 179869 - DNA, 567 bp, Homo sapiens
tcctccaggtcattattcaggcaatctgttccctctcttctgattcaattttttccctctctcctaagtttcatgctactcattccatcagcatacaaataggtctcccatcttgggatgggaaaaaaacaactctcaaccccacatcttcgtccaacaatcacttcacttatcttcacccctctctcctggactttacagcgaactctttaagagatttctatattgctatctccaatttctctcctcctattcctgcattcttgaacccactccaattaagctttcactttcaccctccaccactccactgaaactactcaaaagggtcccatgatactaagaccaatgccagttcttggtctttaacttacctgacccatctgcagcactgggcacagctgaccacttactctaccttggagtttttccatcacattcttggtttttctccttccatcctcactagaagcttttctgtttcctctgctgggtattcttcatctcttttgcctctaatgtaggagggcgagggctcagccctcattttttttttttttttttttg

SEQ ID NO: 179870 - DNA, 989 bp, Homo sapiens
  misc_feature (1)..(1): n is a, c, g, or t
nagactttgtgctagtcgaggcccggtgttataagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtacaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccagcttcctctagctttgggcctatgctgtcccctgcaggcctagggaagccacttgcaactattcggccttcagattcctctcagccactggcctgagacagcatagcctgggtaacggaacagccacctaaggcaagaatggaacggacacaccttgctc

SEQ ID NO: 179871 - DNA, 583 bp, Homo sapiens
  misc_feature (319)..(319): n is a, c, g, or t
acccgtccaagtctacaccgttacaccaaggtgccccccccctaccttggggccacatgtacttaccaagtttgaaaatttatatatctcccctatccatagtgtagtaattatttcagataccctatttgggggagggccttctgtattaccccgcccctctcaagatttaggcaagtctgcccagggatacattaggagcgcctgccaagtggggtccaattctacaagcatgcaggcttggatgcggattcttttcccgagtgcgcctcactcatggttggaacctagtgtagaaattggacgttccaattctacnccaactatcccatcacaggaatattagaaagatattccttaaacctgaaaattattaacttgggatcctaggcatttataaagaattatgactcctgccaattgaaaaaaaaaaaaaaaaaaacactagatggcacgaaagacaccatttggcttttcctgtgtccactgctcacagtgcataaaaatgtagattaaatcaccgttcagttcggcatgggaagcacttagtctatgtgtagaaaattggaatggaatatggagc

SEQ ID NO: 179872 - DNA, 667 bp, Homo sapiens
  misc_feature (319)..(319): n is a, c, g, or t
acccgtccaagtctacaccgttacaccaaggtgccccccccctaccttggggccacatgtacttaccaagtttgaaaatttatatatctcccctatccatagtgtagtaattatttcagataccctatttgggggagggccttctgtattaccccgcccctctcaagatttaggcaagtctgcccagggatacattaggagcgcctgccaagtggggtccaattctacaagcatgcaggcttggatgcggattcttttcccgagtgcgcctcactcatggttggaacctagtgtagaaattggacgttccaattctacnccaactatcccatcacaggaatattagaaagatattccttaaacctgaaaattattaacttgggatcctaggcatttataaagaattatgactcctgccaattgaaaaaaaaaaaaaaaaaactcactcctctgaggcagagcccaacctaaggggtagagaggagtactgtaaattaagtgtgtcaggagggaaataatcccactcaactttcaccattttcaggtcttaaatccatggccagcatgtatagcaggtgggctaaaaagccagcctccaccaacagtccagcccacattacacatttcctttcgccaaataattccccagcctaggtgtagaatttga

SEQ ID NO: 179873 - DNA, 551 bp, Homo sapiens
ggtgaatgcggtaaaggtttatgagtgtgggatatcagggtggagccgttgagacacagggaaaagttagttacgtatagtggagatatagagggggtgggccgaatgtatcggaataatagaagtgatactgcagtcaatattcttgcaattatgtctttatacatatctatgattatttccttaggataaattcttggtggtgaaattgtataatgacctttagttgagaaccactggtttatgacaaaatgctttaggataccccctttaccattctgatataaaattgtacacaagacttttttaaaaaccccaaaacctaacagcataatgcctttattgtaaaggaaaataatttgtaattaatacagattgcttacagatttcaacgtataaatgaacagtgtgactgcataaaagaagaacatccctaggaggtggtattacaccgtttacaacttctgctcatgtgactcatgaatctcctctattaaacacctgtaatcatggggaaatccagctaggccttggaaccaggcaggtcagtg

SEQ ID NO: 179874 - DNA, 689 bp, Homo sapiens
ggatcacaacgtcaggagatcaagaccatcctggctaacacggtgaaaccctgcctctactaaaaatacaaaaaactagctgggcatggtggcactcgcttgtagttccagctactcgggaggctgaggcaggagaatcgcttgaacccgggaggtggaggttgcagtgagctgacatcacaccactgcaatccagcctgggcgacagagcgagagtccatctcaaaaaaaaaaaagaaaagaaaaaagaaagacagactggaaaaatagcttttatcaatctctgatatgctacatatgtcatggagaaatgcagaatggcatgatatgaaattccatttttgaatgaataaaatatacatgtgtatgtatatatacttattaacacttaggattatatacacacaataaaacgtctgtaaggataaactaaggttctatcagtgggaaatgagattgaaaagagggggatgtgttacttgatatgctgttgtatttttaaagtttttgcaattaatatttgttactttaataattaaaaattaggctggcgtggtggctcacacttgtaatctcagcactttgggagccaaggcaggaggattgcttgagcccaggagttcgagaccagcctaggcaaacatggtgaaaccccatctctataaaaaatacaaaaaattagccaggca

SEQ ID NO: 179875 - DNA, 603 bp, Homo sapiens
ggatcacaacgtcaggagatcaagaccatcctggctaacacggtgaaaccctgcctctactaaaaatacaaaaaactagctgggcatggtggcactcgcttgtagttccagctactcgggaggctgaggcaggagaatcgcttgaacccgggaggtggaggttgcagtgagctgacatcacaccactgcaatccagcctgggcgacagagcgagagtccatctcaaaaaaaaaaaagaaaagaaaaaagaaagacagactggaaaaatagcttttatcaatctctgatatgctacatatgtcatggagaaatgcagaatggcatgatatgaaattccatttttgaatgaataaaatatacatgtgtatgtatatatacttattaacacttaggattatatacacacaataaaacgtctgtaaggataaactaaggttctatcagtgggaaatgagattgaaaagagggggatgtgttacttgatatgctgttgtatttttaaagtttttgcaattaatatttgttactttaataattaaaaattaggctggcgtggtggcttcaaatgatcttctaacactatatgatcacagcactactgca

SEQ ID NO: 179876 - DNA, 632 bp, Homo sapiens
ttattcctaaatgtttgtggggcatcctaaatcctgagcaatacagcctccataagaaaaaattactctctcctccctcctcccctacccatcattccaaagttcttacattacagaactgctttatgcagataggcttacatatcccagaggagagctcatataccatttatattatatcacatgcacctgtgccaggccacagggactctctgtgaagttacccatgtccctgtctaccgcctcctccgatcaagaagacctcatggcttcctcattatcatctttgcacccccaactaggggaatcttttccagtttgttttggtttggtttggtttttattttgtttggggttatgggaaaatgagaattcccctcttcaaattcttattttcctttttgttcccctaataatgcagacttattgaaacacggaactaggaggagatatcctattcacctttttctcttccctttcctgaaaacacaagcgtagtgttgtctaactaatagaatgtgtggttggagggcgaggagtcaggagatcaaagaggagaaaaatatagtgggcaaaaagggtgaatatgtcagcaatattatctgctacttgtacatagtacttgtacaagc

SEQ ID NO: 179877 - DNA, 344 bp, Homo sapiens
aaatagtgggcgctggcactcagaacagcccatgtgagataatgaagcagccttccagacataagatcccagaatcagacacttatccaaggttcccctcctgcaatcagcgggtaggagtttgcaatgaaaacactccatgctatgtcccagagtgactcgttcatttatccgtgaaagcagagtccaaatccatgttcatgttaaatgtgcagaaaaatagcatcttgagagttaatgccacagaatgggcatgattccctaagccacatttgcctgattgagacagactttaacatttgcaaaacctccatgttatgagaccctataggtgatagtacatg

SEQ ID NO: 179878 - DNA, 363 bp, Homo sapiens
agctgagatggtgccagtgcactccagcctgggcgacagagtgagactctttctcaaaacaaaacaaaacaaaacaaaacaaaacaaaacaaaacatacattcaaacataaaatgaggaattttaagacagtgacagcagagcattaagccaagctcaaggtccctgtcagcatggggccctgtgtgactgcacaggccaaacacccatgaattcatctcaatttccatccctctcacactcttccccactgctgtggtctcagttgacaccttcctcatttctactccggaggactgcctgtaccctgatttcttcaagggtctctccagtctatcagacacagcccaacccagggtttctc

SEQ ID NO: 179879 - DNA, 800 bp, Homo sapiens
aggttggtcttgaactcctgacctcaggtgatccacccacctcggcatcccaaaaatgctgggattgcaggcatgagccaccacgcctggctcagaatttttttcaacttatcttgacgttcctgggtccacctacagtgatatgatctgctggggatgagtggaaactgcctcctctagatggggcatctggtatccagattgacaagggcctcacccagctggcatcagacattggtccctgcctgggccctgctctgagcctttgccccaatcccctcccttcatgaggttttccagccccctcacacaatcactccttccctcttatgttcatactccctcattatttgtttacatgccagacctctctccatcttggctgtgatagtctgagggtggggcacttgtcttttcacctctgatttacccaggaccaacagacacattgttggtgctcatagtctttgtcaaattgaagttttaaattgatggctcatgcttgtaatcccagagactcaggaggctgaggcaggaggatcactggaggccaggaattcaaggctacagtgagctatgattgtaccactgcactccagcctgtgtgactgtgtgagacttcaactctaaatagatagatagagggatggatagatagatagatagatagatagatagatagatagatagatagaaatgggatagaacagaatagctgaaggttaggtcaggactaattggtacagttaccactgactgaatcaaacaggtgctaaattgcattgtaaaatattataaga

SEQ ID NO: 179880 - DNA, 173 bp, Homo sapiens
ttgagttgccctatggagaggcccatgtggcccagcaaggaagccagggagacccagacccactgcctgagaggaactgagggcctcagtccaacagcctgagagatctgagacctgtcaacaggcaagtgagtgggtctgaagtattaatagatcctccctctacagagctt

SEQ ID NO: 179881 - DNA, 606 bp, Homo sapiens
ttctaaattgattgaagtttcttttgccaaggttaaggacatgcctgggagacaggtatgttcctttctccaaagatgattttgagggctttaatatttaaagtaggctgaagagcaaagagggaaggtatggtaatccacatgttgccagaggaaaggagcaggcaagggaatagtcaattacgtattttcttttgcttagtaagttgggactttacataagataaggtgaacatagagtaattacctgtggagatatttaacctgttatctgtagctatctgcttgggaacaaaaggaaaagcagtttattgcatgactcagcttgcagcttaattttttctcttgacatggtggattggggtcccaagtttttgttttgtttttagtgtcaacagcctaaaataggcaataggaaagaaaatactgtatgagagatgtcatagtgttagactgtggagtttggcaatctattgtatatgaaagttgacagcagagagagtttaaaactattattaaaattttagcctgggctggggcacaatgtctcacacctataatcccagcactttcggaggctgaggcaggagaatcacttgatcccag

SEQ ID NO: 179882 - DNA, 402 bp, Homo sapiens
ctactttgtatgtgcttgaaattttccacaaaagcaagtttacaaaaaagacttctagcttgcaaagtgccatatagttatatcagatataaccatcataattctttctatatacatccttcttaactactagatgtttagaaaatgccttcctcctttgttgtgtccccttgtgatgacatggttggttgtgtgggtgcctcggaaatacagttcttgccaagggacccttttagacaggcaggtcatcagatgataggatcagcttccacacaggggctaccttagaagggtgcccttctggtgtttcagtaactgaatcccaaagcttgagatccacagtggatttgctgcagatgaaatttctctccacaataaaatagtgttagagtgtggttttag

SEQ ID NO: 179883 - DNA, 643 bp, Homo sapiens
ctggcaaaacacattatgggaggggggaaaagaggaattctgttgaggggcagtaaatctttctgaggaaaatgaatggattagagaacagaggttcacttgtaaattagttctctttggaatttttatgaacctgagagacagacattatcttgtgaaagggtctgctgaggtgtggttacattcatggtcatcctttctgcaatagataatgagatagaaaggaaggcaagaaaaaaaaaaactattgttctccttggcgtgtccttctggtctttatgtagataggggaaaagtctcttacagtgtgtattgatctctaagagcctttaattcaaaatactcattataccaagtgatcatattttggagtaaagttccttgtgctcctttattccacctgtctggaacttccttgcaagtttcatgcattaaaagctgagttggtggctgtgaagtgagaaatcagattagtagtcgagtagcaagagataggcaaaggagggggaaaaaaacaatttgggataagcagaaaagagcaaatttaaatatattgtcccatatctgcctgaatcagtctcttagtcctgagaatagatcagttcagttaaacagctgtgtcccatttcaggagatggcattg

SEQ ID NO: 179884 - DNA, 201 bp, Homo sapiens
tcctgattttgcatctgttcctgaaatacttcatttttgctgagttaggtcctttattccagcctgctaagtcatttggagagtgattaaagcaccagtatattagcattgtaccatttgcctatcgaatctgggaaccacctgaatcctcatcaaagccattaacaaaatatgcagccctggagagcataaacagagccc

SEQ ID NO: 179885 - DNA, 312 bp, Homo sapiens
gacctaagtttcactgtagatcaaggcagccaaatagtgctaattttaaaagcagttaggagaatataaacatttaagaaaataataagacaaatagaatatataagcacctatcttttacttagcactgaccagaaatgtaattgttttaagtcctacaactttaaaatttaaaatcataaaaaactttaaaagggtattaaatatatcatcctcataataagaaaaagacagtgctcctatatggtaaataactgcatgcagcatttagtaataacattgttagtataacaacatattctagagatttgg

SEQ ID NO: 179886 - DNA, 399 bp, Homo sapiens
acagggtcaagtgtactttttttaagtctaacttctatctctgttgcttgtatccttttcttgccacccaccccggacaggtaactatcttttaaaaatggcttgacctggctacgcacgcagtggctcacgcctgtaatcccagcattttgggaggccgaggtgggcagatcacctgaggtcagtagttcgagaccagcctggccaacatggtgaaacgctgtctctactaaaaatacaaaaaattagccgggagtggtggtgtgtgcctgtagtcccagctacctgggaggctgaggcaggagaatagcttgaacccaagaggcagaggttgcaatgagccgagatcacgccactgaactccagcctgggaaacagagtaagactccataaaaaaaa

SEQ ID NO: 179887 - DNA, 314 bp, Homo sapiens
tatcaatgcatcctacccaatattcgcctgcagcaaaataccttagtaacatctttggcataaaaaataatttttttcaaataaacttcaaaataacaagaaaagtcaatgggaaaaaattattaatcatggataccaggataagaactgatatcccagtctaaagatgatcacagttgaaattaaaccttaaaagaaaataattgcttcacctgaatactccttttcaaaatacttaaaaatcgtccctctctggcatgcaaatatgcccaattcctaacttataagacctttcctacgcgattagggttagt

SEQ ID NO: 179888 - DNA, 403 bp, Homo sapiens
caatgtctacttgatacacattctaaaaataattttttagtttaaaaacttaatattatcaaaaaataatttctgtactataaaacattatactacatgattgtcaggatgcttacaatgtgtactgccttactaggttcttgatgtgttctctatagtggtagaatacctggactgcctattttaaagatagggaggctgagtttcaggttgcatgaatgatgggtggtagaaccaggacaaaggccaggtgttctgctccaggcccagtgagtccagcaccttacactgcacatctcaaggctctcatccatgtctcttccagccacgagatgcacagacacagttattcttaaagtttcccttagccacaccactaggatgaggccccattcatcagcaa

SEQ ID NO: 179889 - DNA, 202 bp, Homo sapiens
attagtgctgctcgaactctgtggagtaaagggccactttttgttggcttttttcccccaattcgaccaagctgtagtcctgccgtgcagaaccagcacgcagcttgctccacatgcaactcctcacgcgagtttaacacgctcgccttgagtgttcaacacaatgtgttcaactggttctgcagcaacatcaaattcctat

SEQ ID NO: 179890 - DNA, 620 bp, Homo sapiens
ccaggttgatttcatgtgttttaatgagggtagagaattgtctaagaaggagatagagcaatttagaaaagtagcatttagtctttagtaatatgtatattgggcttttttctattgttaaaggaatcctaaatttctgtaaatttttttgaaagcctccagccattgcagtttgttaggtgcaatatcagtatcattgatcacttgtatgatatggttaggaatgtatgtaaacttaaattgcaaaaccacatttattcctatggattatttgcttacactagttcattcttatagagacaactcaaaggtactgtaccgttgactgtacagttaccagaatgtcacatatggaacaatggggtagacaatgaattagaaatgtcatttttaacatttttaagcagttgatagaaataaggtcctggataggagaaaaagcgatttatctccattgatgggggattatggttgagtctcttagctattggtatttataacacttatcatgattacccctactgcagccacttggtaggtttttagtgctcataaaagaattgcacttattttaaaattgaaacactatttcaacactgtgatgtgtatggaggcggaat

SEQ ID NO: 179891 - DNA, 438 bp, Homo sapiens
acctcacacagggcccttctaactctcttcatgtcttggcagtgtgagatctatgaactgtgtctggtctcctgatgttcttactgggtctgcaaaaggttgtagaaaggtcatgtgcattctactttgccacagcccctcccactactaagcttcacccatttacttacactcaggctatagcgagtattttgagtttgcggtcgctgctgtacatgtgaagctggcatcggacaggcatcagtgtactcacagcattggccagtgtttcacatacctgttgggtactggcttccatcacatcctggggaagagcgcagtttctcacggtcatttacatcctgtgaacattttattttatatagttacttaaagttctgggtttatatcttctctcttccccaggaagagagtttggaaacaatagctttggctggg

SEQ ID NO: 179892 - DNA, 294 bp, Homo sapiens
gtggacatttccacgagtcacgtgatcagccttatgtataccaatgtttgcaaggtttttgtctcaatgtcttactatcaggaccttgtaacaaaatagccagtcttctcacacatcttaactcttcgacacaatgtattttatgtatcttaatacactgattttgtgggaaatcttgttttatgttaaaaaaaatcttcaaaaatggtaagccactaatttcagaagttcctttgctttctagaagttactagctattttgatatttccatgttgtgactcgtggaaatgcaa

SEQ ID NO: 179893 - DNA, 248 bp, Homo sapiens
ctgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgct

SEQ ID NO: 179894 - DNA, 647 bp, Homo sapiens
aattctgattcaactgtcaagggtagaatatgaatatatatattttcatccaacatttttatctgaaggtccccagatgatcctaacatgcagacagaactgggaactactgctctaaacaatttcccactacacaggctccgaaaaagtacatctgtagaactcccatgaatgtggcagtatagtattttagtaatctaaagaaaataacattccaggctcagagcagctgtatttactttaaagttttgcattttgaaaaagttgattagtaagtctgattatgtcaactgtcctagctgaagctttaacatcaattgcaccatcatcccctatcctttgatcaagtagttctcaattttagtagcacataagctcttaattgactgttatttatttatttatttttatttaaagacaggatcttgctatgttgcccaggctggtctcaaattcctgggctcatgcaatcctccagcttcagcctcccaaaacacagggattataggaatgagccactgtgcacagccatctaggaagcttttaaacaagccacaaaccccaggccaaatatatcagaatatggggggagtgaggaagaggactgagggggacacctgggcattaccattttcaaaaactcccaa

SEQ ID NO: 179895 - DNA, 565 bp, Homo sapiens
tctagacacgaattcatcatctgcggaagatcatttcctgctgtcgttattgtctgtagcagctccagtgacatgtgctggcatgacaagccccatttaatctcactaatgcatccttttccacgggcaaactaaacccagacccattccaaaagagatgaacccagccatcgcttaccataggaataacattaaatactaatggggacggaagaccctgggagtggcttgctgagtgatgggccttcctcggagggaactgctgatgggattctgctcagatccaaatgaggtgatgctcttggctcttgagttaaggttcagaggttgcagtggacgctgtgccctttccagataccaagaactctgtctagcaaatgtccacaagaggctgggttggactttggtctacatatattttcttcaacatttctcttccattcatcctgaagtcaaggacaaaacaaaggccttgaaaacatctaatgaggacactctagcagggaatggaactttcagtgcaagtagagcattgagcagaaggtagttttctcctttgagtaaa

SEQ ID NO: 179896 - DNA, 307 bp, Homo sapiens
agatccccatacagagtagctgggattacaggcacccattaccatgcccgctgatttttgtatttctagcagagatggggtttcaccatgttggccaggctggtctcgaactcctgaccccaggtgatctgaccgccttgacctcccaaagtgctggaattacaggtgggagccactgtgcccagccaggatcaaatatttttaagagtagttgtgaactgatccttgtttaaaaaattgtttacaaaatggttacatgggttggttgtacctttacttttatgtgtttgaaatactccagaaagtg

SEQ ID NO: 179897 - DNA, 259 bp, Homo sapiens
taaggagaaaatctgaaaaacagccagagagttaagacacatcactccgaagcaggaaccacgtagacggacaggaaacttctcaacagcaaggatggaaggcagaagactgcagaatgggggagacaatgattttccacttccatttccacactcagctaaacagacttacagaaaaggtggatgaaagaaaagacacttgttggtaaaaactgagttgaccattaacaggctgcccttaaataacttctaaaaataa

SEQ ID NO: 179898 - DNA, 234 bp, Homo sapiens
agtgatatgttgagaagcagcagcacaaatgttacctatttcacaattttaactactctgatgaaacggtcttactgaagtgtggtgaaagcaaatgtcattaaaaatctgtacagtactttaaaaaaaaaagaaagaaaaatagcagagtgccttgaacacagcaaatgttcaacaaatgtttacttcagtaaacaaatgaaggcaccgggcgtagtggctcacgcctgtaat

SEQ ID NO: 179899 - DNA, 195 bp, Homo sapiens
ttaagattagaggcaaggagaccatttacacaagagattatgtgggtctgaacaacaggctatttgaataataaacatagaaagaggagtggtggagacaaacaaaattcagaagataacactggtaactggatatagggttggaagaaaaagtctagtggaaagtcactatggattgagtgactggtggatgtg

SEQ ID NO: 179900 - DNA, 557 bp, Homo sapiens
ttatggcctatgtggtagctcttaaagtgcccttgcagtatagatgggaatctgaagatttcattcaggcaaaaggaatttagtgggaagtatgctattcctgattcaagcacttatttcaggatgcaaaattaataatagtttattaataaaacataattaagttcattcagttcccagaagctgtcagggaaaaaacaaccaaggagggctgctatcatgtgcaaatttcactgaatttagtttttcttctttcgtggctctaagggtcaagatgctctatgttaatattgaaagtactctgaaactgccacctactttgtctttagggaggattttttttaaattgttgttagtgaattaatggtactgaagaccttgggttaattctagaacaagcaaaattttttattgacacacacagtcccagcacagtggctcacacctgtaatcctatcactttgagaggctgaggcgaactctgcccaggagttcgaggctgcagtgagctctctgcactacaacctgagcgacagagctagaccctatctttacca

SEQ ID NO: 179901 - DNA, 546 bp, Homo sapiens
ctagtaagtggttggaatcattctgtattataattgtgtaatcaaattcttttttgaaaaaagaaaaattaatgtttgagtatctattagaagagaaaaaaacagaaatgtagtttacccaagatagcataattctataatcccttcatttggaggcaaagaacagaaatagatgattcataaaagaaaaatggttataactggtagataaaaataagaaaatattcaatgtgattagtagtccaaaaaaggtgaattaaaatgagatgccttaactcttaaataattattgtcatcaaagatgaaactataaaagtgatcacacccattaatctattaatttcatttctgaaaacttacactaaggaaataacccaaagtgtggaagtagctataggccctgacactattcaaatcagaatactcatacaagggacaattgaacccacaagataattatgtagagaatcctagcacatcagttttgttaggaactgacttcaaaggatgataactttaactgatcagtaattattaaccatagta

SEQ ID NO: 179902 - DNA, 230 bp, Homo sapiens
tttttcgttgttgttaggaccagatgaagtgattgctatgagacaggctttgtaaactctaagacctttataaatacaagatgttattactggagcattgtgtctccatccggctaggagggaactcaggctgcctcattgcttcggagatcttctgtccctcgtgccctgccccctgattgctctagaaggacgtggtctgtctgaccccatcatacgctgcacctggt

SEQ ID NO: 179903 - DNA, 476 bp, Homo sapiens
ggagccattgtggctccggccggttgcgcgggccctcggaccctcaggtaggcgagggttcgagggcacgagttcgaggccaacctggtccacatgggaaaaaaaaaaaaaaaataaaaaaaaaaaacactcgggggggccgcgcccggggcccctggaagaaggtttcagaaaccccatgcggtggggcgcggcggggccccagagggggtaaggggacacggggcccaaaggagggtcccacagagggagacacccggggcgcaagaggcacaaggccggggggagttttctccaccaatattaaaaaaacgcccggggggggacacacgcgaaggcggctcgtgtggacaccacattcccagagaggggggcgttgcgaggggccccatgaaggggggggtctactacaacagggcggacttcacaggcagaagcccggaatattcaaaattagcccccaaggggggggatag

SEQ ID NO: 179904 - DNA, 487 bp, Homo sapiens
atcttgaggcttctgtgggatggaaactatagcatgaaaatctgattaacaaatatgtgggggcagtttactaatccattcaattagggcaactgcaccttctcagcatgccatgagcaattccattagatagctagttactggaccagatgattacctaattacatgaatatatcagtgtcatttttcccaacacaggacttgaaggccagatttgagaactagtcctggggtagtagtacccagagacctgtttgggagactgggaaggtctgggccatcacgttcttgctgatagcccagagatcaggtcaaggacaggggcaatgagaagaaagaaacagagaccctgggaaggagctatcttggtctttaccggcaagaattaacttcaaagatgggacagaggttctataagttcaagaaagggagaaagttaacacttaaaaacataggctggattggataaagtaccgttggagcactt

SEQ ID NO: 179905 - DNA, 340 bp, Homo sapiens
tccctgactatctgtccccacgtgccatctgttatcaagtcttgtcaattgtaccttttaaattttgtctcaatctaccccttctctctatccctactgccagcatctctcccttggaccagcctcttaactagccaagtcttgcccccttttatccattctccacactaaagtgagatgaactctcttaaggatatgcacgattctgtccttttcccacctagaacccttctgtggtcctctgaagctctcagcaccaagttccaacactgcaacatggcttggcatagaatctgcatcatcagccctgccattccctgcctcctattctacagtccag

SEQ ID NO: 179906 - DNA, 306 bp, Homo sapiens
aattctgccaacaaccagtgagcttggaagaggatcctaagcatacgatgcataagatgagatagcagccccagttgatgccatactttcagccttttggggcctgagcagaggatccagttgagtcatatctagactcctgacctacagaaactgtgaaataataagtgctttaagctgctaatattacagcaggagaaaactacagccactgtgatcgtagatatcttttccccattttatttgtcatttaaaaatattttttaaagctcttattaggtacataaaattagaattgtaacacct

SEQ ID NO: 179907 - DNA, 477 bp, Homo sapiens
gacccacgtgcacttagttactcccttggtttctccaccctcatcctcaactaaaataagaagctgaaacatgactgtcttgccattaaaagtctgaagaaaaaactcacatgtcatattgagcctcctactgaactcagccacatatggaagtttgaagtgggtcctcgaaatgcatgtactgcactccagagttaagagagccattagcaggaagaaggactttggcgaggggtcattcctgcaggaggtccatgttgtggtttgcaagtgtcccccaaagttcatgtgttggaaatataatccccagtgcagcagtgttgagaggtggaacccttaagaggtgatggggtccagaggactctactctcatgaatggattagtgtcattatcaggagagtgggtttgttataaaaacaagctcagccttctcttaagtgaactgttacccttccaccctttgccctgggatgaca

SEQ ID NO: 179908 - DNA, 314 bp, Homo sapiens
tgtgtttatcctgcttggggttcttagacattcttgaatttgtggcttgatgcttttgccaattttggaaaattcttggccattattgctttgaattttgcttctgcctattctccttaccctttccttctgggactagagatatttgtatgttaaaacattttttaaccatgttctatatatctctaatgcttcttcttttattatcatccttatttctctctttgttttattctggatattttctattaacctattttcaagttcacaacttggatcttctgttgtgtctaactggctgcgattgagttatt

SEQ ID NO: 179909 - DNA, 283 bp, Homo sapiens
acaatgaaagaggatgggaaaaccaaccggaaataacataaacatccacccataggaaagatgctcacgattcattgtcaaatagaaaaataaaaacaaaaacaataagaatagaatgacttctactgaaaaaatataaattcctcggtcaaaagagaggaatgtgagaactggaaatgtacttccaatctgtcctccaaaaaggctatcttgagttacactctccataacagagttgtttgcatctgtggaaagaaattctcacgatgttcagggagctttc

SEQ ID NO: 179910 - DNA, 422 bp, Homo sapiens
agagaagtgagggaggcctgtatggtgagcaccatccctgcccacctccctgagatggcctgtcatatggcccactcaccacagatggcccagggagcataggacccaaggtcacatagctcaatagaggtgggtctgggaattgagctcaggccccagacccagtccaaggttccctgacaaggagagggcaggagcacaccagggcacccagacccagcgcagcagaggcaggacattcaccttgtcctcagcctggacaccctgaggtcatactatgccaagacccaggctgggccacctttgctctaggaagccttagggatcctgagtgaagattttccaggaatgcaggcccacagattaatggagatagttcatagaaaatacccctgcctttgcttcatgagacatttcatggg

SEQ ID NO: 179911 - DNA, 243 bp, Homo sapiens
tcctttatcctacacgaggttgtgtaatcttatggagatatgtctttcaaataaaatacaaggtattttggctcttttttacatagtatctctaattttttcctttttaactacaatagtttgttttttaattaatgttgtataggaagatcctattgtatgttttatactgagaacatatctcagttagaaccactcacctatcaagtgctcaattgtctcattagaccgtctttttggaca

SEQ ID NO: 179912 - DNA, 153 bp, Homo sapiens
tttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggca

SEQ ID NO: 179913 - DNA, 331 bp, Homo sapiens
tgcctgcctcggtctcccaaagtgctgggattacaggtgtgagccaccgcgcctggccatttttgcatttttaatagagacaggttttgccatgttggccaggctggttttgaactcctggcctcaagtgagctgcctgtttcagcctcagcctcccagattgctgggattacaggtatgagccaccacgcctggcctaaatgcttaataaagattattctgtggtatgtattcacaggcagtatgccagataccagggatgaaaatataaataagaccttagtcccaaggaatatctgcagtttccatagtttcactctgttttttaata

SEQ ID NO: 179914 - DNA, 292 bp, Homo sapiens
tctactcctgctgcgttcctaggggagagggttaattcccaaaaggcaccacatcaggagatgttataagtggaattgttccagataagcaatgtcagtcatgcagtcatcctgatgtgcaagtcgaacctcttcatggacatgatactggtggtgtccaggaaactagggtgtggctaagactggaacagcataggtcaaactttgcaaaattaactgtgttcattttcattaaagtgtcttccttatatcctattctaatcagaaaaataaacattttattgattatgga

SEQ ID NO: 179915 - DNA, 473 bp, Homo sapiens
ccagtatagcaacatccttagccagaagtctcaacagaattatcatgaacataaacgtttaagggttatatacatatatcaatttaaagtatgaaaaggtgcatttgaacttcatggcaacatttaaaaatgatatccttgttagcacatcaccttgaatctatgatgtatgattcagcaaattaggacagaatcaaattctcagcaaaaagtactttgaggctggggatggtggctcacgcctgtaatcccagcactttgggaggccaaggcaggcggattgcttgagcccaggagtttgagaccagcctgggcaatatggcgaaaccccatctttacaaaataatttttaaaaattagccagctgcagtggcacatgcctgtagtcccagctgagaaaagaagactgcttaagcccaggagttagaggctgtagagagctatgatcacgccaatgcactccaacttgggtg

SEQ ID NO: 179916 - DNA, 350 bp, Homo sapiens
ggcttaggctccgccttagcagaaaagaaggaaaggaaattgagaaggaagtcaggtgtcccctgcccctcacacttggggatggctgacttggaggacatgagatgggggaaatctgagtgagggcagagaagagaaatgtggaggctgctcacagggaggctagggagcatatggcatatccagcctggggagtggcaccactgggggaaagggtgcgtgtgacagtggggaaggagtggtgataacagatgtgagcttgctgtgtccactaaaaaggtcacggctatttttaggaagtaggtgacaaggcatgttcctgtagaactgcttattactgagaacccact

SEQ ID NO: 179917 - DNA, 310 bp, Homo sapiens
gcatttgagaagaaaaaccaccaggcttgcacgctaactgtgagatctgcaagtagagatctatggggcctccaaaaggcgggaaacacggggaagacagagcatgggttaaactccgttcagatggacagttggatcccaccctttacatttcgaggcatttcccctgaaaaggtttctgaaggttaagaaaaactattgatcttattacttgaaaatgtaacaaaacacctttaaaaatacatttgttttgtgctcagagggagggcaaagcctgccaggctaggggtgattatctggccagtttatc

SEQ ID NO: 179918 - DNA, 335 bp, Homo sapiens
gaggttgggagttcgagaccagcctgaccaacagggagaaaccccgtctctactaaaaatacaaaattagccaggtgtggtgcatgcctgtaatctcagctactcgggaggctgaggtgggagaatcgcttgaacctgggaggcagaggttacagtcagccaagatcacaccattacactcctgcctgggcaataagagtgaaactccatctcaaaaaaacaaaaaggaaaactcgatacaatgtaagaacatgaccctcctctgctcataacatttgacggtttgacagttcccaagtgccccccatggccctgtcacctccgtgccctcctcc

SEQ ID NO: 179919 - DNA, 144 bp, Homo sapiens
ctgtgtctatcaacaaattatacatatggcaacacacaaacctgtatgttaagcactataagggatgagtctcaactttatcacttatttatgatgggattttggggaactagtttgaactttctaagcttttaatttccttct

SEQ ID NO: 179920 - DNA, 614 bp, Homo sapiens
cctgcttcacctgttagttttctttcctgagcactgagcttgccaagattgatgtcagatgcagcctcaaactcccctgcattaacagaaagcattaggttctcaggtgagaaagtttttctttagtgacaactcttgcagacaaatccagttaatatgcctgtgtgtgcatgtgcacatgcacacatattcatgtatactaacagcttgatagatgagaaatggctttctgatgatttttaaatcaatttttatagtttaagggctttttttccagaagaggagaaaactttatttaggtagtcaagtgtttgaacttgctgacaggcacttcgcaaataatttttgagtgaataaatgaatgtgaataattgaatgactagtggactcttgcattccttcttcaataaaaaccaaaagcaaagcaaagcaaaacacaacaaacaaacacagaaatccagttctcctaagactagcacaaaaggagatctgctacttggggagcatgataaggtagactatccattttaactttctgctctagatttctcacagcacaggaaaaacaagggcctgtatgttaaaaagttattttactaaagttgggggataac

SEQ ID NO: 179921 - DNA, 565 bp, Homo sapiens
accctgcagctacacttccagttgtaacttaagtctaccaaattcgtcacttgtgagagatttcgaagatgagcaaaagctgcctgattatagaggaaagcatagacacagacatgttcagtttttctacaacaatgtatgaagaggtcccagagtgtaaggcagggattctcaacctggagtccacaagatattgaagatactgcttgagttctttgagagatcagaaatttaacaaaaaaattaaaaaaaaaatttttttaacttttgtgcatcaagcaatggcagtattgacagtaaatgaacaacctcattaacaattgtgttagaaattagccatgtggtagtgcacagtaaaaccatgtttattgagatacagttgtccttgataactggtggttgctacgcatagggggaggatggtagggggctaatgaacatcagcctctccctctcaaattacctccacaaacctctccataggcaccgccaactacctgatataagcaaaaaagctctacaagtgtaatggaaaattggagagaaattttaattctgatgaaaa

SEQ ID NO: 179922 - DNA, 606 bp, Homo sapiens
atcgaggatctcctcgaatcgacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcactctgtcgcccacgctggagtgcagtggcacagtcttggctcactgcaacctccatctccagggtgccagcgattcccatgtctcagcctcctgagtagctgggattacaggtacacaccaccacg

SEQ ID NO: 179923 - DNA, 285 bp, Homo sapiens
cttttctttgttcctctgggtagttatcatttttgttccttttctatcataaatactatttcagaagaaattgaaggtaagtgtggtcaatttggcccattttaacgtgttctagacttacagtttttgtgtgtacacatttaaaatagtacggtttaaaataactgaaattggccaggtgcggtggctcatgcctgtaatcccagtactttgggaggcagaggcgggcagatcgcctgaactcggaagttcgagaccagcccgggcaacatggcatgaactttg

SEQ ID NO: 179924 - DNA, 223 bp, Homo sapiens
gatttgagtatggctgttcaccggcaccttttattaatactttgtcctttcaccaagttagtcacaatattcttcccacagatgtttgttccagagatattttggggaaatttaaaaaataccaagcacaaagaatttaacatctacatatttacctccttgggttgacaacatttaaaaatcaaatctttaccttcattgccttacttttatgcataacccg

SEQ ID NO: 179925 - DNA, 1061 bp, Homo sapiens
atacttggctaattaaaaaaaaaaaactattgtagacaaagtgtctcactatgttgcccaggctggtctcaaacttctgggcttaactgatcctcctgcctcagcctcccaaaaagttctgggattacaggtctgagccatcttgcctggctatcagtgccttttatattcaaaatattttgagccaaaatacataaatactgaatttaggaatttttctgagacagccatccaaatactatttaaatattatttcaactcgtgtgaacttttggatcaataaaaataatgatttgatttttttatctctatacatgattttcaactatcagtctctcagagtaaacaagtggtccatagtacactggttgtgatgttctgaaccatattactgagtatcatatttatgtttagagagtcaaagtggagtaggaattgaggaccttcgtgctggtcctggctgtgccactgacaaggctcttggacttgctctttggaatggatggaatgttagaatcagatgagatcatacagtggtctaattcactcaatatatagaagagggaagaataatcattgctgtaacatttatgttttgaccaagtgccagtggtagtcatttgtttaattaaactttgtcttgatcaaaggtgttaccccatgagaatatttgatgagtctggtatgaaatacaatcctaatgacattcaagcatgtttttcacccttttaaatgatacaagtgaagaatattgagtgctctttaaatgaaagatgccattataagagtagatagaaccactcctggagtaaaaggggaattacaagtttgtattggccgggagccactgcgctcagccagcgtcttctttagaattcatgttataatacctacgaaacatcattggtgaactgtgtttaatttcacctttctaagttataatcaatacattttactggtaaattttacctgataatgtacttattcacaatggtccctgaaaatttttgattaagttcattcagatgctgaggaatatgagtaaagcaagccacgacatg

SEQ ID NO: 179926 - DNA, 138 bp, Homo sapiens
tcccctacacaacagagtgtcactctttaaagatgtcagaccaaaaccctttgtacaaaaccctccagtggcttcccatctcactcagagttgtttattgatgtatccctaggatgagaacgtatctgccacctacaa

SEQ ID NO: 179927 - DNA, 626 bp, Homo sapiens
tgactgggagtctgaggcacctgtggaacatcagtctccattcattccaggtactcttaaagtcctgcccaagaactcctcctcagtgttcaaagatccattaggcacagatattgctcagtttagtatattttggagcgctcaaataagaccaaaacatctctttcgaagtttgctctgatttttgtctttctttgagttcttgggactattgatcagcaaagaaaaccataggaaaacagtactcatgctttgattagaaactgacaaactggtattgttagaaatcttgagcaagattttgtgtcccataagcaatgtgttatattcaaataggcattttatgtatattcaaatagaattgatttaggcaaatttcaatggttgcatattttgggttaatagtttatcagtgtccatagaatatttttctaggaaacaaaacgcatactttgtgataaagtttttcacaggcagaattctgcagttgggtggggctaattattttgtttttcactttaaaaaaattagattaaaaataatgagacagattttaaataacagcaaattgacagtggcccttgctatctctttttagctggtgtagtttagaccaattgtttatt

SEQ ID NO: 179928 - DNA, 359 bp, Homo sapiens
agaattgcttgaacccaggagacagaggttgcagtgagctaagattgtgccactgcacgatccagcctgggcgacagagtgagacttgtctcaaaaaaaaaaattaataaataaaaattaaagctttttctctggtaggacaatttattcaaaattacttgtgtgtatttcctggaaaaaagtttttagacagttcatttaaaaatacttgccaagtgcagtggtgcatgcctgtagtgccaactacttgggagactaaagtgggaaaactgcttgagcccaggagttcgaggctgcagtgagcaatgattgcacctgtgaatacccactgcactcaaggctagacaacatagtgaaac

SEQ ID NO: 179929 - DNA, 258 bp, Homo sapiens
ccaaaatgagggcataaaaatcccaagataacttcggatcataaatgaacacagactatctgaatatgggacaagtacctacctcagagcaaagcaaacagtctgagaagaggcgagcacaggccacaggaagcccagcgtaagtctcaatcttttggagatttcccttctattgggattctcagccactgtggtctggaaacaggaggctgagagaggcctttgctccaaaacctggtgacacctttcagtccacca

SEQ ID NO: 179930 - DNA, 429 bp, Homo sapiens
aaatttgtcaaagcactgcaaaaatcaggtttcttatttttacccagaaccttcttggtaaccactgtttttcacagagatgcaaagatctcttggatgcacatttattccttactgtttaaaccactgtcataggtcaagttctgaaagagaactgctcgccctgcttccccgcaagaaatcattatataggggcaagaagttttggtctttatctttgcctagaaccttgaagtactccatgatttcctgggattttcacgagttgtacttgtaactcatggttgtagggctaagagaaaggcagtgggaggaggaatatagtatttattgagcactgatgcattttcagtgcagtgctaggtatatgaggcattgtctcatctttaaaagtaaccatttttctccatataaagtaaaaacagttga

SEQ ID NO: 179931 - DNA, 357 bp, Homo sapiens
tacacaccaggcagtggggcaggaagagccaggcctcgaacccgcagggcagccccaccgccagcgctgagatccttgtcacagggcccggcctggcgtccgacagggagcgcctgcgttcttgattctctgtgttttttgtctggggacctgtccagacaggctgagtcccatcctcgaatgctcatttcactgaccgtgaacggtagcgtcaggcttcactgccctggcttagaaatgcttttttgtaaatggaagaaaataaaacacaaaacagtctgaaaaaaaaaaaagtgagcctacgtgtgggtgaaggataagctgataagctgactcgtgcacgccttgtgtttctta

SEQ ID NO: 179932 - DNA, 668 bp, Homo sapiens
aaggggagttcccctgcacatgctctcttgcctgctgccatgtaaaacatgacttttctcctcctttgccttccaccatgattgtgaggcctccccagctatgtggaactgtgagtccactaaacgccattttctttataaattacccagtctcagggacgtctttattagcagcatgaaaatggactaatacaaatggatacaaaaaactgactgtctagagttaggccactcaggcctgggtgtggtggttgtgtgatactttgggaacctcatctccttgtttttttctcctccataatcctgcaagtgtggctttaggcctcatggccttgcaaggctcctgcaatttcatgtttctttcaagaagaagaggaacagtctcccctaaactcccctccccttccccttcttcagcctccatctggagatttctgctcacagggttttggctagaactgtgacacgtagccacttttacctttaataatgacttgaaaatgtagattatttttgcttttcaatttcttaaactagatacatttctaccgaaaacaaaactggacatggtagacatttatgtgttctttgtaatttcagtggcagtgtttctagtgtctcatcattaagatgttggcttcttatatagatgaagattctctcttgac

SEQ ID NO: 179933 - DNA, 564 bp, Homo sapiens
agggctcttattactgccgttaccactgtcattgctactgttaccaagattacagaggaggggacctgactacacccaaggtctgaggggccagagagggcttcccagggcaggtgacgtcaggctttggagtcagaccttcttaagttcaggctttgcctgaactgtggattcacagttcttcagagaactcactatgtgtgacattgggcaagttagttattgaaattaagttgagcatgttatttacattctgattacgttagttaaactctacctggaaaatgggataataacacccgacagccaggctgccgtgggagtatcagagccaccaggccagttctgtttgaacatttccctgaatgtcttggaggatgggatggggagggatgaggagggccttctttggggtcctcctgtctgctgcacccttgaccttgtctggtgtctgacagcagcagcaggtaaagagcaggcctcagtgatctcctgcatttcctctggccctcactgggagctcttgccttgcctgacagttcaccaagtactgtgtactatctt

SEQ ID NO: 179934 - DNA, 913 bp, Homo sapiens
gtgggtgtgtttgtgtgtgtgtctgtgtgtgtctttgctaggttttgctattgcagtgattctggcttaacagatgagttagggaggaatctctcctcctcagttttttggaaaagctttagtataattgataccagctctcagtatgtctggtagaattaagctgtgaatccatgtggtctggggctttttttttttttttgattggtaggttttgaattctacgtggacctcaatattaaattctcaaaaccttaccaaaaaaaaaaaaaaaaaaacagaaaaaaaaaaaaagagaggggcgcgcgcgcgcggcctagaagagagtctctctcccgcggggggcgcgcccagagtgctttgcgcgcggctctccctcgcggttttctttgttgtgtcctagggtgcgtggccccccattatggtggggggcgctgcgcgtgtattctatacagcgcgtggagcgccgcggggggcccgcggctggtgttttatcacacacgcgcgtgcgcgggatgcgtggtggagaacacagctggcctgcctgacgcgcgggcggggtggcatacctgtgtgtgaggggagaggggaggatcctttttatctgattctgcggggggggcggggggacccactatgtggcggggagccacaacatctctctcactctagagcaagggagtattattaacagacgcgtctctcccaggaagggggacaactatttacaacaatacttcttgaggaggggtgtgtcttatatcgggggtgggtccactccacctcgggaggcggtcgcaactattatgcgggcggcgagcgcgtgtctaagaaaaagaaattgttcgtgggctcacacagagagggggatttgatgtaccttcgggagagaaatattttttttttatacccg

SEQ ID NO: 179935 - DNA, 238 bp, Homo sapiens
ccatgtgtacaagaaagggactggaagaaagcaatcttttaagatatcattataggccaggcgtggtggctcatgcctgtaacccccgcacttcaggaggttgaggcgggcagatcacctgagctcaggagttcaagactagcctgggcaaccccgtctctactaaaaatacaaaaatcagccgggcgtggtggcacatgcccgtattcccagctactcaggaggctgaggtggaaga

SEQ ID NO: 179936 - DNA, 592 bp, Homo sapiens
  misc_feature (563)..(563): n is a, c, g, or t
  misc_feature (565)..(567): n is a, c, g, or t
  misc_feature (571)..(571): n is a, c, g, or t
  misc_feature (574)..(574): n is a, c, g, or t
ctacatgtcaatacaaattttcaactgaaacttttctcatcagcacagtgagacatcacttttatctcaccaaggtcttcaaatctggtcacttctctattatctccttcacaatcatactcaaccaaactttcatcatatctcatcaagaccgctgcaaaaacagccatccatgtgcctcctcaattcattttcaaaaactccataaacaatttgaatacatgtagccattgggatttttctgtgggagaagatgtccaaggaattctaggccaagtaaagctgcaaccatctgatagctggatgggatagagttaacattccaacatttttcctggtgttggtttgtttatgagagggagtctcgctgtgtcacccaagctggagtgcagtggcgcaatcctggctcactgcaacctccgcctccagggttcgagtgattcccctgcctcagcctcccaagtagctaggattacgggcccccaccaccatgcccagcaattttgttttgtatttttagcagagatggagaacaaatttaaaaaggagaaaggtgcttgtantnnnctcncanttaattcagttttgtgaa

SEQ ID NO: 179937 - DNA, 486 bp, Homo sapiens
ccgccgccttttttttttagttgatattgccctattatttcagctcatgtattatttctcatctccctatagaatcagtctcttgtgttaccatatgctttattaataacagtattataaacttagagtttttttgttcagaaatcttgtttcattagtttttgtttctgtacttagatactcaaataatagctgcttttattattttctgtctgccaggcactatactaagtgccatcattgtctctttaggccacacaatagccttatgaagtaggtactattattttccaaattttaaaggtgaaaaaactgagaattagagaagttaagtaactttgtagagtttctcagctagagaatgatagagtcaggatttggtaccagacttggtagatgtagagatttttttcaatgctcatgttcttaaccattacacaagatgcataattctgcaaaaactatattaaatacttaataaattta

SEQ ID NO: 179938 - DNA, 1137 bp, Homo sapiens
  misc_feature (1)..(1): n is a, c, g, or t
  misc_feature (3)..(4): n is a, c, g, or t
ngnnattctactgactccaagttcacgcagctgttcatcccctgcttaatgtactggtgagttccttgaagccctgaaccgaggacttcttgtgtactttaacatttgttatatctgaagatattctgattggcaacatttttaacatagagaactgtttaaagaaaataccgccagcacacaactcatccacaaattgctgtttttgaaaaagatggagaggctgtgactgagatcatcagagaaccagcccggcaccccaaacataatagggcaaaggagtcagatgagaattttgttcagtatgagacactggacaacaagacaggacccttgacctcagaaatgcaggaattcaggaatattatagaacatgaagtagcagagccgtggaggagaatttatagcactaatcttgagcactttcccccgaggactctgcgctgttttcacaaaggcctctcggaatgccaggctgtgaaaggtagaaatgtaaacacggggacaggagtgtccttcagtctaaagagtgagccacgcaggtttctagttgccagcattccagtagtggtactgggaaatggttttataggataaacaaatcacccaaatgcagaaaatgcaattccactgaagcaaatccaacttcctttcctgacggagaatgtaattaaatcctgcttcaggaggacggtttatatcctctgctgctgggggtctcggctcatgctcatcgctggtgtttacaagatgacattacctgcctcctgtgacatgctgaggcagccctgactttgaagatggggcggtggtgcatgtgagggaagggggatgagtgaggctgtgtttcatttgcagagcttggctgttcatctctcacattcacatctgacaccagaagcccacaccatgcttggcttttccaaaacagtgattctaatgtaacaccctaataagctgtgttaactcacctttcagaaggaggctggggggacatacatcacaacaagttgagaggaaggggtgattgtaacaatattaaatataattatcaccagcagaagttctatgagatgaagtgaatgaatcacagctcatgatgtcttcaaaatacaattaaaagtgcaattttacttt

SEQ ID NO: 179939 - DNA, 474 bp, Homo sapiens
aggaacgggagttaagtatgatgtgcaagtttctagcttggataagtgggcaatgactgagttaggaacaggagaagcaggcagggagtaggggaaaatgtggcaagttgagttcagggtttgatttcaagatgtctgggtaatttcctattataattttttaacttagttttgttattttgttcatgctttgatggataatttccaagcagagctgtccagaaagcagctgcaggggctggtgtgaaactctgccagattttggtgtcatcagcctcaatctttcccaaaaggaaaaaataaaacaaaaccacttttagagaagctgaaaatgatataaactttgggaatgaagcatttagaaaaacagatcatgcaatgggatttcccacggacccattttaggtcattacagggtaattgtctcccattaattcagctgtttttcactaacgatcttaacagtctttcagt

SEQ ID NO: 179940 - DNA, 103 bp, Homo sapiens
gtaatgtgtgcatgaacttgctgtgagtaatgtgtgcataaacctgtctctgctcatgagtcagtcccaaatcctttagacctgctcagttcacagaagggaa

SEQ ID NO: 179941 - DNA, 515 bp, Homo sapiens
  misc_feature (3)..(3): n is a, c, g, or t
ttnatagcccaatcccagagaaaaggggcgcagggataaggcagaggctcagggactatacaggagtttttctggggaatgttaaggagaaaggtgcaaaacagctgaagctttcaggactggatggggaggaaaaaggattttaaaaagctttactggccgggcgcggtggctcacgtttgtaatcccagcactttgggaggccgaggagggcagatcacctgaggtcaggagttccagactagcctggccaacatagtgaaaccccgtctctactaaaaatacaaaaattagctgggcgtagtggcgggcacctgtaatcccagctgctcggaaggatgaggtaggagaatcgtttgaacctgaggcagaggttgtagtgagccaagatcgcgccacttgcttcaggcagtagtctgggggcgtagaaaggaaggcttgggaggatgtggtgggcagaatagaatcccccaaagatatgcatgctgtaatcctgggaacttgtggatatgtta

SEQ ID NO: 179942 - DNA, 188 bp, Homo sapiens
cagggaatgtctgttgagtgaataaacggatggtcaatggaaggaatgaaggttaagtgcaacttcctgacctaggagacaacgttagctctccatgttatctgttcccacagaccagtggcacatcttgcccataaagagtatgctcggatgctggttttgaaccccaacatattagtttgtcaacg

SEQ ID NO: 179943 - DNA, 232 bp, Homo sapiens
actctataagccctgtcagtgaaatggagatgcgcagcagatgagccagatccccaaaggatggttaggaaccctgcaccgtagtggaccagtctttaaaatcagcagttctatgttcttcagtaatattttatgcttgcattcaaaacacctatgccctgaggtgtagcgcatatctaatggtgttacaggtaccagtggaaaaattagtcataaggacccaacggcagct

SEQ ID NO: 179944 - DNA, 405 bp, Homo sapiens
ctcaacactcttccacgccaggcaaagctacgggacttccctcttccatccacgttttttttaaaaggcccaaatttggggttacaaagtaaactaacacaatttgtcagtggaatgaaagaaagacctaagataagtgcagataaacatggtggtatcaaaggaatacgataaactatgaagacagaatacagaaaaagtgactggcaaaggattttaaaacatacaaagagaaaaaggtaccaccaacaacatgatagcgtgccagactgattatgccaaattattccagctaaagaaactacacaaaattttaaagaaaaatggattatgctaaattattccagctaaagaaactatacaaaattttaaagaaaaatagattatgctaaattattccaggta

SEQ ID NO: 179945 - DNA, 477 bp, Homo sapiens
aattctactactgcattccagcctggatgacagagtgagactttgtctcaaaaaaaagaagataggactacaggcacgcgcccctgtacctggctaatttttaaaatttttttgtagagatggggtcttgccttgttgcccaggttggtctcaaactcctggcctcaagcagtcttcccatgttagcctcccaaagtgctgggattataggtgtgagccactgtgcccagctcgaatagactgcatacttattatgtctttttttaaacaagtgtgtaataaactcacacacttttaaattctataatacagttgtccacaatatgtctcgaggattaaacaatgattgagttgctgaaataacgtctgtttgtatcctaagtttttcccccctttagactgtgagaatgatataaataagcaataacaacaaaaaagcttaaatcttcaagattatactttttttttttttttttt

SEQ ID NO: 179946 - DNA, 335 bp, Homo sapiens
  misc_feature (32)..(32): n is a, c, g, or t
cgcgagaagacgacagaggctgatagtggagncctggagcgcgggtccggatggcagaccgcagagatcaccttgctgatgtgcccagctcgaatagactgcatacttattatgtctttttttaaacaagtgtgtaataaactcacacacttttaaattctataatacagttgtccacaatatgtctcgaggattaaacaatgattgagttgctgaaataacgtctgtttgtatcctaagtttttcccccctttagactgtgagaatgatataaataagcaataacaacaaaaaagcttaaatcttcaagattatactttttttttttttttttt

SEQ ID NO: 179947 - DNA, 276 bp, Homo sapiens
attttatcattgtcagtgaaaattgctttatgcgtcatgtatgtgttttcacagtatcagaattcaagttaattttatactgccaatttatatcattgttccataatcagtaagtttttttcaactaaagaagtcttaaaagactaatagctttagtaaagtaatgtggtgaactggacatggtggtgtgtttctgtaatcccaactacttgggaggctgaagtgaaagtattccttgtattctggttttgaggctacagtgagccacaaactaca

SEQ ID NO: 179948 - DNA, 189 bp, Homo sapiens
atgacctcataagcagtagctccctcatggagtatttttaggcatcactttcctccccctcccactcagcttccatgcacttccagtgcagtccagaactctccggaatctctagggttgctgcgactcttgttgttttcccagtgtttaaggggtggaaactgtaactgcccctccaaacactcaact

SEQ ID NO: 179949 - DNA, 396 bp, Homo sapiens
aaaccaaccaatccaaagcgtagtacccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtactacgctttggcagt

SEQ ID NO: 179950 - DNA, 342 bp, Homo sapiens
ataaaagtcttttctctgactacaataaaagcaaatttgaaatcaataacagaaagatcttggacacactccaaatatttagaagctaaatgacacatttttaagtaaccaatgaatcaaacataaaattaaaagggaaattaaagtattttgaattgaataaatataaaacatcgtatatcaaaaaaaatctggggactcttgatagaccagtgttagggaaaaacttagagtactaaatttctgtattagaaaagaggaagggtcttgaattaatgacttccacctaaaaagaaaaaaggtatttaacaaaaagatcagaacagaaatcaacaaaataga

SEQ ID NO: 179951 - DNA, 218 bp, Homo sapiens
attccaggaacttaagcaaatctcatcttccaagattctatggtccaactcatgctaaaaccaattcaaaatgaaaacattttggaaattaaagtacctattgtagtctaggagtcagcagaccttggttttaggcttgagcccatcaatgcctgtgtgaccttagagagatccacttagcattatcttctgcacagccatgtaagaattaaataagg

SEQ ID NO: 179952 - DNA, 451 bp, Homo sapiens
cgcccgcctcggccccccaaagtactgggattacaggcatgagccaccgcgccgggcctagtcttgacctcttttaaactccaaattcgcacccccaactgccaactaccacctgtggtcctgccatttgtccccagatcagattggaatggtacatctgcttgaccaagcctggatcacatgcctaggctctagctgcaaggagagcccagaaagtacctgtgtttttagcttctgtagtagcatagaagtacaacctcccaccaaaacccaggaggtggtccagtccccaggcagttcggatgctccctccgcattgtgcttctgctgccttacctctatcggtggcctcattaaactcctaggcccccaggttcaactcctgaacattttcctggacttgtccccacatccaaatcagccacatcaaaacccatcacttcttcctgtg

SEQ ID NO: 179953 - DNA, 458 bp, Homo sapiens
tgagtagtattttattgtgtgtatatctgtatatcacattttctttatccaatcatctgttgatgaacacttaggttgattccatatctttgctattgtgaatagtgctgctataaatatatgggtgtaggtatggaaaccatctcaaccaaaagataaaagttaacatcaccagaaatgtgatgtgtgtctcctgaaatggtgcagaatacagcatcatatttgaagtgttcctgacaaacatgcatgatctcattcatgaggaaatatcagataaacccaagttgaaaaacattctataatgtaactgacctatactcttcagaaaagtcaaaaccatgataaggaaagactgctggactgttccaaattgaagaagacttaaagagacattataactgaatgaaatttataaatctggagtatatcctggacatcattaggacaactggaaaaag

SEQ ID NO: 179954 - DNA, 494 bp, Homo sapiens
tgagattgaaacatctggtcaatatctcctaacactgcaatttcatgcacagttagcattagggcacatttcttctactcttcttacagggtccataagggtggcacatatggctgatcatttcattcaaaaaggattcaattcaaggcattacacacaatcgtctgtgctttatggtgttttaagtctacctgccacagttttccatcatcattgctgactgctgttctcttccactataaaagcctgcaaatatgacaaagcacttaaagcttaacagctttcctctacctgagttagtaagcatttaaggcaaaggaatctataaagtggcaggtcattttctattgtcaagaactcccaatacatgaaactatttaccattttatttaccatttagcaaaaatctaatacagattagaaaagtaatttttaatgtcaaatcaaatacttaactttctgcttgacagatctacgaaagtacactcttttgg

SEQ ID NO: 179955 - DNA, 657 bp, Homo sapiens
ttctttctttctttctctttctttttctttctttctttctttctttttctttctttctttctttctttctttttttccttccttccttccttctttctctttctttctttctctttctttttttttttttttgatggagtttcactctttttgcccaggctggagtacaatggcatgatctcagctcactgcaacttcttgcctctcgggttcagccattctcctgcctcagcctccctagtagctggaacaacaggcctgcaccatcacacccagctaattttttgtatttttagtatagatagggttttgcaatgtttggccaggctggtctcgaactcctgacttcaggtgatccacccaccttggcctcccaaagttcctggataacaggtgtgagcctgttatcatggtaggcagtatgactatttctttaaaagttaaatacacaattaccatatgatccagcatttccatctctgggtatatacacagaataatttaaagcaggcacacaaacaggtatttgtactgtcatgtttctagtagcattatttacaatagccaatagttggaaacaaatgtctgtaaatggttgcatagataaaaatgtctctgggcatatacacagaataatttaaagcaggcacacaaata

SEQ ID NO: 179956 - DNA, 333 bp, Homo sapiens
ggctacatagacactcctaaaaatgagcttccgaactgagatgaacaattcactgcttcattcctcctataaatccacgtccactttcaaaactcatgtgctaaatccttagatttttttcccccagcaaacatctacctaagagcctgatttcattgacacacacttgtactccgcaacaacaacacttcctttgaaaaacagaatgtcacttcctcagtccagaggccagaagtcccttgattctgatctggggagccaagacaggaaattctggtaggcttctgcctctccccccatggacagccactggtgcagctgacagagggcagg

SEQ ID NO: 179957 - DNA, 450 bp, Homo sapiens
tttttcataatttgacagccctatcatattctttcctgatttctcctctacctgaggatcatatctactttcacagtgtcagctaataccttgactgtgatgattccgaaatctgcatctttagtccagccatcctttctgtgtccagatcaatatgtgagtcatttcttgggttttcctacttgattggcccccagtaatctacaattcaacacacccaataggaaactcatagtcctctttccgcagctggctttgtctctcctttattccctgtctcattgaatggtacttgtgatcacccagttgcacaggtcagatccttagtttcctcctgaatttcctgcttctccttagtccccataccacacatggtcttcaaatcttttttttttttttttttgtttgagatggagtctcgctctgtcgcccaggctggagtgcagtggt

SEQ ID NO: 179958 - DNA, 552 bp, Homo sapiens
tattagggggctagagatctctttgtgtaacatttaactttaatttcttggacagcttatatgaataattgaagtgttgaggcagttaaaatttattttcctctcttgggatttcccagttgtcatagatagctgtagtcactagggaagtagaaatattatttccagcaaacagatggctttcctcgtattggtccccaaaagcgcctactgaggtttgtgtttctgttggatgatttcctaatcacaccaactcagtaacttttgaaagatcacacctggtaacagaatatgatgtaaatattaatatgacttagtgaacttgagagcatccaaaattgtaagtttatatagttcctacatccctggggagagtagtctgtccaatgagaggaatcgcctggtagctagtactttacttttcttatcacaagtcccctttctgcctcagttgtactctcagggattcccaagctgatacttctgctttttaactctcattaactctgtcatctacgtgctattttcatttctgcttagtcagatgactac

SEQ ID NO: 179959 - DNA, 272 bp, Homo sapiens
ggagtgttccagaggctcctcatccttgccaacgcttggtattttcagtctttttagccattctactggagcagtagtattttattgtggttttaattagcacttccctgataactaataatattgacccatttcccatgtttctttttattatatgctttattttgtgaaatgtgtctatgagttttttatatattctaggtacaggtactttacaaatatttcccatttcttaataatgataccttggaagatcagatggttttaatttt

SEQ ID NO: 179960 - DNA, 469 bp, Homo sapiens
ttcatttcaggtttttcagattattaccctttggttatcattactatgcagtctactttatagatcatttgtgtcaaatgttaaattttatattgtctttctcttgcttcctggaagattttaatgtgcctcttctagatacttgttgatgtttttggtaaacatgaacagattttaatgttagcctaagaacacgatgaagagaactaagtgcttaccaaaaaattagccatgtaatatatatttcaaaatcatatataggagaatacctcatctgttaagtctgcagcaccgaactgcagggagtataaaaatgaatgttgagatgagagtctactagcgagtctcagtatttcacagacaaacatacatttagtaattctaaaacaagttagatattcatctgtgctataggccagtaatgacccaaatgctatgggaaagttgttctagaaggaagaaactcttt

SEQ ID NO: 179961 - DNA, 137 bp, Homo sapiens
aactccctgaactagaaggaaaaacaacactcttatcttcaaggaccaggaattaaagcgaaggaaataccgcacagaccttgttagattcctggatacgtgtgcaggctgtgcagatttgttacataggtaaacat

SEQ ID NO: 179962 - DNA, 398 bp, Homo sapiens
cgcattactcttttttgaaaaagaagaaaaagaaaactctcagagctaggtgctccccttactccaagatccaacctagatttgtagggataacttgcaaactcctccctaccaatgtcagatcccagactggcgagggtagaacatgctagatcccctcttttcatggcaggaagacaaatggggatgcctaaaaaggatctagcaggtcgggtgtggtggctcacgcctgtaatcccagcactttgggaggccgaggtgggtggatcacctgaggttaggagttcaagaccagcctggccaatgtggtgaaaccctgtctctaccaaaaatgtaaaaattagctgggcgtggtggcgggcgcttgtaatcccagctactcgggagactgaggcagg

SEQ ID NO: 179963 - DNA, 188 bp, Homo sapiens
ctcagagtcacagcttggcaaagccagtcaccacgatggtcgttcctggagcatatgatctgagagaaatggccccaaataaataaggcagccacagagtcaggcaagggctgagtctccagggcacagtaaacgctctgggctgtacatcacatcatgtgtctgagcggcccgcaggagccaccacc

SEQ ID NO: 179964 - DNA, 347 bp, Homo sapiens
ttccaccctacacatctcctgccaatggaagagtgagcgtgcctgtggtgctcctgacacatctggggtagttcccattcacagtgctcaccctttgggactttccacacattacagggtcatcgtccatctatgctaacctagaatgtccagataaaagctcctgtttagagactggagagaaaattgtcaactctgaaagcccacaaactgtctcagccagggggaacacatgcaggaaagactacagaatcgtatgtcagaagcctaatttcagattgacccctacagctttatgactgtgagtaattcacttactttctctaggctctgttattctcacatca

SEQ ID NO: 179965 - DNA, 760 bp, Homo sapiens
gtgatacatattttctagatctttacaattttctgttgtaataaataagagtgcataattttgatcaacaaagaacaaacattttcattcagaggactaggaatgtactaagtaaataaatagttgtttttggaatgaaaaacaaaaatgggattaagattttgttttctgaccgtgttaaaggaaaccatgccattttttctttttacttttttttttaaatacccagacttcaaaactaccatatcagttttaacttctgaatctccttctacatggggactatttgtgataatcagtgaccttttacatagaatgctattaaaatatagttttatgtctggcaaatataagactcctttcttccctacatattttgatttaaatgaagtattgtctcatttctccaggtgtgattcttatgtatgttataaattttgcgatctgtcaataccacagaacaagctgagctgtggttaacactatttcaacatcgaagaactttcttccagttctttctgaaatatgccagtcaaagaaaaaaagtttgaggaagttgaagaatgtaagaaattggtggagcatgctagtggtggttttagaatacagtctttttgttcgtgagttctgtgcttcagtcgaaatcagtcatagcagtctagcaaaaccaatgaattacctaagttatttcagaattaatatgtattttaaatatcaaaatcaagtcaattcactgaagctaggcattctgcaattatca

SEQ ID NO: 179966 - DNA, 429 bp, Homo sapiens
gggcgtaaacccaggtcatctgcctccatgtctacaatatatcccactgctctgcctcagaaggacagacagaatctgagtagacaagtgatggcaaattcatggggagagaattccaggctagaggaaatgcgtgaatgcctagaactcatgaatggcggagctggctgggcatctgcttgtggccacagccatgggtgtgtgtgcatgggtgtctgtgccagggtgagtctctgtggcttgtgtctgtggcctgtgtgcatgtgcccactgctcctgcggcaccccctcccgttcccctctgggcagctggtgagcttgccctctgaaagccattccctctcctgcagctccccagggcatcccagcagccagcagccctgtttgattctgttcatccataaatcatcttgctgaggagatgagaag

SEQ ID NO: 179967 - DNA, 245 bp, Homo sapiens
agaggacccaggcgttgtagtgaggcccgttgtcagtgcgctcacagggagggcttagcctgggcatctcttcctattcctgctctcttccccatcggacatcagtggctctagcatcataaggtcaggagcaaagtgacacccctatttcagatgaaaagaggacttctccacatcagtgctgcgttttcatggtcctcttcccttccccttctgagctgggccccttctcttcccactgacaa

SEQ ID NO: 179968 - DNA, 230 bp, Homo sapiens
ttcctccactcaaccgttatcctttgtctctgtctccacatatatgttccaaaggttgatctcaaatttggccataataaactagtcaaaaccgcctaggcatggctcacacctgtaatcccagcattttgggaggccaaggtgggcagatcacttgagctcaggaattctagcccagcctgggcaacatggcaaaaccccatctctacaaaaaatacaaaaatttggcc

SEQ ID NO: 179969 - DNA, 415 bp, Homo sapiens
actgagggatggcaatgtgcatcgtggccacatgtacattaccacacacatttattacgacgcaatgctaaaactgggcctactgtacacatctaatatgactgctcatgggtgaaaccagagagaagacaagcgaacgaacacatcagagagctggtgaaaatgaagatctaaaatacatttctcaacatataatgttttccataggcacatgtcattaaacagtaaacactctcaattatctacactgttagttttagtcagcgattcagttttttgctatggatcctgaataacaaacttctacatcaaaaagggaaaagacctttagtctacaagcagagagaaagcaaggtgctctgtggactataaattccttatcttcttactaatgagatctgaagcttactaatga

SEQ ID NO: 179970 - DNA, 508 bp, Homo sapiens
aaataagtgatggtacatacgtacaatggaatattataaaatgacagctgtaagaaagaatgaagaagctctctatgtaatgatttcggatgaattacaaaacatattaagtgaaaaaggcaagatacagaatagttactacagtatgctattatttatatttaaaaacttgcaggtatagcaaagaaaatcattggtaattgcttttataagcataaaaattctctggaagggctgggcatggtggctcatgcctgtaatcccagcaccttgggagccaagctgggaggctgcctgaggccaggagcttgagaccagcctgggcaacatagtgaaactacacctttaccaacaattgtttaaaattagctggatatggtggtgcatgcctgtgatcccagctactcatgaagctgaggcatgagaatcacttgaatctgggaggcagaggttgcagtgagcatagatggagtgactgtactccagcctgggcaacagagcgagactc

SEQ ID NO: 179971 - DNA, 552 bp, Homo sapiens
tgcaggactggacgatttcttaacacgttgtgaagggtctcatttctcggtatttaaggatgtgatcacaagattgttccctatcagggacccttctcttgaggttttgtcgctgctgttaaaaatcccttagggacaaacgtgaaacagaatgttgtgatttagtacatatgacctcttggaacacgttcaagagtttgacactagcttcacctgctccgtcgttccctcactcctacattcagggtcattagaaggtaaccttagtaaccagttctagggtcctgccccactccacccctaggcaaagcttaacacacacgaaggtgacgataatagctaatgattatggactgtcacgctctaggcagcatgctgcctgctttgtcagtcattatcacatataattctcatagtagctggttgaagccagtaccgttaccccactttacagataagcaaacagactctgaggatccgtgtgtccaccagctgagagaaggtgagcccaggcagtctgactccagagcctcttaacttctcgcgagcaca

SEQ ID NO: 179972 - DNA, 680 bp, Homo sapiens
ctgtcgcgggctgcctagaggaccccggtgtagttgttctattgctcgaagcatcctttattagcagtcagtccttgagcatgttacttaaatccctgtgctgcagtctcttcattagcaagataaagatgagaatagaacttgcccttataagcctattaatgtcataatttatgtaaagcacttattcagtagggtagattaaggatgatcacaaattcttgctattcctcccatcaagaggtggagtctaattctcctctctttgcttctgggctgaagcaaagcatttaccttgtaaatgcttgatcaataaaatgtggtagaaatggcattctgagatctgtgaggctaggtcagaagaagtcttttagcacccacctcccaaggctctggaacacttgctgtgaactcaaccagccaccatatgacaagactggccaccctgagactccatgctatgaggaagcccaagctacccaggtagaggggccacttggagagagttgcttgattagcacccaaccgacccagcctgcccggtccgctcaccagacaggtaagcaacaaagccttcagataactaaccactgctcatctgagcccagtcaacctacagaactgtgagaaatattaacaagttgttatttggagccactgaggtcagggtagtttgttat

SEQ ID NO: 179973 - DNA, 302 bp, Homo sapiens
caacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaa

SEQ ID NO: 179974 - DNA, 419 bp, Homo sapiens
ctgatgtcatacatgttatggctactgggttccctagtcattcgtgtatgttagtcctacctcctaattagatccaacttcctaaaggatcgaaaccttgctggcctcctctttcgtgtgttgtataaaaaatgaagaacacacaagcagaggtcgaggaatacatgactaattcacctaaaatgctcaaaactcagctgatttactttgtaaagagtcttcattttaaatctcatacaaaactcaattttcttaaaagaaaacaatgctatttattaaaatgcctttgtaatatcttaaaatggatcaatgtacattccattctccaaaagcaggaaaaaatatgtagggtataaaatgtttattatattaaactgctgaattacccaaatgtctgtaagttgtcagctgaaagaaac

SEQ ID NO: 179975 - DNA, 466 bp, Homo sapiens
acacagcacagtgcaacaagatgcaaaggaatggggcatgtgctggacttgatataagaagaacctcaaagagccaaaagacattcactggaaatcatggcaggccaatgtgagaagagcagctagcactgggagttttgccagtccaataagtagatggatgcaagagacctacagtaaggattaaaagaccgaagctaacttctacgaacttttgaaattgatcttccaaggttctcttccaagactccagtttgaagagaaaccattgggaggaaaagcacaatcagcaagataggaagaagggaaaagagaaactaaaaatgtggaggggaagagggccagaaactcccagaaagtaagctgctacacttctgaacattacacaaaataacagaaaagggagctctgtgaaattattaaagcactctgaaggtacatcacctttttaaagttcaggaaagct

SEQ ID NO: 179976 - DNA, 100 bp, Homo sapiens
gttagaggcttatttaccccacatggagactgtgctggggggcggggttgtgggcacagccaaatgggcctcctcctggaggtggtgtctgtctcacact

SEQ ID NO: 179977 - DNA, 494 bp, Homo sapiens
acctcatgtttgaagttgaaataaaagagcatttcattgataacatcatctgaatgatttcctaccaatgtattgcctttgacttaaaccactcttgatgctgtattttctatttagatttcatgttaaagaaaagaattacatgaagcataaagaaaagccacttgggacttagaaaagttcaaataatcagaattttaagatatccaagttcatttattcagatattttatgagttttaaaataagcatgattttgtgctggatgtggtagctcatgcctgtaatcccaacactctgggaggctaaagtgagaggatctattgaagccaggagttaagaaaccagcttgggcaacatagcaagactgtttctccaaaaaaaaaaaaaaattctttttatgagctaggcatggtgacacatcacatgcctatatacccagctactcaagaggctgaagtgggaggactgcttaagcccaggagttgagggttc

SEQ ID NO: 179978 - DNA, 853 bp, Homo sapiens
gggatagggcagcagggacctctcacagactggctgcacttcgttaagtgtgttgtgaagcaaagctgcatatatctttagttgcacaaagcctcacacagttactcctctttccatttatcgcccctcacgcttccctcacaggggctggaaatgagtctctcaaaccatcatggaagataacagctcatcaataccttccagtacacttatctttctccccagagagctctgaacccaaacaaaacaactcccacaaaaccaaacaaataaaactcaaaaccctcttcaattcaagatagcaaaactatgtcaattgatgcaaatacttaacaatacttgggtggacagaaatgagaaggttggtgatgttttgtacactccatcccataattcataaaacccaggaatagtgggggtttctcatataacttgaaaaggaagtcaacttatttgcataagaaacataatgcatgaaagctctcatctcattggcaatctgtgagaacgcaatcctgggagaaatctgcaatggttgtagtccaaaatttaacagtgctttgtcaaatggacttcttgctatacaagaattttctctgtaggtgctaagaaacatccactgcaccctactccaaaataaacacacagaaattaaactctttcaatccagataacacaaaagacaaagatagaaatgggattgccctaaaagtagacttcacagtatggtggacagagctcaggatgtggcattaaaggtcttagtcgaatccaggccctgccacttacaagctggaatcccccgagaaagtccctttcccaccaggcacggtggctcacgcctgtaatccca

SEQ ID NO: 179979 - DNA, 122 bp, Homo sapiens
agctgagggtgatgcacaggcaggcgatgaaactgatgcgtcagtccagccaagaaaggacgcgtccctggtttggctacgtggccgtcctttatttctttgttaactgaattttcttatag

SEQ ID NO: 179980 - DNA, 422 bp, Homo sapiens
agcatttgacagaaagtaaaggagtgctcaaaacaaacaccaaacagagcaaaatgcaaaaaaggaggaagtcatgtcaaaaaggacacaggagcaagcccaaaaagtgtgcagagtcataaacagaaaccaactgagcaataaaaaaaacagtactggattctaacccaaagaataaaataaatctccatagtgcatactgatataaagaaatgattgaatgaataaatgagtagaagagagaaactgtccttacaggattcccaatgataaaggtagaaggcacgagggaagtagaaaatcaccatttgaacaccacagtaataactgctgcagctaagattcactgatgaatactaaaattagtgggtgaaactttaagcagaaatagaatctttgtatagcctcaaagtatctaccca

SEQ ID NO: 179981 - DNA, 708 bp, Homo sapiens
gaaacaaaggatatataaaacaaccagaaaacaaataacaaaatgacaggagtaagtattcacctatcaataataaccttgaacgtaaacaaattaaattatccatttaaaagatatagactggctgaatgaataaaaagaacaagactcaactatattctgcctacaagaaactaattttacctgtaaagacaaacacagacagaaagtgaagggatagaaaaagatattctacacaaatggaaaccaaaaatgagcaggaatagctatatttatactagataaaatagactttaaattaaaaattgtaaaaagagacaaaagggtcaccctccaatgataaagggattaattccacaggaggattatatgacaattgtaaatatttataaacctaacactggagaacccagatatataaagcaatcgttagatctaaagagggagagagaccataatacaataatggttaaggactttaccaccccattgtcaggattgggcagatcatctagacagaaaaccaaaaaagaaacattggatttaaactgcgctatgaaccaaacaaatcttacagacatttgcagaatatttcatccaccagctgcggcatacacattcttcacctcagtatatgcaacattctccaggatagactgtatgttaagccaaaaaataaatctcaacaaatttttaaaagttgaaata

SEQ ID NO: 179982 - DNA, 283 bp, Homo sapiens
attaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttcta

SEQ ID NO: 179983 - DNA, 303 bp, Homo sapiens
cacaggctcccctagggcccagaggcagccaagctcaaggcaaagtggatgggagaaatagtaatcccccatcctctagtttccacctagacattgtacagctataaatgcttccacttgcacctgctgggatggaattgctcaagtacccagcacagaccctccaagaggggaggagtaggaaggagatgctctcatcctcaagagtcacagactctcttttgctccccacttgtcaagtttcaggaaatggctgcctctgtagctcctgtcttagactcacaggtgcaaccattggatagg

SEQ ID NO: 179984 - DNA, 147 bp, Homo sapiens
gtaaatattttaggctttgtggactgcctctttcacagtgacttaactttgctttatagtgtgaaagcaggcatagacaatatgtgaacaaatgagcatgactgctttccaataaaactatttacagaagcaggtggtgagttggat

SEQ ID NO: 179985 - DNA, 123 bp, Homo sapiens
aagcacctggacacaagatggctcatgtcaaggctcagagctgggagcagcttgttctgggagccggggactgttgtttgtaaagatcagtgtctccctatggtaggccagttgcttcctggc

SEQ ID NO: 179986 - DNA, 272 bp, Homo sapiens
accaatggtcaactgtatgtgcaaaactaattaagatcacatagctactaaggaaaagatgatatgaaccgaagacatacattgcaaagaccatactcttgctcactatgctgatgtgcctttcttaaggatattcttttttttttttttttctttttcttgagaccaagtttcactttgtcaccaaatctggagcgcagtggcgccatctcggctcactgcaacctctgcttcccgggttcaagtgattctcctgcctcagcctcttgagt

SEQ ID NO: 179987 - DNA, 804 bp, Homo sapiens
tgaggcgagcgagtggcggggctgaagggagtcgcggcggcgctgaggccagcggcggagctgtggggggcaacggtgctgaggcggtggccgcggccgggcgggttgggctgacgtgagaagcgccgccgccgctgggcctcctccattccggcccgcagccccgcgccctcccagcctttggcgccctcccgcgcgggcggcgcgctggcagccgactactccattagtccgccagccatgacagacctgcgtaccacactcgacaggtgcagccagaactaccacacaggactcagaggccgccatcaaccgccagatcaacctggagctctacgcctcctacgttatacctgtaccatgtcattactactttgaccgcgatgatgtggctttgaagaactttgccaaatacttatcattacaccaatctcatgaggagagggaacatgctgaggaaacctgatgaagctagcagaaccaacgaggtggccgaatcttaccttcagcgatctcaagaacccaagactgtgcatgcactgggagagcgggctgaatgcgcatggagtgtgcactaacatttggcaaaaaactgtgagtcagatcactaactggaaactgcacaactggcacttgacaaattggcccccatgtgtggtgacttcttgagacacattaactggaatgagccggtggaaggccatcctcgacttggtgaccccgtgaccattgcgccagatggaagcgccgaatctggctggcggatatccttgacaagacacctggaaactgctatgaagccac

SEQ ID NO: 179988 - DNA, 311 bp, Homo sapiens
gtggtgtgttatgtgctatgtgtcatgcgtgtgtatgctgtgtatgatgtggtgtgtaggttgtgtggcatgtggtgtggtatttgatgtgtgtgtatggtgtgtatgatgtatgtaggatgtatggcatgtggtgtgttatgtgctgtgtgtcgtgtgtatggtgtgtatgatgtggtatgtaagttgtgtggcatgtggtgtatttggtgtgtgtgtggtgtgtatgatgtatgatgtcatatgtagcatgtgtgttatgtggtgtgttatgttgtgtgtgtggtatgtggggtgtgtattatgtgata

SEQ ID NO: 179989 - DNA, 532 bp, Homo sapiens
tttatcgagtgacaaaacagctctcagcagagagggggacacgagttgggtgcactacccttacccaaaatcaggtagtcctccctgtgcctgaaggtgggcagtccctgcaagtgtggctgagtccggggcctttttttttttgggatggagtctcgctctgtcgcccaggctggagtgcagtggtgcgatctcagctcactgcaagctccgcctcgcgggttcatgttattctcctgcctcagcctccccagcagctgggactacaggcgcatgctgccacgcctggctaattttggtatttttagtagagacggggtttcaccgtgttagccaggatggtctcaatctcctgaccttgtgatctgcccacctcggcctcccaaagtgctgggattacaggcatgagccaccgcacctggccaagtctggggcttttatgggctcagaatgggggagtgtgtggtgatgggtttgtgagtatgcaaaaaaggctaaaacaaaggcaccactcaaagatggaaacaacatg

SEQ ID NO: 179990 - DNA, 300 bp, Homo sapiens
catttgtgttgcaggagctggggtgggaggtggggcataagatggtctttttgacattttggaagattaagttctcagttccttaagaacgaatctgagacaccatgggcagaaaaagcgcctgcagctccagcttcacttccctttacgtgcttaatttctaagcagaccctttttaaaaaaaaaaaaggtaatacaaattcaaatttactctcagtccatgaatcctggtgattaatgcagtctgaatttgtgagatcttactgtgtttttgaaaggtgaagcccgctgggcttctgg

SEQ ID NO: 179991 - DNA, 531 bp, Homo sapiens
catgcctgtaatctcaggacttttggaggccgaggcaggtggattgcttgagcccaggagttcaagaccagcctgtgcaacatagtcagaccctgtctcattaaaaaaaaaaaaaaaagcatcctaaaaagtcataatccaatataagcactgacttatgaatatttttgaagcccagttctgcaactgagttccaccaccacccaggtatgccaccttcacgtgaccgaatgagatgcttgctctagaaccttattggagttaaaacaggtgatctcaggcagtattgactgatttttgaggatttttttttttttaaagcccagggagcttgactttagcagcccagtcaaaagtacctgccacagacgaagggccaaccaggagtggttttatagtagtaaacctataacacatggttttatagtagtaagcctatatactatatagagagagtatatatacaactatgtatatatagagagttacaacctaactctgaagaatatcaaaccaaatgtttagttagct

SEQ ID NO: 179992 - DNA, 630 bp, Homo sapiens
gggctacgggatcgagcggggaaggctttggtattctcccgtggttgctgtagggtgtttctagcccttggaaaatttcttgcccgaggttttccaggtggtgaatggggtgcaaagctttccagtacctttggggtcagattcctttcgagaaaaccacccctcttgaacaccgcttgcttttctgctgcttaggagaaagtaggagtggagagaggtcagattttttgaagatagtgttaatagttactatgtgtgtgcaagattaggactaagcctaaagtcttagttccctgattgccaaaatgagtgttagagcttccagtttagcctcctgtttagatttgctccttctaaatcatttggagaatcatagcaattttaagagttacttatttggaggattataaagagttttcttatcaaaaatgccttcggtgaattatgctgagactcttaccggcatcttcttaaatcctgcagtttttagatcgacttttaagaatatgaaagaaatacacacgcagttctattcacggtgccttgctttgagttggacatatggactctattgagccagtgatggcaatactttctttaggttggcacactttcatcaacaaatatttg

SEQ ID NO: 179993 - DNA, 160 bp, Homo sapiens
tttttggtccctgagttctgtctatctccacagctgcagctgcacaaaaacagtactgggacaaacactcaggatcactacgtgaaagtaccaggagttcagagttccgagttctaacagaagagctggaaattaggggaatccctaaaagcagagaaat

SEQ ID NO: 179994 - DNA, 187 bp, Homo sapiens
tgccccccactgcatggggcatgaacgccagtcatgcccagcacccagccctgcatagagggagccaggcaggacccaggcttgtggccaagtcaccctttgccaccgaatggtgtttgcagaagcagggagaggacgtgggtcataaagtgggtcctgttcctggagtgcgcaccctcccccgtgg

SEQ ID NO: 179995 - DNA, 189 bp, Homo sapiens
ttggagttatcagtgggtactactttgtctcggggctgctgtaaattattctttgttgtctccctgaagtgccccatcacagagtaacatgtgttttgggatagttataaggcatgtagggttataatgacaaagcaggaaagttggtactgtctaaaccacagagtttgtggttgaagtggcttatgt

SEQ ID NO: 179996 - DNA, 345 bp, Homo sapiens
agagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgg

SEQ ID NO: 179997 - DNA, 362 bp, Homo sapiens
ctattatccttagcaaattaatgcagaaacagtaaaccacatacttcatattctctcttataagttggagctagaaatgagaacttacgaacacaaagaaggaaacaatagaaaaaggagcatattggagggtgggcagtggtaggaggtagaagattaggaaaaatatttattgggaatgaggccttgtatctgggtgatgaaataatcagtacaactaatgcctgtgacataagtttacctgtatggcaaacttgcacacctacccctgaagccaaaataaaagttataaaaaaggtgatggtctcacctattctcttggggaaggctccaaaagtaacagctacctctagttaaaaatc

SEQ ID NO: 179998 - DNA, 406 bp, Homo sapiens
gtgatgtacatcctcagcttatgaatataacaggattaagagattaaagtaaagacaggcataagaaattacaaaagcattatttgggaactgataaatgtccatgaaatcttcacaatttatgttcctctgccgtggctccagccagtccctccatttggggtccctgacttcccacaacaagaaataataagaggttaaggtggagaagagcaaggaagtccactttataaaggggtcaggaaaaagctctctgtggaagcaccatcttagctgagacctaaaggatggtctaatttggggaggtgcagaggaaaatcattccaggctgaagcagcaagtgcaaaggccctgttgtggagaaaggtttgaaagtccaaggaaacaaaggaggccagagtgtccg

SEQ ID NO: 179999 - DNA, 532 bp, Homo sapiens
tctttccttgtctgatgcctctggtatccgacccataactttttaatctagatatggccattctgccgaagttttcagggttttcaggttgacgcctcagccaggcactctacctgactttgttaactttatttttatttgcacttggtgccacactcttcagcccactccacctccagtccctggggccaccatttctctgggaggagtagccaggcatttcttgtcacctaagctctagccattggattcatcttcattcctgacttttgtagtcaacatgatctgacattgttctttaaaatatatctcttttccatcatctatttccatgactattatcacaacccacatttaagttcttagcacttcatagttacacatttaacagctacgatcccatttcccgagacggtgattagttatacatttaagcacatgactttgttctggctaatgttatgtaagacaaagtcactgggagattcttagaaaagtttttctctgagacaaagggacacataaggagaga

SEQ ID NO: 180000 - DNA, 239 bp, Homo sapiens
tcctccgatacagtcccactcaatattcaccctggtctatttttgcacaagggtaagaatttcaaccagcttggataaacacacaagttgtgtgacatgaagataaatttggcaatggttgcttagaaactgacaacagtgcaatcaataggcagtttcccagagcgccctactccaacaccttttaaagtgccaatcaaagtttgcaaaaccattcattatatttcaatatgtggaat

SEQ ID NO: 180001 - DNA, 274 bp, Homo sapiens
tggaatgagggggaatggcctgtagacagagcctcagggagccacatctgtgagtatccagggagagaggaacccacaaaggacagaggggagtggtcgtagtggcagaagacccagaaacttgggatacagaaaccaaaggcgcagagaagacctaggaggaaaacagcagtgcgagggcttcagaaggccagagtccttgaggctgagagggccagactgcagcctcggggaaccgccaatgtccctggcaaggctgacggcagagggcggt

SEQ ID NO: 180002 - DNA, 662 bp, Homo sapiens
aaagggtgccagagaaaaaaataaagttaaaattaaaaaatcttttatgtttcttattcttaagacatctaagaaaactcttcatttaaagtagtaatagcaacaacacaatggataattagtgtatatggataatgatataaaggacagtaatgttataatggacaagagggagaaattggtaatacttggttgtgagatacctgtactacctgtgaaaccatatagtgttatttgaaggtggacttagattagttgcaaaggtacattaaaactctaagtaaccactaacttttttgaaggaagtaaaatacatgctaacagtggagataagatggaatcatatgaaagctcaattaaaaccaaagaaggcagaaattccaagaaaatatatttaacatgtatgtacctgacagcagaccatcaaaacatgtaaggcaaacactaacggaactacaaggaaaaggagacaaattcactattagagttgatgatcttaacatccctcttcagtaatttatagatcaagcaggcagaaaatcagtaaggatttagttaacctaaacagggtatagtggtgcatgcctgtagcccaaaaatacgtggccttatgtctggtatcaactcttacatgtaaagatcttggaagtcatcaccccact

SEQ ID NO: 180003 - DNA, 333 bp, Homo sapiens
ctctgaaaaaacaaaacaaaacagataaccattgttactattttgttgaacattttccagataccctgatagaagacagatctgtgcatgcacatacacaattttacataaatgggaccattccatataggccagtatctagtgagtactttttttactccacaatttgccatatatgtctttccaaatcaatcaacatagattaaatcatatcaactacacaggattccatcatctgtgtgtgctcttgaatcctacttttaaaatgttctcagaaaggttatcctgaaatatattcctatcagaagttttccacactctctctaaactgaa

SEQ ID NO: 180004 - DNA, 251 bp, Homo sapiens
ggctagctcacccacagttcagctgtctgtataatcaagtaacagtctgagaggagtgttgagatatatttaacatttggaacaattacaatgattatttcttagtaccatctaaaggtggcccctctatagcagccaagctaataagtagtaatgctgctgctgctgttgatgatgatgataatggtgaggttgatgatggtaatggtaatggtggggatgatggtgatgatggtgatggtgaggatgat

SEQ ID NO: 180005 - DNA, 285 bp, Homo sapiens
tcattaacgtaactacaaagtgtaattacaaactctggcaaatgtcgtgaaggaaaagtgatgttgagtcctctctttctcttacccaccacatctaatctgttagcaaaccctgtgggctctaccctctcatccccatcatcaagtcttccctcatctgcatctcttgcctggcttttgcagtgttctccagttgttctctctgctcctgtccttgctttcctgtagtttattctaacactttagatagaatgatcctgttggaacatggttaggtctacctgg

SEQ ID NO: 180006 - DNA, 178 bp, Homo sapiens
gatggaccaatattctagctaggaggaacctcacatgcagaggcttagagttatggaaaatggagagataagttaggagcagattgtaaagaggcacaccaggagatgtggaatttactttgtaggcaatagagaaccagcccaccagcccagactttcaagtagggggatcatggaa

SEQ ID NO: 180007 - DNA, 132 bp, Homo sapiens
ggatgaacgaatcaagtagtatcgggactatgctgtgcatatcgtagtgttctttcttttccctcaagacttggtctgcttttattgttccctgaagttttcccaagtccagatcagaagaggaaggtgttt

SEQ ID NO: 180008 - DNA, 793 bp, Homo sapiens
aaaaaaaaaagtaaaacttaaaaagaaaaccttttaaaaatgaaaagtagggccaggcatggtggctcgtgcctgtaatcccagcactttgggaggctgaggtgggtggatcgcctgaggttgggagttcgagactagcctggccaacatggtgaaaccccgtctctactaaaaatacaaaaaattagccgggcgtggtggcgcatgcctgtaatcctagctacttgggaggctgaggcaggagaattgcttgaacctgggaggtcgaggcagtgagccgtgattgtgccacccgtactccaacctgggtgacagagcaagaccctttcttaaagaaagaatgcctaccttaaaagcagctctatgcccccagttaggagactgaggtgggacaatcacttgagactaggagttcaaagctgtagtatgcagtgattgcgcttgtgaacagccactgcactgccgcctaggtaacacagtgagatcctgtatctaaaaaaaggcagctcttgggccgggcacggtggctcacacctgtaatcccagcactttgggaggccgaggagggcggatcatgaggtcaggagatcaagaccatcctggctaacacggtgaaaccccatctctactaaaaatacaaaaaattagccggacatggtggcacgtgcctgtagtcccagctactcaggaggctgaggcaggagaatcacttgaacctgggaggcggaggttgcagtgagctgagattgcgccactgcactccagcctgggcaacatagtgagactccatctc

SEQ ID NO: 180009 - DNA, 656 bp, Homo sapiens
taaggctagataaatcataagccaggaacatttgaaagtctatccagcctgggcaacatggtgaaactgcatctctacaaagaatactcaggcggctgaggcaggaggatcacttgagcctgggaggtcgaggcagtgagccgtgattgtgccacccgtactccaacctgggtgacagagcaagaccctttcttaaagaaagaatgcctaccttaaaagcagctctatgcccccagttaggagactgaggtgggacaatcacttgagactaggagttcaaagctgtagtatgcagtgattgcgcttgtgaacagccactgcactgccgcctaggtaacacagtgagatcctgtatctaaaaaaaggcagctcttgggccgggcacggtggctcacacctgtaatcccagcactttgggaggccgaggagggcggatcatgaggtcaggagatcaagaccatcctggctaacacggtgaaaccccatctctactaaaaatacaaaaaattagccggacatggtggcacgtgcctgtagtcccagctactcaggaggctgaggcaggagaatcacttgaacctgggaggcggaggttgcagtgagctgagattgcgccactgcactccagcctgggcaacatagtgagactccatctc

SEQ ID NO: 180010 - DNA, 357 bp, Homo sapiens
ctgaaattatgttgtcaggtagaatgtaggaaatgctatacctagactacattgacaatataaccttgaaagcattgtttatataaatgaacaaaagtctagaataaccgtattttagcaggcagggaattttgtagagctgtcacattcagctttctgttacaatttaggactggctatatattttgttggtttagtatgaaataaaaatatggagtcattcaaaagttgttaagaatttcagtatggcaagagacaagcaattaaaccaaacgtaacaatctgcgtaaaggtataggtcatagacccatgaagccagctctgcctctataccattactatttgccagaaatttag

SEQ ID NO: 180011 - DNA, 452 bp, Homo sapiens
aaagggagcaacaatggctgcagtatatgtggcctttcagctagcgcagaggatggaaaccagagtgggctgatgattggatgccaggcctgagccaggtgagtcctgttctcattatactgtaaagtgagctgctccaagcctccctgattcttagcactcccagtccctgcaggggtccctgagaaggttaatcttgcattaggccctctgctgttttccctctgtaagccttactccaccttgcagtgagttctagtataacttctattccagtaagatcaaatggttaaggactccagaaaagaaatttggtgaacacaaagggtttgtcatactttaacttttgtccctttcccaggtggcccatgcttctaggccagcctcccaattcctagcttgcttcatgctcctggcctttgcctactcaaaacaatctgtcctccctaacc

SEQ ID NO: 180012 - DNA, 684 bp, Homo sapiens
cctgtcacatattgaaagtaaaattaatatttgtaggaaatgcattccacaattaccaactgcagttgtgattcaggaaagggagatattgcatgggcattcttcaaatacagagaattaaactagtgattttgggaacaaccggactggaaaaggagaaaagcccagtgtggcaggcaggatgctatcactgaaaggaagctgaagggctggctcctaaacagcaaacaaattacaacccccatctttcagaaagggagcaaacatgaaagcaaaggaaatcacaagcccagagcagcagcagataatttcattcaaggcagctgactgaggcaaaaggaaacttcaaagcaaaaatcaaaaaagccaacaggcagacgaatcgacctggagtcgcagagtggccatggcccaccttgaccaagaccactggttgctgaatgaaaattaaacaaacaaacaaaaaaaacccatataccacgtgacataaatcacccaatcaacaataaaccagaacaaattaaccacgttcagttattactaagctacagagacatgaggcaggagcctgagatttcacagaaaaatgtaccaggggagatccacgaaacatctgtacctcaggcaaacaccgctgagcaacagcgaaaagaggaatgctacgagtccttttctttttaagta

SEQ ID NO: 180013 - DNA, 121 bp, Homo sapiens
ggccagactgggcaacacagaagatcccatatctgccaaaactttgaaaaatgagccgagggtgatggtgcgccccgtgcacctctgtggccaaggacagcgcgtggccatcgtggacagg

SEQ ID NO: 180014 - DNA, 427 bp, Homo sapiens
cttagctctttcgtgtgtgctcctgcaccactgatcccttccacaacatggactgtctgtgatgcacgtgtgcaggatgctgggagtgcccaggtggaaagacacacgtgctgcccccaggaactgactgactggtaggcacagtacagataccagtggtgaggacagtgaggattcttcccttctgaccctttgcagatggtaaaggaaggaactcatcacctaattcccccgactgccccttgagaacaaaatcccttgaaaaattccaaaagctttaactctgataactgttaaggcactaaacaagaggatgatggggcaaggaaaatgggggcagtgtagtgcagaagtctgaccctcaagagcagaggagcttggtcctagccagtttggtttcaggcctacagtggcatttggtattttg

SEQ ID NO: 180015 - DNA, 456 bp, Homo sapiens
tgcttgtagtcccaactgcgcaggagcctgaaataggaggatcacctgagcctggggaggtcaaggctgcagtgagctatcacatcactacaatgtagcctggatgacaaagtgagaccctgtatcaaaaaaaaattcttgtaagaaagaagaaatcaactaaaactataatttagatatattttagaccatttttaatgtacacacttgaaattaatagttttaaatgcccttttgtaacttgtattagaaaagcctagaagtgtagttccattaagtcataatcaatattaaaatttaagttcaataacaaaaccagcattagcatcatttaattcaaaagttaaaagttctttcctttagccttctgattaaccaatatttttgttcatactctaggtgatagatgggtctttgtgttactgttattctttgaaatagatatgtaatgccctg

SEQ ID NO: 180016 - DNA, 158 bp, Homo sapiens
atattgatttatcagtactttggtgtgtaaatcaagcattaagttgaagttctcttatagtcaataaattctatgggccctgtgtggtgggtggttcatacctgcaatcaaagcactttggaggctgggcagggtggctcatgcctgtaatcccagca

SEQ ID NO: 180017 - DNA, 503 bp, Homo sapiens
ttcccctcacttttccattgccaaataaatcgtccttatcttttggagttaagttgaaacatcaatttcttgagattgtttcagatcctacttttctactgcccaaaacccgtagttccccagtctgtcactttatagcacctggcacttccctttttgcaaccaatgtcacgcttattgtaatagttgttcaatgtctatcttcccaattagactagaagtttcattagcatagaaatcctatcttttgcacctcgattcttagcacaatcttgggcattgtgctttgtacctatttggatgatgaatgaaagatgaatgattacatctcataatcactttgagattcctttctgaaaactccaatattgaactctttgtgcctttctaaatatgctggtaaaactgagaacaggtttttctattagagtgaaaaggactgctgtttattgaatgtttccccctacctcgctactccttaccttttcctattatgacaatct

SEQ ID NO: 180018 - DNA, 558 bp, Homo sapiens
aaactaaaatataactaccatatgatcccactatcctacttctgggaatgtagcaaaaggcatagaattcagtatgctgatatttgttttatatcacttctatgatcacgtgagatagaaaatgaaagcaaattacattaacaaaaatgctcctaaaatagctctcatcagatgaaagccttctgaaacactttttaactcctcttttccttgatttttcccacgttagcatcttttgtgctaattggaaactttggttgtgccacatttcttgggagagtcctgtgctactctctgtgagattatctttcttacttagtaacagtccctctgcaagttgtgttgatggtactgccagaggtgttaatggaaggatttcagaccaagttcttgaatgtgtgcacagttgcaaccacattatggctgccttctggtcaatagtgtttttacaatatcaatattaagacatatatgtctctttgaaaaagtaagaaaatgcgcactgtaacataaacagaatactctgtttttttctgtgactgcccatttctcagtggt

SEQ ID NO: 180019 - DNA, 505 bp, Homo sapiens
tagcaaaaaatattcaatcaacctaagtgtccatcaacagataaaggaaatgtggtatatacacataacaaaatactactcagtcacaaaaaagaataaaatgtcttttgcagcaacatggatggaactggacgtcattatcctaagtaaaacaagccaggcacagaaagacaaatgtcacatattcgtattcctaagtgtatgctaaaaaatgagctctcatggatgtagagtgtggaacaatagataaggaagacttggaaaagtgagtgagtgggaggggggaagatgatgagaaattagttaataggtacaatgtaggttattagggtgatggatacccttaaagccctgactttactactgtccaacctatgcgtgtaacaaaattgcacatgtaccccataaatttacacaaatgttttagtcctaaaaaatgcaaatgatcatctgagccttcagtaagctgtaatctttttgctggcataaagttttgcctcaatgt

SEQ ID NO: 180020 - DNA, 199 bp, Homo sapiens
tatcacaaagctacagtaatcaaaatagtattatactgacataaagacagacacacagaccaatggaacagaagaattagcccagaaataagccctcacatatattgtcaaatgatatttgacgagggtgccaaggccacaaaatgggggagagactagtctcttcaacaaatgatgttgggaaaactgattacgtcca

SEQ ID NO: 180021 - DNA, 169 bp, Homo sapiens
gagaagtgtgtgactagactgattttaaactgtgcatgttcatacctgtgtgagggtaagttgtatttctttggagggcaggatgatgtcctaacacaagatatcataagacttcattttctgggttttgtctgtaatgccttttttttttttttttttttgagacaaa

SEQ ID NO: 180022 - DNA, 160 bp, Homo sapiens
cctaatagtcaccccatgaatgctcagtgaaagaaggcgtccaccacaaggtcctggggaaccaagaattccactgtggcccataaattctaagtcctacaggattctggaatgggagatgggaacggccttcaaaagtggcctctcttttaacccatta

SEQ ID NO: 180023 - DNA, 299 bp, Homo sapiens
aaagctttacacccactgcattgcacggaacctcccttgtcccactgacccctgcactctttataagcttgctggtcatccatcctggctcagctcccccagacctgggtctccagtaatgtgcctttatccaaggtgatgccataacgcagaacggcagacgccgaaggtgccttctcccatctgacacgagtccactctcaagatgacagcagcactggtgcagatgtggcaggtgactccaccctacaatcgctgccagtcctcccagaccagcctcagataacaggcactcaaat

SEQ ID NO: 180024 - DNA, 513 bp, Homo sapiens
tggagtctcctgcttcagacatttccttccacctgtaatacaactttctggaagaaaattcatagatgtagttagttaacatattaaaggagacatagctcacataaacagggcctaccttctgttacagaaggaaaaaaatggagttcaattgctccacaatgtggcaaaagctaggcttggtgagttattgagtatgatgtgagaacttggctgtttgcacttaaatttctctgagctttggttttctaagtaaaatgatggtaatagcaatctcagagatctgtgggaagggtagaaaagctttaaaggatgaagttatgttcctgtacgtgaataaagcataaaatgttctgcatggctggaacattgtggacatctgtatatactttagtttttgtcctagcctcagcacaatatgcaaatcttctgtttctgcatagctacctttccaaatacctaacaaactgtttttctgtctttctgccttttttgttcttcctacttaccata

SEQ ID NO: 180025 - DNA, 809 bp, Homo sapiens
attcaggacataggcgtgggcaaggacttcatgtccaaaacatcaaaagcaatggcaaccaaagacaaaattgacaaatgggatctaattaaactaaagagcttctgcacagcaaaagaaactaccatcacagtgaacaggcaacctacaacatgggagaaaatttttgcaacctactcatctgacaaagggctaatatccagaatctacaatgaactcaaacaaatttacaagaaaaaaacaaacaaccccatcaaaaagtgggtgagggacatgaacagacacttctcaaaagaagacatttatgcagccaaaaaacacatgaaaaaatgctcatcatcactggccatcagagaactgcaaatcaaaaccactatgagatgatatctcattgtgatgtaccacattcttaaaagtccagtccacttttggtggcttgtggttggctttgtgattttgctagtgtaaatagtgctgcgactgcaggtgtctttgataaaatgatttccgtgggatagatacacagtagtgggattgctcggtcaaatggtagttgtaactatttatttgagatacctccatactgttttccataaaggtggagctaatttacattcccacaaacagtgtatgagtgacggatggagtttcttttaactcagagatagcaagtatggaagcagtgggtttttgttttcacaagacttgtgacatgaaaagagaaatttggaatgtaaattaattgttactgcatagaaatttgtctaagtgcttaggaacttaaaatctatcctagttaaccttcagtt

SEQ ID NO: 180026 - DNA, 171 bp, Homo sapiens
tccaactacactgctcttccagataccccacagtgctcaccatcaacccgtacatgtctgatttttttttaaatgttgtattatagaaattttgaaaaatgaacacaagtggagagggcatcacgaaccttgaattaccttgctttaacagttaacactatttcctcaatg

SEQ ID NO: 180027 - DNA, 657 bp, Homo sapiens
ttctactgttcactcatcagccacttgtaaacttatttttccgaggcttctagcctaggaagaacctgaacactataaacgagatctttctctgaagatgctcagagtgtgggggaagggacagggtaaaagaagttactagtatagcatcaataaattctgttttgattgcaagtggttttgtactttattttctttcactctcccccacctttttttttttttttttctgagacagagtcttggttctgttgcccaggctggagtgcagtggcacaatctcggctcactgcaacctccgcctcccgggttcaagtgattctcccgccccagcctccgagtagttgagattacaggtgtgtgccaccatgcctggacaatttttgtatttttagtagagatggggtttcaccgtgttgaccaggctggtttcgaactcccgaccttaagccatccgcctgtcttggcctcccaaagttgcagcggctcatgcctgtaatcccagcgctcaaggatggcttgaggtcaggtgttcaagataagaagccagaagtctaaggcagtatacaataagcatcacataattgctatagcacccagagtctgttcttttaagcaaacaaatatttttataactttgtattttataagcattta

SEQ ID NO: 180028 - DNA, 809 bp, Homo sapiens
tcctaaagaatagaaagcagacaggcgtgtatgcaatagaggaggagaccccagagtgctgagctgagcatgcccatggcctgcacccacattcaccattcagacgaggccctcctccctggaggtgatcccaaacctctggaaattggagtaactggccatttgatacccaaggattatgctcggcttggaagaatgagcctggcctatgggagtctctcctagggattaatctccaagacaaaggaagttgttcattggtttaggagccgggtagaaatcctgtaagttcagggttgcaagattttataccatttgtctgagctaggaggaaacccaggtagtggagagagaattgtgatcagttcctgtaacctgccacaatccctggtggactgaagaaagggtggcgaatgcgggaataaaagacaagagacaaaagagtatatttggaagaaggggtcagggggcaccttgcctctagtggacaagggccctgagctttacacagctttctgtatttattaggcaaaagagatagcgagaaggcaggtagaagaagaggtcagcttgtccagagtaggcttgcaagactgcattccctagatgtcgcagtagataacctcaaggagctcggcgccaggaagcgactgccctcatcaaaccttctggggcaggcacagaagtgagtttgtccacattctgtattaatggtaaacagtttgctgtttgatcatatagccccagtggaatgctgagttggtcacatcccacaggcctttggctccctgcagttctctctccctgaa

SEQ ID NO: 180029 - DNA, 370 bp, Homo sapiens
aaaaccaaatttgcatcattaggctgaggaatcgataagaaaagtgggtgtgtcctggaagtatggtatgcaagacatactagtggagttaatttacaagaacatccgaagaccatttgaggaaagaggctcaaatttcagccttgggaataaaacatagagatgggtattggttagaaaaacacataacaagttaatgacaatctactggatgtggagacagaagtagcaaaatactgcagtaaagaacaaaagatcatggttgtctttcatgatggaatgcctaggaagtctttgtgattttacaggacccagcagtgaataaagctgctctcttcctggcaacatcttaaaagaaaccagcagccgt

SEQ ID NO: 180030 - DNA, 473 bp, Homo sapiens
tgagaacaaaagcaaaatgctactttcacccagcaatacacatgcccctcagggaaaaggataaaaatgctaaactgtcctcttatagtggagcagaggaaaaaatacagaaagagcaaaataacaaattaataattaaaaagtatcctattagaagtataaaaattctaaactgttgtttcccctgaatcttctggcaaaatcaaacctctgatgaactgtgctatgtgtttaatttaactttacatacttttggtattccaaattattccctggggcacatatattccagctggagaaacggggttataaatctcatttgattcttcataacctacggattgggagccattatctctcttttatagatggtaaaactgaggctcaaataatttgagatttacccttggttagtgatgattcattcagcaaatcctttgagtacctgtgatgtgccagacactgctctaggg

SEQ ID NO: 180031 - DNA, 255 bp, Homo sapiens
tctttttagctggcaaatttctcttttaaggtaatgaaagtgtttcaggttcctctttgtccatttgcaaataaactggtgagttaacgtcactcccagtgcaaatgagagtgtagtgcacacgtcatgaagatgaagtggtttccccttaattttgcatattttcttgtctgcttttaactctagaagatatttgccttcacctgatttacagtcaggttcgtttctcgcatcgtaaatggactcttctcggtt

SEQ ID NO: 180032 - DNA, 364 bp, Homo sapiens
gtggaattatataatatttgtccttttgtgactggcttatttcatttagtgtaatgtcttcaaggtttatccatgttgtagaaggtgtcagaatttccttccattgcagtatacaccatactttgtttagttattcatccatgatggacacccaagttgcttctatcttttggcaagtcacaccctcttcttaaccatcttgacctgcaagtgacacctgtctcttctgatcacattccacaggagaaggtatgacatagctccacctacatgcaaggggagccaggaagtgcaatccctggctgggctgccacgtctcagaaaccattaagcctatggaaggtaaggcacaatttgttggtgg

SEQ ID NO: 180033 - DNA, 305 bp, Homo sapiens
taatctgcaacctgcatatcttctgtgtttgcccattgattagactgtcagctccctgaggacttccagtattccatttgatgtgcctttgacacaaaggcagccttagggcagacaccaccaagaatctgccagactttctcctccagaaccagcatagggataggaagaaggaacatttagcaaaatgtcattttccctaatatatatctcattatgtgcacttattatccagcttctttgtttaaaactctgctctaagtgttgtgggaaatacaaaatgtaaaataattagatttaaatta

SEQ ID NO: 180034 - DNA, 440 bp, Homo sapiens
atttcccttcactcccttgatactctgtcagcacatcaggtaactccactgcatgttgctagtaaatttcccttttaatgtatgattcctccttttccttagtttactaatgactgattgacccagaaaaagaaacttcagtcctctcgtgaagcctttttaaaaatcagcaagcagcttcttaatattagaattttttttttcaaatgtcagaaacaagataaaatatgagctcagactcttcaaaaggagaaggtggccggggctcagtggctcacgcctgtaatcccaaagtgctgggattacagacgtgagccaccacgcccggcctgggcagttttaaaaaggaaagcttcacttcacttaaaaggcttccttgcaatgagggggatgcttgggtgataattagttgggtctggtgaatacatggatcatcttat

SEQ ID NO: 180035 - DNA, 565 bp, Homo sapiens
tagggagtctttgcagcctgtagaagaggagaatacatataagaaaagtgaatgagccggcaggatggaaatctgattagcgtctggcatggctgagtatgtggcctttagtaattggacctctgcagcttttctcctccacctttgtctcggcttccacagagtgaggaatgtgatgcatgctggagacgggtaatgtgactgaccgagagccctgatggacaaggtgacgttggtgatagcccttggtgtggaacaggacctgaaagaacaggagcaggggaggttgaatagaatttagccagccttcttaggaacactcccagcaaacccttctctaaccctgaaggctttcacagctcactttgccgtgcatttagaaactcctcagcccaaccgctccctctttgttcatttgttttacattttacaaacatttgaggaaaggcactggttgtggggcatcaggaaattgttgcggtatgttccttgttttcaagatgcttatgtattgtgcggggaggggaggatgtgtatccaaaacactgttgcacaaggcagtaca

SEQ ID NO: 180036 - DNA, 365 bp, Homo sapiens
gctcatgctgctacctagattactacatgccactcatctcccacggatgcttctagatcttggagcaacttcttggaagtttctctgccttctcccactcactcttcttgtgacacccacccctacctcttcctgctccactctctaatgctcttctgctcccttattgtcaagctcgagtcttaccaatccatcaccactacttctggcttattaaaacttcagcgtggactctggtggccatggtggtgatatgtatttataccaccttttgagctgtacccacaagcaagtcacataggacactgcaggaaacagcaccttgagccagctttgctccagaaaaggtgcccttgggaaaagaa

SEQ ID NO: 180037 - DNA, 219 bp, Homo sapiens
cagcttaaggatccccttagggagatgacctaaatgtcatttttcaatcttacacccctgttacttccttatatttactctggtctccaaataaacaaaactgctcaccttgccccaaataagcacataccatccttttcctgtgcctctgccattcatttccttttcctgaaatgctcttccttctactccctaagaccctagggtaccgatgctcga

SEQ ID NO: 180038 - DNA, 842 bp, Homo sapiens
  misc_feature (839)..(839): n is a, c, g, or t
agatttctccttcaaataaagagtggagctgaagctaagaaattgcctggagtaggaacaaaaattgctggaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccaatccgttcccctttgggagtcactggagttgcaggagaaacccctggcatggattagtgaaaaaagactctttgattacatccagtgngaa

SEQ ID NO: 180039 - DNA, 634 bp, Homo sapiens
  misc_feature (631)..(631): n is a, c, g, or t
aaggctcacagctggattcatgcccagtaaagggacacctgaatggaactgagtcacttttagacttaatatgggatgttatgacaattcttaagttaaaaaatgcagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccaatccgttcccctttgggagtcactggagttgcaggagaaacccctggcatggattagtgaaaaaagactctttgattacatccagtgngaa

SEQ ID NO: 180040 - DNA, 376 bp, Homo sapiens
tgcagagggaccaggaagacaagggctcaggctgtgccccacaacctgctctgagaagtctctctctctctttttttttttaacctcttcattgatagccttagacttccaaatgaactgaccagcatggagcctccataaaagggcacagaattctgtctggcacccaggaggaagggggttcccagtgagggcagggccagtctgcatgcacctgttcaggaatgttctcctcatagctcagcctcaaggtgtagacatcctctgtgagcacgcagtgtcatgggagcccttgcccggggagcagtccagctgcacacctggaatgggatggttttcctcttgaatgtgtggtgctaggccccatggcaggcag

SEQ ID NO: 180041 - DNA, 567 bp, Homo sapiens
caggattgagggcagaggaggaatgcttaagagacaggaaatgtagttatttttctcatgaagtttgtatcagaattgtatagagaaggagaaggaaggtaaacaaggacaggatcaaagatacagagaaatggcaaggaacagaaggaagaatagttcatcctctgaaataatagttaaaagactggtgaggatgaagattaagtttgtcagcagaggggtgtgagacagtaaggaggaaggacggacaataaaaggagggatggacaataaaagaaggcatgacctcctaggaagtgggcggcaggacctaacgcaacctcatttttacactccaagaagtagcagccagagaaactgtcttgtatcacttgacactaaattatttcatatccacactgaaaattttgaggccagtcagttcaaattatacctttcatccctgtaatctgtaggaaaaatctaagatgaaagtcttggtcacctattctccctaaatcctcaatcttctctgtcctactgttctgtttttcctcacttcaactcattctgttgctcctctctctc

SEQ ID NO: 180042 - DNA, 310 bp, Homo sapiens
tagtctcaaattaaaaaaaaaacaggccaaaactatcacatatttaatatatttcactcctagttgtgcaaatctgaggcttatccaggtccactaccctttgctcattgtctctcaaaaagcatttaggtcagacagagaatatgaacctttttactctgccttctaataaaaagttacacagggaaagaaaacgttatgtacacagtgaaatttggtcagaggaacttctattttcttcttctcttctacctatattgacataaatagagattataccaaacaattaatgatcttttttttttttttt

SEQ ID NO: 180043 - DNA, 383 bp, Homo sapiens
ctcagctagtttatgatctaaaagtcctcaactgcctattgtcccctactccctatgctgcttctaactttggctcatacttctgcctggaataagccgctcatgcttctagctgcctgattcccagtcacatttcaagactgaacttagcatttcctggccactcttacttccctgccatctacactagattcctattgcatacctgggtactccagtactccttcatgttactattgtattttggataccattctacctcagtgactgaaattatttgcttctgcatctttcactcttgagtataatataaatttctgtagggtgaaaactaattattacgcatctctgtatctataacatagtacttgatgccttaaata

SEQ ID NO: 180044 - DNA, 309 bp, Homo sapiens
ttcctcactgtccatctccggctatgacaagctcttcacaactcccttgtaggaatgccatcctgcctctccaataattataatgtcacttggtcaaatcctacaaagcttctcactgcatccaacactgacctgtctcctttctgaatatcagtaactgcatgtgatccactcttctttacttgtgatgtttccgctaacatttggaaatggttctccatcatagctccagcaatgtaatcattcctgagatgtattgtgatcctctttccagacgctcagcagcaatattcctgccaactgcccttg

SEQ ID NO: 180045 - DNA, 347 bp, Homo sapiens
acgtccgtgtacttccctcagtgttaggaccgagggccttgcgatgtatgaagcaagaagagaggcaggaggagggaaaaccggcgtctcttttcactttctctatatcgtctgacagtacggttgcttttctggtgtggttctgtcttctaaaatattagaaccaggctgggcgccaccgtctgtaatcccagcactttgggaggccgaggcgggcagatcacctgaagtgcaggaaacaagacctatgaggtaaggctccattttctttctttctttcttttttttcctgttttgttacagacggggtctcactgtgtcacccaagctggagtgcagtggtgtga

SEQ ID NO: 180046 - DNA, 618 bp, Homo sapiens
aagtcgtgtggtgcaaagttgctttgggcaggcccatgtgaattcctgataccagaacttcctaagcctggacagacattaccagctttctcagctcttctcagtgcactttggggttcaaggtgagacctggttacctctatctccaggaaaacaggtggagagagcagaagcaagcctttactctggtgagcaattgggcgatgataataatagtagttgtgacattattcactgcctcctatatgccaggcccaacaaacgcatcagcagaacaaaccaaatgactcataggccaaggaagaaatggaaattagaaaatatttagaattgaggccaggtgtggtggctcacacctgtaatcccagcactctgggaggccaagacgggcggatcacttgaggtcaggagatcaaggccagccatcctttgccaacatggcaaaaccctgtctctactaaaaatatttaaaaagtagctgggcgtggtggcatgggcctgtagtcccagctactcggaatggaagactgaggcaggagaatcacttggacttaggaggcagaggttgcagtgagctgagatcacaccactgcactccagcctgggcaacagagcgag

SEQ ID NO: 180047 - DNA, 519 bp, Homo sapiens
agaaaaggttttggtgacacgtaagagatttctcagcaaagtgcaaagactcggatacaagtgttctcttgcctcccttatgcaatgtgtgctggtaagagtttaacaatcggctctccaggaggagactggggcaagagggaccctgatttgcagcatttgccagttccgcagggtaagtgctcccactatggctggtttcaaactaccagtgtgacatcacagactgtgtttggaaggagatacacacgatagtcttatgagccagtatgagttggctccagcacaccactgcatgccattaatagatttctgctgttctttggaaatttatatcatggtatttattgctgatgagaagataatgagtttttgcttaagtttgggaaaggaaaacaaatttgaaaaatgtgcactgaaattgttatgaaaagctcctaattcttgagtttttgttgttattgctgtttttaaaagattgcttgtttggtccttcaaatgtgagtaaaggaaagaaga

SEQ ID NO: 180048 - DNA, 301 bp, Homo sapiens
caggagagagtcactagcaaaagggtatggggagggaagaggtaattgatgagtagagcctcggggaagccttcctgagagatggcatcgagcacgacggctttgaagcacaggtaggggttttgatctcagagcagagcagcatgtgggaagattccaaggtgtgaaaaagagggtcacacaggccaccaccccttagcaacgtggatgtctccagctgtgacccaggacagagagttttgagatggttacgtgactgaacccagtacacgcccccaggtgactcgtgagcccatctcaa

SEQ ID NO: 180049 - DNA, 865 bp, Homo sapiens
ttaactcaagttagaatgaatgaaaatttcaatttaagatcaatcaaatacacccatagatggaaaaaatcagaatccctgtaatggccaggcatggtggctcacacctgtaatcccagcactttgggaggccaaggcgggtggctcacctgaggtcaggagttcaagaccagcctggccaacgtggtgaaaccccatctctactaaaaatacaaaaatcagccgggcatggtggcgggtgcctgtaatcccagctactctggaggctgaggcaggagaattgcttgaacctaggaagtggaggttgcagtgagctgagactgcgccactgcactccaccctgggcgacagagggagtcaaaaaaaaaaagcagcaggcacggtggctcacgtgtgtaatcccagcaccttgggaggccaaagtgggtggatcacctaaggtctggagttcaagaccagactggccaacgtggtgaaaccccatctctactaaacgtacaaaaatcagcctggtgtggtggcaggtgcctgtaatcccagctactctagagactgaggcaggataattgcttgaacctggaaggtggaggttgcagtgaactgagatcgtgccattgcactccagcctgggcaacaagagcgaaactccatctcaaaaagtgaaagaatccctgtaacctccagttccccagggtgggtggtcctgtcttgtagaagagaaacaggccccgatgcggggaaggagcaggggtttggctctgtgaccttggcccagctgtgtcccttctttgaactttcatttttgctatctttacagcggaaatgaatccctacttttcagggtgatcacgtgggagctagttgg

SEQ ID NO: 180050 - DNA, 362 bp, Homo sapiens
tcttgaaatagttagttccttatctgtctttcacttcccattagaaagtgctgacattctgattttctgtaatcttattactctatgtgacttctatagagctctttcttattttttcttcctgttatttttacttttgaacatttacagggtgttagctgtcaatgacaatgaaccccaactatggtctttaatcttttcacggtggggctccaagatctttataactaccagcaaagagctctgtgatttgccaaaattcaatcataaggaagagtaaccccctccacactgtttttattatggtcttttccctccttgctctactacatttgtgggcataaagctttgggggaatgaaa

SEQ ID NO: 180051 - DNA, 448 bp, Homo sapiens
tatgtctttaccagcagcgtgaaaacgaactactaatacaccagtgaactctccaagttcactaatagtctttgaaggtgggactttggaggtaggagataagcaagggtctctggactatttgaaagatgcagaagccgtcagacactgggcacgctgtgccccaggacctaaccatagcctttggcacctactaacatgccacctaatctatttatttattatgtttgctattagttttctgcctctctctgctagaatgaagaaagctccatgaaactagggatctttgtttttaagatcagacagtatgcatgccctatagcatacactcaactaagatatgttgaatgaatgaataaatgaacttgttatgaatgtaattaatgccactgacttgtatgcttaaaaattattaagataggaaatgctatgatatgtgtatttt

SEQ ID NO: 180052 - DNA, 464 bp, Homo sapiens
catagtagtatggatggccatgggaggaagattcccagtacctagtaaaatgaaccattattgggaaacaatacctgcaagtgctatgatgtcatcatgaccttggaacaaaggcagcatcataaaaccagtaaatacagtccactgtacctgcccaggtaaagcaggaggctttttggtttactggtaagatttctgggctggcgtacgccttgcctgttgcagcatgcagatgttctctgtgtggtggcttgggaatcactggacattgtttgtggcttggctgtatcttaacacctaatgacccactggtggggattatggtactaggtccctgggttctggtataccctcatgggctagacaggcaggagtctggttcaactgcatagataaaaccttttttaaatcaggtgctggttaagggagatatcataaaacaacctttgaagatacaagaattc

SEQ ID NO: 180053 - DNA, 182 bp, Homo sapiens
  misc_feature (17)..(17): n is a, c, g, or t
gtgtgtgttggtgtggnagctgtcaaagcactacagtatcctgccatataagtgtgtggctgttagttcccggcttgtgcagtgcctaagtatgctgactgccttacctatatggcatctcctgtcatttgttccacaaagcttgtgctgctgcactttcactgtgtcttttctttccctgc

SEQ ID NO: 180054 - DNA, 220 bp, Homo sapiens
gttcctgaaactcttcttgcagttgctttagggttaaagataaattcttaatgaagaaaacaaagacaggagaagcaaggttgtactggggtcagatggatgtgagtaagccaaaaagcgtgctagtaaagaactaccgattaagtcatgaagacactgaaatcaatctttacttttgaaaaacacttgtaaagggaagaatgtgatgagatttttctac

SEQ ID NO: 180055 - DNA, 457 bp, Homo sapiens
atgacacaatatagtataagtccttacggtgcacatgaactgcgttaacatccattatatatattttgcatcttgctgttggccattccattaagagaaaataaagggagaatgtgggaagttaaataaaacttgaaaatgtgtgctagtggctagaacaaagctagagttctctagaaccacatttatgaaacacggcaaaatagaaacttggtgatatccacggctgttagaatgatggccatcagtcatgactgacttacagcttcaggagttttaaagacagcattaggagaaatgtgaaacctcaaatacggccataggtggatcattaagtctaattcctcatctcctaaacagtttgtctttttccagtcgttaggaaactgcctgcacccttctggagcacaactagtcagtggcttggtctgggcaccctctctctattgaccaacag

SEQ ID NO: 180056 - DNA, 424 bp, Homo sapiens
tgcctcaggatgaatcatgcactgagtctcactcatatgtgatttagatgagactgtggaccttagacttttgagttgatgctggaatgagttaagactttgggggctgttgggatggaatgagtattttgcacatgggaaggacatgactttgtgggggccagaggcagaatgcatcccttctaaaatttgaatgtgtaccttctaaaattcatgttgaaacttagccaggagtgctggcaaatgcctgtagtcctagctactcgggaggctaaagcaggatgattccttgagcccaggaggtcgaggcttgcagtgagctatgattacatcgctgtactctaacctggatgacagagggggaccctgtctctaagaaacaaaaacaaacacccatccatcccccatggaattcatgttgaaa

SEQ ID NO: 180057 - DNA, 542 bp, Homo sapiens
tggagaaggtggtttctgtgcagtgctgtgagcagcagccagagtggcacgtgcaaagagatgggcactgagggaggaagacactgctctttattaaagacaacagacagtaatgctagagatagaggcggccagtggctgcggcaggagatgtttcaagtggagagaagcaagtcagatgagagacaaggaaagaatgcagggtgagctgcatgggaagccagtggcacaggcgcctgccagtcaaactgttactacccctgagtccctctgtccttaacaccccttggctccctgctctctccacatgaccattccctatttgggccctcaatgatctctttctcaggctcttgtaattggcctgcatatgacactccctccctctcagcctagccacagccaggggatttccctaaatggcaaatggggcatgctactgcccacggctgcccaccccacagcccgtgacagcagttctcaataaggcagctaattgcaagcaggtctctggttgccatattgatttggggaggggtata

SEQ ID NO: 180058 - DNA, 344 bp, Homo sapiens
cagagtttagaaaatgaatgttgatagatagtctcccactagtctcttactattcaaagtatggtccctggattctcaggaccagcagcattagctttacctgaaatcctcacgccagacctactgaagctgacctactgaagcagaatctgtattttaacaagatctccaggtgatctgtatgtaggtgaagttggagaaggcagtgttaattgactccactttttttgttgttgtttttgttttttttttaagccggagtcttgccctgtcgccaggctggagtggcgcgatctcggcttactacaacctctgcctcccgggttcaagcgattcccctgccg

SEQ ID NO: 180059 - DNA, 400 bp, Homo sapiens
ttgtagttagtgctattgagagcttgaaaaagttctgaattgcggagaaccaccagcattttgggatttgtgacaccatctgaaattgcttgccgggcagatttttccatttggatgtaataaaactcacgaaagttgctgaaccacttgatcatctgggaggtaatgcagcggttgaactgtacaaacaagaggtccatccagtcagacatttgccacgaggtgctcagaattagaactgtctgcttccagctcagtataggggttcatatacggctttaaccagcattaacaggggcttcctttaaaaaaagaagcgaagccaccgctattttccaagcctatttagttatactcagaaaaatctaaattagctacagtgcccattagaacataactt

SEQ ID NO: 180060 - DNA, 600 bp, Homo sapiens
gtgcttgttctgtgctaagcactgttacaaacatgcaaaaacgctctttgagggggcttatgtgttagtagggtgagacatgataaagtaatagaatatatggtactttaggtgatgatgagtgataaggaaaaatagaaaggaatagggagtgggtgagagactctgtgtgtgtgtgtgtgtgtgtgtgtgtgtgtgtgtgtgtgtgtgtgtgttgtgggcgggggtcggttgcaactttagattgggtggcctgggaaggctttagtgattagtgagatctgagcgaagatctgaggaaggtgagagagtgagccacgtggataactaagggaagaacatcccaggcgagtgtgaagttcctgaggtgaggccatgactaacgtgtgtgagggacagtgtagaagccagcgcagcaggggcagaacgagggagggggagagtggtgcggggtgagggagagaggtggctgaggacagattgggtggtgcctcacaggccatggtgaagactttggcttttactccgagtgagggggagccgcaagagcattgtggacggaggagggatgtaatctgatttaggatttaacaggctccc

SEQ ID NO: 180061 - DNA, 197 bp, Homo sapiens
aataaggcagccagcacaagcctggagatggtgtgcctgtgtgtgcaacatgtgtgtagttgtgtgtttgtgccaacacatgcaagcccaagtacatatcctatcagctattgtgtgtgtgtgcacatgtgtatctggggaggtgcccagcatgaaccatgtgtcggtgtcagcgtgtctgcatctcagtgtggatg

SEQ ID NO: 180062 - DNA, 435 bp, Homo sapiens
  misc_feature (7)..(7): n is a, c, g, or t
cgactcngaggatccccttattcgtgttgcaccacgaacttgggccatcaacacaatcacttcagacaagaggcccctttcgggatgttcctatccccactccatccccacccccagttcatagtggcagggaatgagtcccaggccctgggtcttatttatttatgccacccttgtcagtttaggagaatcccagcctccagtgcctgcaatacacatggtgctttgcttctgtgatctccaaaactttgcagacaaggaaatgaccactcagaggctgagtagcttgcctaagataccacagatagttcatcacagaagcgagattctaactcagtttgtctcattcaaacctgaattcactgaagtgcagggtgctgccttgagcgtgtgtgtgactcttatttataagacataacgtgcaacacgaataaa

SEQ ID NO: 180063 - DNA, 482 bp, Homo sapiens
cctttcacttagtataatgttttcaaggtcacagcatggatcaatacttcattcccttttattgccaaataagattccattgtatggatatactcgtcatgtcatctgacagtcacccattgcctgcaggttgacatccagctactgtagcctggcatcacagtcttctagagcaaaaggtcctgcacgccaaactggctcttgccatctgcctggtctacttacctctactctttttttttttttttttttgagacagaatctcaccctgttgcccaggctggagtgcagtgacacaatcacggctcactgcagccttgatctctgcggctcaagcgattctcccacctcagcctcctgagtatctgggaccatgggcatgcaccaccatgccctgctaaattttgtatttttcatagagatggggtttcgctatgttgcccagtctggtctcaaactcacaggctcaagtgatctgcctg

SEQ ID NO: 180064 - DNA, 271 bp, Homo sapiens
acaatctcttacacttttgttggaaatatccatggtataaacatttggcaaagctattttgctgtatatacctttatagcttttgcctcaatgattcattctgtgagaaagaaagcacgcctttttctaagcactcttcaggatggggaagcatgtgtccaaccagcctccatttcttcccaggacatgaaactcaatctactcagtacagttcagtctaatagttcctttccctccagatatataccttgctgtctttttaaaattgttt

SEQ ID NO: 180065 - DNA, 703 bp, Homo sapiens
gggagagatgtccctttgcagcagctgtgcacagggcttctgcacctcccctggggacagcttggtgtcttggctctgccttcagagccaggtcctttggggacagttctccccactcttcctgatgcctgttgtgtggtcgtgtctcacctcgctgcctgctggcccacttgagcccagctccttctctggagaagttaattatcaaatcctagcaagaagggcaagtggtgatgattccacgacagagtgataatacctcacctctgcctcctgaacaactcggcctggtttcagcctgtgaaaatgatgccagtcctggaagatgcctagtgacattgcggagggatgacctgctcccaaccaaggattcttttcttccaggatgatgtcctccgtcataggttatgagatgtgccctataaccatttatgccaacaggactggttcattgaaatatatgggcaccagttttaactgtttggtgcattgtgttagaaagtagcagcaattgaatcattgtcgcttgatttctgtcccttcgtttttcatgcctgtcagcaagcaaaagtgggacaaatatttggaatttcttttttctggaacaccttttcttaaagtgtaagatttaaatggttttcagtaccagtcatcaccataatcaattttagaccatttcatcacctctaaaagaaacattagg

SEQ ID NO: 180066 - DNA, 135 bp, Homo sapiens
tattagtaacccagggattgctgtgcccatatcaactaccagattggtaaggccatgttaacaacataccaaccacaggccacaaaaccaatatcagatgaaaataatattcagactctaacatcatgtttaaag

SEQ ID NO: 180067 - DNA, 401 bp, Homo sapiens
  misc_feature (7)..(7): n is a, c, g, or t
  misc_feature (350)..(350): n is a, c, g, or t
agcttgnatgaactttgacaaatgtgcgcacccctgtaaccacattgcccctgtggagatatagaatacttccatcaacgcacaactcctcttgctccttccccacctccatcctcaccctaggcaaccagtgttctggtttctacctttgtaggttagttttgcctttcctaagacttcatataaatggaatcaaataatatctatccttttgtgtctggcttctttcagcagttttttttttttccccagaggtagggtctctgtcacccaggctggagtgcagcgacacagtcatggctcactccagccttgacctcctgaactcaagagatcctcgcacctcagcnctcctgagtagctgggactacaagtgcatgccaccactcttggctaattaa

SEQ ID NO: 180068 - DNA, 637 bp, Homo sapiens
caggatggagtgtggtggcacgatcttggctcactgcaacctctgcctccaggttgaagcgattctcgtgccttagcctcccaagtagctgagattacaggcgtgtacgcccggctcatttttgcatgtttagtagagatggagttttgcaatgttggccagactggtcttgaactcctgggctcaagtgagaccttgtctttactaaaaatcaaaaaacaattttttgtggtaaaatatacataacataaaatgtgttatttaaaccatgttttttctgaatattatgtggaacattttaaccatttaaaaatatatagttccataacatcaagtacattcgtattgttctgcaaccttgtagcatcctgggattcaatcttgacttcctatgctcacttcctagatgataatctttcaatcccgagtttcataagcattcccaggtttatatctccaacccaaacatcttccatgaacaccagactccaaatccacgtaacacctccttatggatgtaaataggcatctcatttgacatatccaaagccaaactcctgatccttcttctgaagcccctgccaaacctgcctttcctattgtctttcttacccatgagtggcatctttattcttgc

SEQ ID NO: 180069 - DNA, 223 bp, Homo sapiens
aggtgtaacccacccacctggcctcccaaagctcctgggattacaggtgtgacccacccactgtgtctggcctatatttcttatagtaatatagttatggtggggtctgaaacagaaataaataaatgcagaaatatctaagtactttcaacaaatggctcatgctacagatcagtttctagcaggcagagcacccaagtatgttcctggaggttattggcat

SEQ ID NO: 180070 - DNA, 569 bp, Homo sapiens
tctaatataaatggcaaaatattcaaactgataggcattgagattcttaaatgctaaagttgcattcaaaaggataattttaggcgttgtgacaaagcagtgttatattttaaagttagtgacaaggctatgcaccttttatctctaattgtttcttacagaatgtttttattattgagtagtaaaacaataaatgtcagatcctttatacaaattcaagattgacattgataaacaaaacttcagcatatcactcaaggtcagcgtagaaattgtgtgtctggaaacttctatagtaattttatattactgtgacattagtatgtgatcacttttctagtaatgttttaaaaaaatatatcttacaggccaggcatagtgctttatgcctgtaatcccagcactttgggaggccaaggtggcaggattgcatgagtccaggagttcaacaccagtctgggcaataaagtgagaccccatcgctacaaacaaattaaaaaatatttatgtatgtgtgtaatatatataatatataacaaaacacatatgtatgtgtatatatagtatgt

SEQ ID NO: 180071 - DNA, 334 bp, Homo sapiens
gcggggagggatgaagggtttcatttcaaaactcaagagctaagagataccacaccagagaaattagaagacaacctggtggtgatgagtgcttctgacccacaccaggtgacgaggaggaggtagcagcagtgacagaaaacaaagtgacatcagacactcctgcagaggggaggggttcccacgactcccacccgcttttaacttcttgtacaacacacacctgtctgtgacatgggcactgaaactaaagccaacagtgagggaggactgtgaccatacaggaacatttctagagaaatgacaaagcacttcgtacgttacaccaaatgcg

SEQ ID NO: 180072 - DNA, 263 bp, Homo sapiens
tcgcttaccttctgccctttacaccagtgttcctcccctctggaggacacagcaacacagcactctcttggaaagagagcagccctcaccatacaagccaacctgccagtgccttgatgttgaacttcctggcctccagaagtgtgagaaatacatttctgttctttataaactacccaggttcagatatctttgttacagcagcacaaaacagactaagacatagagcaagggtacttcaaggcagtaagcatggaagaaga

SEQ ID NO: 180073 - DNA, 261 bp, Homo sapiens
acatttaagcataaagataaatgccgtctacattttcaagactatatatatgaaacttagctaattacaagaggctacgacaaaattaataatggaccaaacatatttatactaataaaaaagtttctcaaattttcaagtctatttgagtttagtttagagttcatgcacagacatgaatatgttttatttgatatcctactattgagacagaaaaactccaaccggcctgcccactgaggtgaagccttaggaagttcg

SEQ ID NO: 180074 - DNA, 117 bp, Homo sapiens
ctatctgagctcctatcaggcattcagtcaagaagttagcagataatgacgggaacaggacattatctgcaggaaaataaagcaaggtggaagcagctgctccgatgggagctcccc

SEQ ID NO: 180075 - DNA, 314 bp, Homo sapiens
taggcactacaaatacagtggtgaaaaagataaacttctaccctcagagagctcattcaatactggaggctttaagcaataggtaaacaaatgaataaggttcttttcagaagtaatgagaacttgtaacaaatatcgatgtctattttagactagtcaaaaagatttctttgaagaggggctatctcagcagaaatatatcatatgattctggaataaagtaagtacaaaggccctgaagcagggaaaaaagcttaatgtgtctgagaaacaagagggttagtgagtgtggttagaatgatgtaagaaaaagg

SEQ ID NO: 180076 - DNA, 135 bp, Homo sapiens
cacgttgacacttcagttaacaccaaattgcttgcatctgattaattcattacactcattctgcaagtattttctgagcataaattatatactagccactatgccagtaagcacagggaatcctgaagtgaacgt

SEQ ID NO: 180077 - DNA, 451 bp, Homo sapiens
catgtcattctggtcttggaggtacatccagaggtgatgtttttggggtggaaggctgatgctactaagtggtcctttgcaaggtggaatagaaatccagctagaggtaagaaacacaggcccagttctggaatcagaggtccagtcagacaggccaggatctgggtagggtgttgaaaggcagtgccaggggtgagaaacacaggcccagctctgaaatcagaggtccaatcagatgggccaggatctgggtggggtgttgagaggaagtgccagaggtaagaaccacagtcccagctctggaatcagagatccaatcagacgggccaggatctgggtagggtgttgagaggaagtgcggtgtaataggcagagggaaagcattggtgcctcaatttccagcccctcaaggctggtcacagaatgcattattgttctcagctactggccc

SEQ ID NO: 180078 - DNA, 756 bp, Homo sapiens
ttataaaactgttaacagagatacagtttttcaggtattccttttaaaaatggattggattctactgtcaaactagatgaacttgaagaataaaaactggaggtcaagcacatgggtagttttaccttccctatctactacttaagatctttcacagctggtaaaaatgtaagggaatataatactatttacgatcagaaattggtcccacgcctcaatttgacacagggagtctacacaaacacagccgttggcgggatcacggtgactgtttgactgccacctgctgggaaggggctccccggcggtgcctgtttgtgtacattgccagtggcagctaggatcacccactgttctgtcggcacttggcatagctttatatttagtgctgttaaaatggcatgaatgcagttgtctccttccctgaaggttgctaatttaactgagagtgcgggccacagagacctgcatttgtcatttaatgtgtctgtgacacacaagtgaatagaaagcatattcaactcttaataaaccttgaataaggcactgagaatgtttgagtattcaagtgagaagctgtacttgaaaagcaaacatttcctactttttgtttgcaaactgtgttgccatggtgacgcacagtatctagcgcatttgagaaattaaagtagaaaatcaaaggaattgttgttttgcattatctatctgcacagaaagatttgtctttaatcatttcagcgaaactcgctgccccat

SEQ ID NO: 180079 - DNA, 301 bp, Homo sapiens
acatattaatacacttctgtttttcttctgttaatttgtcttttgttacagggagcctcagataagagttatgaaggacagagaaaattattactttttccttctctacactaccttgtttttcttggtgtttttttttgttttgttttgttttctttttttttgagatggagtcttactctgtcacccaggctggagtgcagtgacacaatctcagctcactgcaacctccacctcctgggttcaagtgattctcctgcctcagcctcccaaggagctgggaccacaggtgtgcatcacc

SEQ ID NO: 180080 - DNA, 196 bp, Homo sapiens
tgtggtgatggttacaaaactatacgtttactacaaatcattgaatcgtatacctaaaatcggaggacttttatgcctcaataaagctgtttgaattttcgggttttttttttttttttttgagatggagtttcactcttgtcgcccaggctgatgttacattttctagaagttctcagtgatgggcatttaaagg

SEQ ID NO: 180081 - DNA, 358 bp, Homo sapiens
tggctcaagctacatacactgtttgtaccttaattttttttcctttcactaaacagtatgttgtggatggcattccatgactagaggcataggtgtacatcattggattaatggttgcacagtatttcattgcatagatgtaccttaattttaattattttcaacttttagattcagtgggtacatacgcacgtttgttacctggtatactgtgtgatgctgaggtttgggtatgaatgattctatcacccaagtactgaacatagtacctaacaattagtttttcaacccttgtccctcatcccctctagcagtctccagtgtctacagtcatctttgtgtccatgagtacccactg

SEQ ID NO: 180082 - DNA, 359 bp, Homo sapiens
tgccttagtccgttaggggtaccatagcaaaataccataaactgagtagcttataacaaacacttaattttcacagttctggagggtgggaagttcctcaaggtgccaacagattcagtgtctggtgagggcctactccctggttcacagaaggcatcttctccctgtgtcctcgcatggtggaaagagacaaatctggactcttaactcccttataagggcattcatctcattcacttgggctctatcttcatgactaaatcatatcccaaagttcccacctcctaacagcattgtattggggattaagtttcagcatatgaatctggggagaatacagatcttcagttcacaacccc

SEQ ID NO: 180083 - DNA, 111 bp, Homo sapiens
ccccttgttcagataagttgtgctgcaaatggctccattcctcctgttttgtactagtgacaggaaagttcgtctagagataaaatgtcacaaatctgtccacctcctcta

SEQ ID NO: 180084 - DNA, 240 bp, Homo sapiens
tggcattgtctaaataatgctgagaccccaccaggggaagaggatttctataaccctcattgagaagcagacggattcatgagactgctaacccaagatcaagtggaacaaaaattaatgactaggcccagatgaactactgaaggaggactgcggcttttgtttacagtattgttgctattttaacactctatattctggatacataaggaaccctttctcttctccctctgcctgtat

SEQ ID NO: 180085 - DNA, 342 bp, Homo sapiens
cctgccttggcctctcaaagtgctaagattactggcgtgagccaccgctcccggccgatgttttatttttaaaagtaaaggaaaaaggtggcattctttcagaagaagatattgctagttttagagcaacatcttagaagggtgtcctgattgtttttagcaaatggaaaaagatctgggtagtcttggagaagaaactgttgccttttgcttttcctttaagaatatgtctctgtagtttgggagaaatagcaaaagaaccacaaagatttctcagatatttggggatatgtagtttcagtccactcaagaatctgactttaggcctcaatccgtcaccag

SEQ ID NO: 180086 - DNA, 785 bp, Homo sapiens
gcctcctgagtagccgggacacaggacacttcagagccaaagaggaaacgaatcccatctgttctgagcccccaagcacagttcaagaggacaggctggggagtggaggaaggggcggtgaagagaaaaataagaagactggaacatccagccacacacggagggcaggaagccacctgatgagagagccagggtgtggcagaagtcgccaaggaatccttctgttcccgacacactcctacagcactcgctcaagatggagcctgctgactctgtctaaggccctgtggcccttggcataggttgcaggacagcagtcctgtcagggctgtggacctcacacctctatgtaatgtgaagggcaccctctggagttgtgggacttggcagtagtgttactgcactggcctgcaagtccccatccattactgccacccagctcagacacagctcacccattcacatacacaaaaatggacacattgagagggaaacccacattaaagtagggagaagatggagggccctctgacctcctcccatcaggcacgtgtgcctcctctactcagtgcctgcatccaacctctgtatgggtacccatcctctattcccctcccactccaatggatgccagggatggaaggacagatggctgtgaaacttatcttcttatttagattaaattccagactttcctatttttagaaaaacaaattccttttgtatttccaagtggtaaaaatggcccgagctgtcatctaggacagtcagcagccaactcaaag

SEQ ID NO: 180087 - DNA, 304 bp, Homo sapiens
tatctcacataattatagtacatctattaaaactaagaacactggtacaaaactataaaccatagattttattagatttcaccagtttttccattaatgtcctttttcgattccagaatatcattttacgtttagaatgcacacactattttaattctcaaatatcctagtacttaatatcataaaatgttacatttctattttctaattgttatctaaaaatcattctgcattctgaccctcagagagaaaacacatatacacacatacacacatacacacacacacacacatatacacaaag

SEQ ID NO: 180088 - DNA, 753 bp, Homo sapiens
attatcccaccaagacagaaattaatcactactaatatttccattcatggccatccagggtctcttctatatataagtgtcttagttcatttaccaaacaggattttaaatactgcagaacaagcgggaagtagcatactagttctttggaagactaattttcttcattgtaaagttacacttactgctgagtaagtcaaccatatgtacaagaaactggagagaatgacaaaggtgaggggaatcatacctgctctttttcattcactcacagcaaaccatggagtccatgttttgggaaccattatgtacgcaaagaccaactaatgagtatgtttcctttataaatagcagcctactaaataaacaaatacatacatacaaatatacagtcttgccacaggagttacacacacagtgaaaggaatgacattaagagtattttttttgtcaccatgaaagtatcttaagagaaagtaaagggatatgtgaaaggttgatctaaaattcaagacctcttccacgaaaatattttctgtgcacataagatgaaggaacaatctcactacggaaaatatacctgttggttttacaatgctataacttatttacatgtgtaaataaatatgcaggagtttaaatagtccacaaatattgacagcttactctgtaccaggcaatgtattaactgctagggagtaagggagagaacagccaccagtccctattctgcagaactttcagtctacctct

SEQ ID NO: 180089 - DNA, 265 bp, Homo sapiens
aaaccaggaataatttcagttctcaccagccaaattggaagaccccatagataacaggcattaggtagagcaggggtccccaacctccaggggcactgaccagtactgttcatggcctgttaggaactgggctgcacagcaggaggtgagcggcaggctagccagcaaaccttcatctgtatttatagctcccatcacttgcattactccccatcactccccatcacttgcattaccacctgagctccacctcctctcagatcag

SEQ ID NO: 180090 - DNA, 561 bp, Homo sapiens
tgaggaaggaatttgtctcagtccacttccacacctgtccacctgagctgggcgttagcctgagcctttgcctctgtatggatccctgactttgagttttatgcaatttcttgtataaaaggagagcctgagtccatggaagttgggattgaacatcctgaatatgcagttccttggagagccaccaagaaaagacctaagcaagagacatgatgtcaccttcggggaggaggctcttcaagctgtttggcatgagaagaggaggaatgaggaggatcactggccttgaacccccaaagagaggctagagcacctttctaggacccagtccagggtttgtcttgaacatccagctccaaaagagatgctgtgcagattcaagctgccaagtcctgaaggacctgagggaaaacccaaccccaagcagcccagatggtatctgagtatcctgtgccctacccacgaagatcaggagcctaaaggctagagctcactgcagaaccagaccaaagacagtttaagggccattgagccaagccttcctgacctcccatggagagg

SEQ ID NO: 180091 - DNA, 871 bp, Homo sapiens
ggaatgagagaggatagtcaatttcccaccaagatcaaaggcttacttgatctttgaagagaggttccctctgaatggagcttgctggtgaagctcctgccttctgttctgcttctgagcgcactgactggctcaggtggctctgggacaacaggtgggatgccagcttacagggaccaagtcccagctgtggtgctggagctgctcagtggcaactctccgtctctgctgctttcacgcagcactgacgaagagcaggcatccgcctttccactggctctcctggatgactaagccctaagccccaaccgcatactcagcccttcactggcacttggcataattttatctcctctaaatcatcacagccaccctccatgatagcaatttctattctcaattaagtgaaaaggaaaccgaagtttaggagtggtaagtgacttacccaaaatcgtatagggaggaaatgcagacccaggatttgaactcgagtcttctttccttccaaactcatcccctcaacctgtttatttccttttctctatgaccatgtctgaagaaatctgccttggggttgtctcatattggactcactctcttggtctgtcagtgagctgaacttctcatccaatcaaatccaagcttatttcccaagtaatatctctagtgtattctatttgtaatgatcacacaggcaagggccacacatatcactggcatcctacagtacaattaatcaagtcaaattagattcctggcatctcatattctgactgaatgctaatggtagtagatgtaaaaatgactccagtgcaaggcaaggagggaggggactggatgtagggctgaatggcgaatcagtaagccttgc

SEQ ID NO: 180092 - DNA, 468 bp, Homo sapiens
ctcaggattcagggtggtggaaggtgatgagagggagaaaattggctgccagggcagtgataaaacagagctgggagctggcagtgtctcctctggctgtgaaggatggtgctgatgcacttgacacagagatccggagcaagggagtacaacaaagagtagaaaccaggaaatcaaaacacattcaaggcagacagattccaaaggtatcatgcctctgtctatgctaagtgcatgctttattcattttttaaaatcctacacaaactgaaagagacatcacagtctactgagccgtggaattaggcaggacaggtgcttttatatgaatttgtattaaacctactgcttaaatgtaatccatggtggttactgttatcttcacttataatgaaggcatatcatagaaatctctgcacattctcacttagctctcctgatttcccgttctccttgggcccacgcttc

SEQ ID NO: 180093 - DNA, 517 bp, Homo sapiens
ttgacacatcctgaccagaggcaagccaaacacttaggagactgttgcagtgtcaggagagagacactagtggcatgggccacttatgacagtaggacagcagcaatggaagtagacttgacagaacttaaatgattgtttggatgacagggtgggaggggagagaggttggaatgacatgcagattcctggtttaagattgtgatgtgatgtaggagacccaggagaacagcgagtttgggcgagaaagatattgccttcaggttgaaacatacggagtgtgagatgcctgtggaatgtccctacatcacacacagcacactgcagctgtgactacagatgagcagtagagggaggagccctggggaacagcaggatttcagaggcggccagaggaagaggaagctctaagggaggctgtaagtatgttttattttctagcagacttgtcaaagcaaaaggtaagctctagggtcaatagtgtggagagattgacaagggtaagcagagggtaggt

SEQ ID NO: 180094 - DNA, 999 bp, Homo sapiens
tacagttcaccccagaaagcaacaaaaaaatcacactacataatacctttctactgtcagaatctccctgatgcccatgccccaaagacagaacagctgagaactccttcagcttaagagaaaaccaaatgtcttcagcaccttatagttgctgtgtataggaaaacatgggcagaagaggactgcaggaagagaaaaaaatagctaagaccaatggtgtactcttcagtaatactccacttgcatgcagcagcttacgtggagagaatggctgatgtattgggcattgtgagaaaaaaaaaaactgacgtttatactttcctcaaattttggcagatttccccaaatataaacaatggagacaatttattcacacaatcatttcctagaacttcataaaataatgaagtaacaccgtaatggtgaaggttgtggtgaggaaaagaaggttggggaagaaaggaatgcttctttttattttctacccactcgacctcaccaaattactagggctcaattgagtccttagcaaacaaaacaatcaaaaatgtattttatgcaaatgaagctctttttagaccaagtacctcccaactgcagtgcttcccgcagcactccaagaagagtaattccaggataagcagatttctctaaagtctcagtggcaactagtgcccaactttgcaaggtttgatttaacgctcaagaatggcaaatgaggccgggcgcagtggttcacgcctgtaatcccagcactttgggaggctgaggcgggcggatcacgaggtcaggagtttgagaccagcctcaccaatgtggtgaaaccctgtctctagtaaaaatacaaaaattagctgggcatggtggtgcatgcctgtaatcccagctactcggaaggctgaggcaggagaatcacttgaatccgggaggcagaggttgcagtgagccgagattgtgccacagcactccagcctgggcaatagagtgagactccatctc

SEQ ID NO: 180095 - DNA, 689 bp, Homo sapiens
attgtggaatatttatactgcaatgaaaattttaaaaacacacacacaaaaaaaagtacaacaaatttaatgttgaaaaaaaaagaagccagacatttaaaagtacatacttattccatttatacaagtaagaaaatgggcaaaacacacctatgggtgttagaagtcagtgactgccaggggatgagatggtcttcaaagatgctggtaatattctatctcctgatctggctgtttgggtgtgttcactttgagaaactgcatcaagtgggacatttataatgtgcaccttcgatctctgtatgctatgctccaatgaaacacactccctaccaatccagggctgctaagggcagggtatgttttccataattattcctccatttactacagccctcgaccaacagccctgacaaggctaaactcaccatacttcagcatttatgcacacacaagttctgtcttgtctgaactctccaccttgattgtacaggccagcaccttcctgttggcctgttggcagtgtctgtacccataaaattgggtaaaacgacagaagttgcccatgtatgccaggaagagttgaggcaaactgaagtgacctgaccaccagaaagattcagagacatggccctggatcacaagaaggacaatgcctctggaagcccagctcgccagaactgctctgg

SEQ ID NO: 180096 - DNA, 438 bp, Homo sapiens
tcactctgtctcctaggctgaagtgcagtggtgcgatcatggtttactgcagcctcgacctccccagctcaggcgatcctcccacccctcactcccactgcccttcccagtagctggactatagggtccaagccgccactctggctaatttgtgtattttttgtagaaacagggtttcgccatgttgcccaggctggtctcaaattcttgggctcaagctgtctgcctgccttggcctcccagagtgttgggattacaggtgtgagccaccatgccctgctcagatagtctttcaaccagaaaaaaatacctactttcaaaggtgtgctttcttaaagatcctcagtgcataagggaaatgtcagaatcatccagtgcttttcccagacttcttgacagttacagttcaggagttaatggtactctgtgtgacctaaa

SEQ ID NO: 180097 - DNA, 341 bp, Homo sapiens
acaacatgatgtcatttttataagatatacacacacacacacactatacatatatgtatatcatacatatgttgtagaactatttaaaacacacaacacggtcatacaattaccttgggcagggagttggaaaataaaggcaatagaacacatgcaccttcaatgctactgataattttccatgattggctagatctgggaacagtgtgggaattagacagattgcaagaattggagcagtgacaggagaaaaaatgcagtttgaccagttaggtctaaactccaaatcacgggtgttcatgttattatttactttacatacacgttgtacgtactcttaa

SEQ ID NO: 180098 - DNA, 375 bp, Homo sapiens
attcctataacttttactcttgttaatatttctagttagtgactgatgcagttctacctttgtttcaaggttcatttcagatactgcctctcttccctttaccccataacaaaaggagggtcttctctttgaattctggagtactttgtacctctctttatgacatttaacttattttactttcttttataattacctgtgattgtcttatttccctcctactaggctgtaatttgcttgagggagaaagtatgttgctggcattatgtgttttacatttttataagtttattgtaagtgttttcccttttatttcttacatttattgaatttaggaagctccattttcacgaatctatggcacgcaaataggtg

SEQ ID NO: 180099 - DNA, 141 bp, Homo sapiens
cttaattcttccagctgctcatgacaaaaatcctgtagtcatcttttttttccacctctttttcttttaccccatattcaacgtggcagcaaaccctagtgggtctatcttccacacagacacagactcagacagcctact

SEQ ID NO: 180100 - DNA, 375 bp, Homo sapiens
tatacctgactcctgaataaactataaactttataataatatcaagtagcccttgtggagaagaaagggacttctacgtaaatataaatatttctcaactttcttaatatgatactaaacataccatttcctcaattgattttgcatcaagaagcaaaacatggccaggcacggtggctcaaacctgtaatcctagaactctgggaggccaaggcggatggatcacctgaggtcaggagtttgagaccagcctggccaacatggtgaaaccccgtctctaccaaaaacacaaaaattagccggacatggtggaaaatgcctctaatcacagctacctgagaggccgaggcaagagaatcgcctgaacctgtgagg

SEQ ID NO: 180101 - DNA, 756 bp, Homo sapiens
agactcggctattgttacaggaacgtactcctaaattaggttttcaatcttgtctacctgttaagttaggttacagttcatccacaaggactcaaatatagaagtacggagtccttctcaggctatcttcagttctctttaacagtatgatacgggataatcttcagtaaataaaaatttctttaagtttgttggattaactaaagcaggcatgtcttcagagttgtcaacattaaatataatacatacatacagtttttttctaccaggggttactaggcaaataagtttgttattgtaactagatgtttaagattataaaactgtcagtttaatctaagagcaaaagtgaaaatgtggtagctattttattaagtacagcggtaaagcaagtatatattaagtatagcagtaaagcaaaaaaacaaaaaaaaacaagtatttaacttttttttggtttttttttttgagacggagtctctctctgttgcccaggctggaatgcagtggcacaatctcagctcactgcaacctccacctcccgggttcaagcgattctcctacctcagcctcctgagtagctgggattacaggcgtgcaccaccatgcccggctaatttttgtatttttagtagagatggtgtttcaccatgttggtcaggctggtctcgagctcctgacctcatgatctgctcgcctcggcctcccaaagtgctgggattacaggcatgagccaccaagcccggccttaacttt

SEQ ID NO: 180102 - DNA, 420 bp, Homo sapiens
gcctcagggaactgaaggtttagtgtgattggaacaaaaaccaaatgataatggattttataggccttgtgtaggtattctctagatggaagcaatgtgtactatagccataacatattcatgtttcatttcacgctatcactttgactgcactttggaaagtggtttggccttatacgtctggaagcaagaacaatcacttaagaaagctgttgcagtaaatctaaataggatgactatagctagaaccaaggaatgggcacaggtagtggaaagacagattaattatatcataaggatgtagacttgttagaccttgatggttgaatgtgttgtgagatacatccctgcctccaccccctactgtaaggtttctgcttaagcaactggatgaatgatttgttggttaggatagtctaa

SEQ ID NO: 180103 - DNA, 2264 bp, Homo sapiens
  misc_feature (2190)..(2190): n is a, c, g, or t
  misc_feature (2232)..(2232): n is a, c, g, or t
  misc_feature (2236)..(2236): n is a, c, g, or t
  misc_feature (2263)..(2263): n is a, c, g, or t
catacaatatggagtgattgtgatggtgggacccctcttagctaattgctctgtggcgccatccgtctggaatgcagaggggtcttgcttactgcctatgctgccttcatgatatgctctctcgttaattcagactgtaaatttcaggctgaaacagactgcctgtgcatgttgccttaataagtcaaatgcagctaatctcaaatttgccctctctcgaagtgtacattaaacaatttagggtgtgcctaaattcacaactgcaaccagcttgcacatccttaagtgggccatacatattcaagcctctggggctttgttatagagtgccactcatttccccttttctgcttgtcagaatcctcattggccttcaagaccaacatgaaacgcctctgcgatgaagctataggagttagcagtggctacctgtcttcgctgtgctcagagcatgccaagggtttctttcccagcattccgatcatgcttccccgtggcctggttaattgtgtgctaggctgtattcctcaacaggctcctaaagactaagaattacatttaattcatttttgtgcccttcacagacccaggagagaggtctgaattctcccaggctgataagatggggagcatccactgagataaagcaagcatcatgtggtgtggtggctggaagagtgtaggatactgccagagagagaaagttgagttatactgtgaaaggcccaaatgtcagctcaggaatcggaactttaccctacagaaaagggagaaattgttaacggttggctaaatgctacatttccaaaaacccactcaggaagctctgtttctatcccagatccactcactgttagctaggcagcctgaggttggctgtttgtgtctcactttcttcatctatgccaggcagacactagtagttccccctcccaaggacaccgtgaggatccacagagttagttcatggaaagtggggagggtgcctggcccataatcgtgagctcccattaaatgccagccacttttacccagcggaacattgccatcctccccacttcctctgcatattggagggaggaaagaaagaggttgcttttgctttgacagcatcttcccccttctgggttcaggatgcttgacctcacacactggggcaactttgttggcattctcttgcatatgggctcttgaactgagcaagcaaagtgcatttcaaggagaaatgggtccacagggctttggttatcacagctggcccacgagaagcagtggggcatgaggcaaaaatggctgctcaggagaggcaggtccaagctcagatttgcaccttgtgaggccttgggcaaggtcagctacccctcagaacttggggtccccatttatgggaggtgggtgaatatgggctcctagcaggtgattattaaacacaatcgttcatgtagtgcgttcagcatagcctgtcacatagcagatgcaaaataaatgataacacatattacttgtgatatccgaaaacttagcagccaggtaaaaacgaaagaggaagggagtcctggaaacagccaacttatattggttatgagaaaaggttggttgtggtatttggcttttaataacaaccatcggagggggtgtggagaccataagttttgcatagacaaaagcaaacatgagaaggatgctgtcctagcaaagcttctagggaccatgaggccatgaggctaccaggccagaaataccgaaatctaactgccgctgcttgaccatggggaatatctcaccccagtgcagcactggcgccttcccgcagtatgttcctggtcatcgaaccactcaatggattacagtcatctgttcacctctgtgaataactgaaaagggtaaaaaccggaactgtttcctatgccccttgagaatctccaagtgggagccacatggccacttttatctccactggattcactctaaagacacagatgggccaggcatggtgggtcatgcctgtaattccagcactttgggaggctgaggtgggcggatcgcctgaggtcaggagttcgaggctagtctgaccaacatggtgaaaccctgtctgcactaaaaatacaaaatttagccaggtgtggtggtgggcgcctgtaatcccaactattcggaaggctgaggcaggggaatcacttgaacccnggaggcagaggttgcagtgagctgagatagtgctgctgtacnccancttgtggcagagcaagactccatctcnc

SEQ ID NO: 180104 - DNA, 202 bp, Homo sapiens
  misc_feature (18)..(18): n is a, c, g, or t
ctctagaggatcctcagntgttcatgtataccttttgaataaaagggggaaaataggaaaatataaatgtatctgctcatatgtgcaaaataaccccacaaagtagaaatgggagtccattgagactggttacacatgggagaggtgtgaccaagatggaaagtacaggaatggaggatgtggtgtggggtggcacttctga

SEQ ID NO: 180105 - DNA, 320 bp, Homo sapiens
ccagtggggagagcaagcccagaggtgagcctagagccaagtgaggcccaaggacgggtgctgccagccgggaaatgtccagctggcaaagtgacattgaaagaatcctgtctcaataggattattactgaaaaataaattattctctagaaagattctaatacatcaggaaaacttggggggaattctctttagacgtgaacacttatgaacatatccccaacctccttaattttcttattttagtaatatgagttcttatattatgttttctctgtgacaagcacctcacctcccaacccaccccctatactcccaca

SEQ ID NO: 180106 - DNA, 426 bp, Homo sapiens
tggagaatattccctgagcaatttaaaggctagtttctgggtttgcagaaaaaggcaaggttcactgtgaacggagtcttggaggttgcctacaatggtcatgggtggacgagtttgttggaaaagcccccgtgactgggctctcggtagagtggcagggcgtgtgtgttggaatggaagatggaaagttaaaccttgggctcagtgggcgtctaatcaagagagaagtttcctgtgcgtcaggcccagacctaggaaacggggaaggtctccgtgtttccagcctcagcctcaaatgaatgggcaccaggatgggccgcagtgacttctccggggtctctctgatgtccaaagctctccccacacccagatatttttgtttcacaggaaagtcaggagcctcctgaaaacagacatgaatgtagc

SEQ ID NO: 180107 - DNA, 194 bp, Homo sapiens
gtccattcctaaccatcagttcaagaatgcctacatgtagattgacaggctagccctctttctatgtgagtgcaaccagaacacatacatatgatgctggagaaaataacattgatcttaggtcagtagccttcggttcaagtcccagcctttttctaaccaactgtgataacctgggtcgttagtctacctgc

SEQ ID NO: 180108 - DNA, 302 bp, Homo sapiens
agaggatagctcgaatcgacggtttctctggctgtattccaaatcgaacgaaggacttaaggatttagtttactaactgattgaatatgcatctttaatatgaattccatgtgtctctgaaatatgtgagttacactgtgaaaaaagggtagacgataagccaagcaggtcaggagaaataagtaaaggtaggaatgtgtgaaggtaatttacaggctgcaaaactcagttgattggatgcttgtatgcagagtcctgagagataattaaggcaggaatactgggaagagaaggatgctctg

SEQ ID NO: 180109 - DNA, 535 bp, Homo sapiens
taaaactcttttcctattttagaccatattgttgttcatgacattcttgcatttctctgtattgctacccacttcaccctttgcttttgtggcagggcttctcagcctcggcactcttgacattctttgttgtgggtgtgtgcgttgtgcaatgtggtgtgtttggtagcacccctccttcatttgtgacaacaacaaccaaaaatgtctctagacatttccctatgtcccctagggaggcagggggcggaggcgggggcaaaattgcccctagttgagaacctttgttccatggtacctatggattttccccatcatcctgtgggacaaggtgtgatacagctcttaaataccagcaaccaccaaagaaaccattcctgacccgggcagaagttgtggctcagcatactacagtgagctgtgcataggcattaatgaaaaggtagggggatacaaaactcagactggagtcactaaggaggcactttccttcctctctttctgtctttctactggaaaagtgttatgaacatat

SEQ ID NO: 180110 - DNA, 323 bp, Homo sapiens
tatgcccctctgctgcccctgggccctgtgcggtcacaggctggaatccagttgagcgacgcctatttgtggcttttttcttccaggaacatatcgttaagccacttgcagcctcgtttggaatgacatcaaaggaaaatgaatgaaggaaacatgtacattcatactcgtttcttttgccgtcttattgcaacctgtagaagctagttcttctattttattcatttgttttcagacttttgttgcaaactttacatttccacttaggagatattcacgaggatggtatgcaaaagtagctttctgagatcagacatgtaagg

SEQ ID NO: 180111 - DNA, 305 bp, Homo sapiens
atctctgaatggccttaacggccgcatgatgtctctgttaacttcccacggctaggcactgaagttatttgttgttattactgccatggtgatctttatatccacattttagtgtaggattctgattatttctctagggtcagctcctgtgaagagaattgctgggccctttaagattcttggcaaagactgtcaacatgcttcccagaaaaacatgtattgacgccagctgtgtatgagtatgcctgtcaggcctcaccctccttggtacggggtattgtcattttagttgctaatttgattgc

SEQ ID NO: 180112 - DNA, 693 bp, Homo sapiens
ttttcttctttttaaaaacagggtctcactctgtcacctggcgtacagtggcatgatcatagctcactgcaaccttgaactcctgggctcagataatcctcctgcctttgcctcccataatgctaggattggcatgagctgccgctcccagccaactattacaatttttatcatcatcagcatcatctgtttatttaatgctcaaagtgtgaaataaatggcttcaaaaaaagtgtaagagatgggaactctcaccctattctataactaaggagaatgagcatgaagggctcaaatacttgtgtaagacacacaacaattcagtgttggagccaagagtcagacttggatgtgctggacctaaagctcagtttctttccactgtgtcacgttcatctctcttggtaccttgcgtccttgaaaatgatggatgtgggaagcagccacaggcaggtgggaagggcacaaaccgtggagttggagcacctggattccagctcctacttgctaactgcatgacctgggacacataacttctgctctctggacctcagtttttctgtgtaagatggataataatacccacatctgagggttgttgtgtcctcacaacagtaaagctatcacagagcatattctgtgtcttgtcatagacaatctattaggtggttctaaatctccttcctggctggg

SEQ ID NO: 180113 - DNA, 637 bp, Homo sapiens
tgaaaaaactttcctgatgtcatatggctggtgagaagtagacttgagatttgattctaggactactcagcttcaagctaatgataacagtagtaatatatcagctaaaatttatgaaacatttcctctgtgtggggcattttgctgaaggtttcattgatgattacataaaactcttaaaacaatgctatgaagcaaacactgttactgcaattttcagttgaggaatcagaggctcagagaagttaagaatcttgtgcaagaaatttataactgttaagtcttacattaaaaaagaagaaacatctcaaatcaacaacctaatttgcaacttcatggtacaggagaaaaacaagctaaacccaaatatattgaatgaaggaagtaataaggattagagtggatataaatgaaatggagaatggacaaacaatagaggaaatcaatgaaaccaaaagttggttcttcaaaataagatcaacaaaattgccaaccattaactagactgactaagaaaaaaagagacaagatggaaattactaaaatcagaaatgaaaatggactcccagcatggtggcttacaccttcaatcccagcactttgggaaggcaaattgggaggattgcttgaggcctgg

SEQ ID NO: 180114 - DNA, 278 bp, Homo sapiens
atttattgttgtagatgaaaagtctgatgcctatctgattcttagttctttctgatagttagtatgattttctgtgtaactgtaaagtgtgggggttttacttcttttttttttttttgagacaagaatctcgctctgtcagccaggctggagtgcagtggtgcgatcttggatcactgcaacctccacctctcaggttcaaatgatactcccgcctcagcctcctgagtagctgggactacaggcatgtaccaccatgcccaactaaattttgtatt

SEQ ID NO: 180115 - DNA, 405 bp, Homo sapiens
tgagattagacagtttctactggtctgccttctagttcaatgattctttctccaacatctcaaaactaatgtcagtcctatctagataatgcttttctttttagtcattgtgctttgttttttttttttaaccaactctaaaatttccatttgattatttcatggttcttatttctcttacgagatttcctatttgttcacggatttttagcacacaatactacaattctttgtttttctttaatttttcaacatatgtataatagctgctttgaagtcattgctatatctaatgtctgggcatactaagacattcagattccttcctattggccctttttccgcctctgttattggtgatcattttctctcattacacatctagtaataatttgtgaaaaacta

SEQ ID NO: 180116 - DNA, 246 bp, Homo sapiens
tggatggcaaacctaactcagaatagggatttgggtgccaggaagacaaaagcaggaggtgaaagtaagttgttcagcattccatttccttaggattactctaaatggctaaactacaagttgaagtatgaaatgcatcagaatcaaggtctccaggttggtgtagccctggccagctcaacatgaaatgagagccatgggcaacagcctacagcaccacatacagctgggtggagagtgacttca

SEQ ID NO: 180117 - DNA, 836 bp, Homo sapiens
ccatatttccttccctctatctttccttatcttagccagctttaagttccaactcaaatgccttctctggaaagacttatctgactattacagcccatgctgatcttctccctgctgatcgtgtcctcttagtcccatgctgatcttgtcctcttagttagcagcctctgctttggtcctgcattagtccatttgcattactataaaggaatacctgagggtgggtaatttataaagaaaggaggtttgactggcttacagttctgcagagtgtacaggaaacatggtgccagaatctgcttctggtgagggcctcggaaagcttacaatcatgcgggaagccggaggagtagcccgcgcatcacacaatgagagagggagcaagggttggggggaggtgccacacacttttaaacaaccagatctcacgagaactcactcactatctggaggacagctccaagccattcatgagggatccacccccatgacccaaacacctcccactgggccccaccaccaacattggggatggcaattcaatatgagatttggaggggacaagcatccaaactataacaggtaccaaatcactctcgaattccaagttgcttactccactccttcctcctggcctgtaagactcagggatgggaaccatgctatcatgagtcagaaaataacaagagacttgggttccaaacctagttgtatcatgtatcagttttgtgaccttggccaaggaatagacttcttggagcccctgtttgctcatctgcaataccctatcagtagtgcttcagggaaattaaataacgtgtgaatctttaagaagc

SEQ ID NO: 180118 - DNA, 779 bp, Homo sapiens
aactatatattattgttagtataacctgatcatattcctttttaggcattgataacacacagtctatcttagctggtgacaatgtatatgattcatatataaatagacagatcttggggatgcttttctaacagatcaaaaggcatgaagatatgtaaagagcatgccctggtgatggatgataagggaggaaagcagatggaagggtgtcaccaagagccaggcaagagatgctcatgttctgcactagggtaacagcagtaagggcgagaggacctggagatctgggcggagctggatcaaggggatttgtttgagcttggagaaggaatcaagggagagtctgaattcagtcacaagtttagggcagtgaatggacatgagagggtccaattatagaaggtgttggtgtttgggtggatttgaagggtaagaaagaaaggggaaatttgtataattcctagttttctctctagaagactggatggatgacatgtaattcaccaagaaagaaaaggaaagagtgaagtagggagcaagttcaacagagagagttttggacctgctgtctttgaaggactcatgcatttacttggaggtctcaagcaggaaagtggacgtagtgtctgcagcaggaagaagtgcaggtgggccatattgactctacagcgaagaccacagtcatcaatgaagttgctcgtggaggatgtagagtaagaagagaagaggaccaagcactgaatcacgtggagacaagcacacgtaaaagaaaagaaggg

SEQ ID NO: 180119 - DNA, 617 bp, Homo sapiens
gccaacattaattcaagtccagtttagaaactaacttttctttatgtcccttcaccatccccaatttataccatattgtcttacttttttctttttttgagacagaccctcacccagttgcccaggctggagtgcagtggcgtgacttcagctcactgcaacctctacctcccaggcccaagcgatcctcccacctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtcaggctggtcttgaactcttgaccatgcccagctaaattttgtatttttagtagagatggggttttaccatgttggccaggatg

SEQ ID NO: 180120 - DNA, 900 bp, Homo sapiens
ttccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagcattaaaaactctcccctatccagtgaaagagataagaatgccagttgtgagaaaattgaaggggaaacggagaatgtcagtgttaaagatatttgaactttttttttttatccatttgaaaggtattttttttgggtgaactatttgttaatattcttggtcctgtaaaaaaaaaattggtgtttggactttttcttattgtagacactcttcataaattaaggaaattc

SEQ ID NO: 180121 - DNA, 363 bp, Homo sapiens
atcagggacccaggctctttccacttggaacacaagatagcaggggcctttgtcaccagcaggatggaagctgacacacaggacaccccttccaggaagctttgtcacatcgacttcacctaactccaatgacctctcccttctgagtccctctgcacttagaggctctttctgtttggactgagtggtggttttggaaaggctcttgtgtgattttcactggcgtggactcttccccagatgctcactttgtactaacaccgctggctcattatcacagagtcatggagcaggcactgagactcagagagctctgtggctgcgcaaggtcagggtaaaggtgggacttcagcctcaccagac

SEQ ID NO: 180122 - DNA, 338 bp, Homo sapiens
tcagcaaactttttctgtaaagagtgagatagtaaatattttgggtttatggatcataaggtctcttgcaactaactcaattccaatgttgtgaggtgaaagcagccatagaaataagtaaacaagtaggcatggctgtgttcccaaaaacctttctttacaaaaacaggcatcaggctggatttgtctcaggggctgtactttgctgacccctggcctaagccaatgggaccaatgtagttccattttcttgccagaaactggttgaaacataggcatatgatacaaccatggccaatgtgagatgaaggcagatgtgtgagcagcttctgggaaag

SEQ ID NO: 180123 - DNA, 247 bp, Homo sapiens
ccagctatgtgactttttgggcaaattacttccctattatgcctccgttttgatgtgtatcaaatgtgaataataagagtatctgcctcctatgatgaatatgagaactactgaatacatcggaaacactctgtgcagttcctggcgtgtagttctatatgtacacgtgttcattataacgtgggagtacatgcagcgtttctttttgaactccataggcatgtctctctttttttttttttttttt

SEQ ID NO: 180124 - DNA, 241 bp, Homo sapiens
tcttagcccctatttctccttctgtaatatggaactaataatcatagtgttattagggttatattgaagattcaaagaaataaagcatgctgaacacttagctccatgccagagctataggaagcacagccagcttcagcccccactcaaccgcgtggacttgactttcccttccctcctcagtcatatcactgtccacccactccttgcaaatatgatggcatatttttgaacatttgag

SEQ ID NO: 180125 - DNA, 399 bp, Homo sapiens
cgcacgaagtgctgaaggctggcgccaagccggacagattgggattcatcacgccctacgagggccggcgctcctacctggtgcagctacatgtcagcttcagcgtgctccctggacaccaagctctaccaggaggtggagattgccagtgtggacgccgtttcagggacgcggagaaggatttgatcatcctgtccggtgtgcgggccaacgagcacctagagccgaggtcgtgcgcagcttggagtgaatgtgtcccagttgttttcagaaaagagcagactaggtagagagacaaggagaacattgagaatgtgaaagatggtgtttacgtttggtgtttgttatttccagctctaggctggaagtttaattgccattgatccaagactgccaaga

SEQ ID NO: 180126 - DNA, 541 bp, Homo sapiens
tgtgtggagaaattctgatgcacataatttcctgagtcctttcttttaatccccagagaaaaacatggcataccccctccatttgaatctgcacataaagagaaaaggcaagtttcaaatccaaaaggggccattaaaggatttcactgggtactggaactgcatccaacaatggttagacattttacaaattctacttatttcttcaattaaagtaaaaaacgcttgaacagagatgcagaggtcatccactgaagtttggggtgcaacatcatctgccatcatgtgctggattatctagactagcaaagcacgggggagtatacgttcgtggggactggcatataagaactttgaaaaccagctgatgactgcagacgaagcctggctgaaaaactggtcagggttcgtgatgacaccaaacgtaaaaaacaaaaacaagcatggactcagggtcgcttcgcttcctctccactgttctgtaggtggtggcttgtcagcaacaactagtttctagaaagagagttttattgaaaatact

SEQ ID NO: 180127 - DNA, 432 bp, Homo sapiens
gaaagagttttggatctgtgtatcttaagcagaacataaataattttttttgtagacctaatgctgaaaaaagctatttggaaagcttctttatggctcgaaaagggtgccttataaatagctttacaaaaattgctttcttattttcatttactataattgttctaatcaaagcttaggggaaaaatgtgattactgaatttaaagttggtaattaaatgagtatacataagaaatgtaaattaaaagcgataatattttaagactagaaattaaaacattagtattgtagtaacaagtttctattttcaaggacattctataatctaaaatttcattttacagtgtgtgaataacaacaacgcttgaaatgattatttgaaggcaatgaaagatcaaaaaactttaatctgaataaaaattgaaagcata

SEQ ID NO: 180128 - DNA, 300 bp, Homo sapiens
gtgtaaagtgcctaacagtggttagctagctatcactaataaatggtagctatcgtgagtttattgagaaaaaatttaaaaattactggaccctacccatatgtttagactggtgcatacagccaccagaaagtgtacagatctgtttatagtagaacaaggaaaagctattacttgtattaaataaagtaagatgattaattaacaatcaacaaaatatactcttggcattgtggggccagatacccaatagatgcttgaaattaaattagacatgattttgctctcaaggaattttcg

SEQ ID NO: 180129 - DNA, 370 bp, Homo sapiens
ggggcagtacagtcctcaggcctctttcataagggcgctaaccccattcttgagagtggaatcctcacagcctaatcacttcccaaaggccccaccatgttggggatcaagtttcaacatatgaattttaggggaacacaaacactcagaccacagcatttggctcctgaacccccaaaagtcatgtcctttttacttgcaaaatacattcagtccaccccaatggccccaaatagaaactcattctagcatcaactcaaaggtctaaagtccagagtctcatctatcatctaaatcagatatgggtggctgggtgtggtgtatcatgcctgtaatcccacactctgggaaaccaaggtgggcgaatcac

SEQ ID NO: 180130 - DNA, 709 bp, Homo sapiens
tgtggtggtgcatgcctgtggtcccagctactcagaaggctgaggtagaaggattatctgagccctgggaggctgaggctgcagtgagctgtgatcatgtcactgcactccagcctgggtgacagagtgaggccctgtctcaaaaaaaaagagaaagaaatggacacaaataaatttctgggagtgttcatcatctcaattgtgttgacttcatgggtatattatgtatgtccacatgtatcaaattgtacactttatgttatttatataaactttatctcaaggatatttttaaaagtaaagataaaaacagtaaaagtattgaggaaatattgcacaggaatacactatgcttatgcaaatgacaataattagtgggagaaaaattaaatggatgaaacggctagaaaaacagctccaccttgaccctgatgttaaatcagaaggtggctagtaattcatttgggaatgtgttggctaaacatggtgcaaatgttgcttattgaacctacttcttaaaccatagttccaggcccatctgaatctgcatttcagagtgagtgacaagatggtgaacaaagtgattatcattgctaagagattttccatgacactagctgagatgatcaaggaaggatgctctttttctaaaaattttcagtgtacgaacttggtctacttcgttaaatacagatgtacacacacattt

SEQ ID NO: 180131 - DNA, 531 bp, Homo sapiens
atctaaaagatttggcaggttttcatattttccatgtgtcagagacctggaacactactgtgtcctggcaccccctcagccgctttcttgcctatggtatctcccaggtgccaggtgccccctaccctgcacaccaagagccacgctgggagagagtgctgccagccgagcacccgagcgcctcgacccgtcccacctgattgcaccggctctaaggcaaacctcaaagaatgcgctcactgtgaaggacagtagttagctgtgtccaaatctgtctgttctgctagagggaagctcctgggagagggaccatggagggcaggactgcgcctcactcccacctttgcatcttcagagcctgcaccgtgtgcacatagcccctcatcacagggcttaatcggtttgctgaatgaatacatgatcttcctatttgctgagagccataaatcaccagctatagaagtggtggccccagtagccgttgcattatagcatcccagggccaaagagaacaccagaagacccttaatt

SEQ ID NO: 180132 - DNA, 309 bp, Homo sapiens
ttacttttagccagggaggagtcactgagggcactccattgacactccttccttctattaaacacctaagtcttaggccaggtgtgagccaccacacctggccatgcctggctaatttttgcattttgggtagagatggggtttcaccatgtatcccaggctggtctcgaactcctgagctcaagtgatacacctgtcttggccttccaaagtgctggcattacaggcatgaaccactgtgtctgcccaatttttaatttttgtgcgtacatagtaggtgtatatatttatggggtatgtgttaggcca

SEQ ID NO: 180133 - DNA, 530 bp, Homo sapiens
tatgacctttacacattgctaagtattatgaatctcaatttttctcatgtgtaaaatgtgactatttttttgtttgtttgtttttgagatggagtctcgctcttgtctcgaaataaaataaaatataaaataaaataaaagccaactgtatgagaatcacatgaggagtaaatctcaaaaaatagattgatatatttggcttaagctgccaaaagacgtaagaatgatgtcaaaaagataaacattcacactgctgacaaatgagggaataagctccagacctttacacacaacatctcctttccctggaatgctctcctttcccctcaccctccaccctgtacttcccaggccttggctgaaatgtcagctcctgagagaggcattctctgaccatgtaaataggtgctaggcatcactcactagataaataaatcaccccacagattctgattcaagataactgcataggatacctgaacgaggtttccgcccctatgaaagaccatgctgaagaacccacctccaac

SEQ ID NO: 180134 - DNA, 301 bp, Homo sapiens
gtgtgaatattcactttctcgttccacaaaaagacccaccagcaagctgtgaaatgagcatttcacaaaagcataaaacacgccgataattaaaacgctgggcaattagagtgacaaactacactccccaatctacagagttaatttcacaacctctgaaaattataaaggaaatctatttagaaattaggaagctccaaagcctttttttttttttttcctcgagatgaagtctcactgtgtcacccaggctggagtgcagcggcgcagtctccgctcactgcaacctttgcctcccaag

SEQ ID NO: 180135 - DNA, 122 bp, Homo sapiens
gggcttggtgccttccagaagcgattgtaggacaaagaaggattttagtaaattttgagttggaaccctatgactgcctttcttagctgccaggaaactgctgttttgggtgctgtgttgtg

SEQ ID NO: 180136 - DNA, 239 bp, Homo sapiens
acacttacgctctagaggatcttatttggccacatggttttaaatatttctatataccactaatgactcccatattgaaatttataacccagactctattctaccagtgctcaggccaaatatcctgatgctgtcctagacttcccgtttgtgtctcactgctcatctaacccatcagcaaattgcattggcccagccctcaaagtagatccgtctctaccagtacccttctgatccga

SEQ ID NO: 180137 - DNA, 566 bp, Homo sapiens
agtgcacagaacacagccagtgcacaggagaacactgcacaggagaaccacactgcacaggagaatatgcataaacagttcacaggagaacacgcacaccacagtgcatagagcacagacacagtgcactaggagaaccacacaatgtacaggagaatacgcacacacagtgcacaggagaacatacacgcagtacacagtacacagtgcaccggagaacacagtgcacaggagaacacgcacacacagtgcacagaacacagacacagtgcacaggagaacactacagtagcacaggagaacacagtgcactaggagaatacacacggtgcacaggagaattcacacacaatgccacaggaaagaacacagatgcacaagaacaacacacacacacaacatgcaccaggtaaaccatgcacagtgcacaggacaatacccatggtgcacagcagaattcacacagtgcacaggagaacacacacagtgcacagaattcatgcacacagtgcacaggagaacatacacagtgcacaggagaacacagtgcacaggagaacacacac

SEQ ID NO: 180138 - DNA, 464 bp, Homo sapiens
tcaggcgattcttgtacctcggcctcccaagtagctgggattacaggcacccgcccccacgcctggctaatttttgtatttttagcagagatggggagtcaccattttggccaggctggtcttgaactcctgacctcatgtgatccactcaaccttggcctcccaaagtgctgggattacaggcatgagccaccacgcttggccatcaggttctttttctttaattttggcattttgaaaatgttattcttttcccttctggcctgtatggtttctgttgagaagtgtgttgccaaatgaattggagctcctttatatgttatttatctcttttctcttgctgcttttagtatcctttctttgtcgttgatctttttgagtttgattattatatgccttagggtagtcttttttgggttgaatctatttggtgttctctgatcttcctgaacatggatatttat

SEQ ID NO: 180139 - DNA, 367 bp, Homo sapiens
agacttttacttcatactcgttctgtacctttttcattttgaaccgtgttaccacctatgcaaacaaaaacatgaaaacaattttaaagacctttagagaatcacagagcaagagacattagggtgccccacatttaattcaacataaaaatgaaatgagtatgaggaacttctacaaagtttagatttttttccctagatgacttgttccgtatctgtgaaatggccaatgagttctgttttctctttatttcacatatctgctttattagtgtcctcagtgtgtgctgggtctaaagagtcaatctagcacagatgaagttcattaaatctaatgactacactgcagttcttttttttttttttt

SEQ ID NO: 180140 - DNA, 243 bp, Homo sapiens
acaaacctcatggaggagacagtagggctgggacaccttgttgcaatgctctgctagaagaccagtgtaaatataaaggtaacccaactcttaagagggtcgttactacagctggtgaagctttggaaccattgtggttaggaggacaagaatatgcttcagaaccatgtaagacttgagttcagatcctaactctgctatttattagctataaaaagttggacaatgccctctctgaatgtc

SEQ ID NO: 180141 - DNA, 487 bp, Homo sapiens
tgggggcatatgcagatacatgggacagatcccttggaggatacagacagataagctcatggttcctgcacagggtggtgtgggctcttactgctgagctgagacctatgtggtgactgtgttggactgaaccccagggaaaggtgtggggtcgggtgtgatgggcacaaacagaaaagtggctgttatgattcacaaacttattgcatgtcattgtacgttacaggtaactttcagtgctctctgatgtatggagcattaacaatatggaactaaactagtgtttctcatatctttcaatcaccacttccaataaaaaatattttctattgggaggccgatgtgggaggatcacgaggtcaggagatcgagaacatcctggctaacatggtgaaaccccgtctctactaaaaatacaaaaaattagccgggcctggtggcgggcgcctgaagtcccagctactccggaggctgaggcaggagaatg

SEQ ID NO: 180142 - DNA, 483 bp, Homo sapiens
cccttaaattcagaatcaggatcctatctgatccttgcatgggggaccgctgaagaatttggtctcccagaacttggtaggaaaacattctttttttttttggagatggtgtctctgttgccaggctgaagtgcagtggtgtgatctcagctcacggcaatctctgtctcctgggttcaagcaattcccctgcctcagcctcccgagtagctgggattacaggcgcgtaccaccacaagcagctaattttttgtattttagtagagacagggtttcaccatgttgtccaggatggtctctatctcctgactacctgacccgcccaccttggcctgggattacaggcgtgagccactgcgcccggctggaaggaaaacattctgagtgaccgtgtatgtaaataagtctttctggttattttattctgtgaacctgtgtgatgtaatgactgcatttaaatagtattacaacaaaaactaattg

SEQ ID NO: 180143 - DNA, 174 bp, Homo sapiens
gtccgggggctactaaggagaagagtcaagtttcaaaaaccagtattgtctccagagcccagcccataaccactgcaccacatagcttttcactatacagaggacttatctcaactaagctcagtcatgcctgccccagagcaatgcttcaatgaccaaacagagcacagattc

SEQ ID NO: 180144 - DNA, 335 bp, Homo sapiens
agactaactaggcttaaggttatgagggcagtaggaaaactggcattggaaagtgggaaagccaccccaggggcagagtttgtgaatataggaatgttgcaaaattgagaattggaagaagttatcagcatatgcaagggttcatactctagggccaggttttgtgtaggagtggaaagattgtagctcacctgtttttggcttccatcattgcctcttcttttcttggctctgtgcctagctattcttgtgctcagaaaaagtttgttaaacagctctgttgaaatggctatgaaatttgatcacaggcataagaactctcctcccctttccct

SEQ ID NO: 180145 - DNA, 364 bp, Homo sapiens
ggtggtggtgttttttttttttttttttttttttttgtagttttcattgctcacaaatctcaagtgcatccagcattctctgctgctgaaatatctggagccacaacaaaatttgggtttatgggcagtgcggtcaagaaactgggtccactaagtagtgtatcagtggatccagaggcactgtagaatccgggtttggtaattctgggacctcccctctctcttataccttcctccccaaaatgtttcttctgctcatcagggcaagagcaaaggaacccgaggctcttgctttgcagccatctttacaagcacaaatccatgatgctgggtccccttcctcctcatcttcctttaaatcctg

SEQ ID NO: 180146 - DNA, 241 bp, Homo sapiens
ttgagtggtgtgtattcagtgtggactattacaaataatgctgctatgttcaatcttgtacaggtcttttgtggacatatggtctcactcctcttaggtatataccgagtagtgaaactgccaggtcatgggagtatacacgtgtccaatttttgtgcattactaccagaaccatgaccacccctagtttccctgcctttatttcctttcatctatttactttgggctttctttgttccct

SEQ ID NO: 180147 - DNA, 307 bp, Homo sapiens
caagggaaggccacatgggcacacaatgacaggcagccacctgcaagccagggagagggtccctaccagaatgtgaccatgctggcaccctgatcccagacttccatcctccagaatggtgagaaaataaatgccggctgttgaagccacccagcctgctgtggtattttgttagggcagcccaagcagaccatgacagcccgccaaatccgggtctttctctctgctcattctgtaacccactgcctgtcaactgtgtcttcaccaatagtcattccgtcactggtgaagaaggtgtcacctggtc

SEQ ID NO: 180148 - DNA, 422 bp, Homo sapiens
cgcagtggaacatccatattagccacgtgtttctcttcttctaggaactaagtattcacagcctttgcccaatcttccactggctgcttgtgtttttgttatttgttgcagctctttttttttttttttttttttgagactgaatcttgctcttgttgcccaggctagagtgcagtggcgtgatctcggctcactgcaacctctgcctcccaggttcaagcgattctcctgcctcagcctcctgagtagctgggattacaggcacgcgccaccgtgcccggcctccacatagatgtcggataggtgttctgaacttatgccagagctgaactccacctgatccagaaacggctgccgtccacctgctcagaccatacctcagaactgttgctggctcctccttttccctcatgccccactgg

SEQ ID NO: 180149 - DNA, 262 bp, Homo sapiens
  misc_feature (135)..(135): n is a, c, g, or t
cgcagtggaacatccatattagccacgtgtttctcttcttctaggaactaagtattcacagcctttgcccaatcttccactggctgcttgtgtttttgttatttgttgcagctctttttttttttgtctatgtgngacatgagccattgatttcttatgaagttgagaagaacttcttgcccagcttgggattatgccaccaagaggctactcacgatgtttataggacaaacactggaactaatcatgcctcaatgggggc

SEQ ID NO: 180150 - DNA, 423 bp, Homo sapiens
ggaggaacttctgggtgatgggaatgttctgtcttgtggcaggggtttcacaggtatatacatctgtgaaaacctaaattgtatactttaataaggatatcgtttattgtatacaaaccaggccttagtaaagttgatttttcaaaactttcctactgatttgttttgagaagtaaatgagagaaaatgtagctggcatatggtaagtgtttggtagtaaatgatgatgatggtgatgttggtggacactggggcatgacagcagagtgtcctggaagtcagaggaccagagtttctctctttgagtcctgttattttatataataatctctgaacttcactttcttaacatgacaaaggacaggtctggacgagatgtcctagagaagcttaaaggtgcaacaatttgatcctaaagtgatg

SEQ ID NO: 180151 - DNA, 361 bp, Homo sapiens
ccttccagtaatgtgagcctagccttctaatcatctgagcctaggcactagccacctgagtggagaaacccctggcagtttgcgtcttcacaaatgagcagacattatggagtctgcagacagtcattattatctccattcattgtccagagtcctaaactggagaacccatgagcataataaaaggttatttatttctaccactaagtttgggatggtctgttacacagcaataggtaatcataacagaatttaatattggaagtggggtgttgctgtaacaaaacctaaagtgcatgggaccagctggtgggtagaaagactgttcatgaagcttggaagggactcatggagactgatg

SEQ ID NO: 180152 - DNA, 583 bp, Homo sapiens
tgggatgccaaaagtctaattctgactttatatattattatttatataaataacatggtattataaaatcataaaattacagggataccgttttcctttttaatatacctattattttctttactctgcaagttaagagttgtgctgcatcagcagagctgggtacctatggaaacaatgaatgatccctgaaggccattatgttttatgggccaagaaaaaaaagttggtttctatcttagatcacatgaatgcagaaataagttgtttggaaaaaaactctctgggttttaatatgcaagaataatattttggtttcctgtagatattaagattcattccatcagcaataccttgttcagtaaaataatgctggaaagaatggcatttaccttcaataaattttggcagttttggcataatttttatgtttaccaaggaaagaaaacaaaaatgggaacaagtagaaccaattataaagagtgctttagtttggcgaggatgttctaaatggccagtttgttgtaagcagggccaggctgaaagctgaaaaatgaaagtttgttaggtccttagtatgttt

SEQ ID NO: 180153 - DNA, 265 bp, Homo sapiens
gctgtcacaccagcagaacaagcactgccccacctcagtctctcacccgaggctcagtccacacccatcactccctccaactggctggaccacagttctgtccatccatcaagccccaagcacacacaggttcaagagcaatagatgcaagagctctgtggggttggtggtgtcactaccacctggggctaaagggagctgggcacgctgtttcaagggataagacggtcccgcttattatgtacagactacatggtctgtaaat

SEQ ID NO: 180154 - DNA, 177 bp, Homo sapiens
tacattccttttttaaattacacacacacgtgcacacacatctagagttaaatatttactgatttatatcttgatttttacgtttaaggtctggattttccaagtgtgaaattctaatactactaatactactactactaattttaatactactaactcagtagtaaaagaaactaa

SEQ ID NO: 180155 - DNA, 586 bp, Homo sapiens
ttttatttatgtgaatattctcttcatatcaagctaatacttttcatgcccttgtttcttttttctgtgactctttgcatacttggttttttgaaagttgcccacgtttttcatcaattgatatccatctttctgaatttgacttgtttgagcctaaaaaggactaccaatcatggctgcctgtcctgaccttttaaacttctttctaccacttattgcttgatgacatggtatcaggagcggcactgccatcattgtcgtcgttatcattattgtaaaccttaccaagtgtcagaccctgttctaagcattttataaatgtttatccatttaattctcataacagctaagcagaagatagtattattaacctctatttacagacgatgggattaagaaacagagagttggccgggtgcagtggttcacgcctgtaatcccagcactttgggaggccgaggctggcggatcacctgaagtcgagagttcaagaccagcctgaccaacatggagaaaccctgtctctactaaaaatacaaaaaaaatttagctgggcgtggtggcacatgcctgtaatcctagctac

SEQ ID NO: 180156 - DNA, 109 bp, Homo sapiens
tgttacttgatgttaggctcatggtagggtctaagggcattcttgcttctcctggtccagcctcagtcttaggcagaggctgtgagcctgagccctgtggttgaggcct

SEQ ID NO: 180157 - DNA, 258 bp, Homo sapiens
ctggtgctgtcagtggagtattaaagtccgtcactattattgtgttgtcatcgatctcatttcttaggtctggtagtaattgttttataaatttgagaactcttaggtgcatatgtatttagaattggggtattttcctgttggtctagtcctttttatcattatataatgtccctctttgcccttttttttttttttttttttttttttggagacgaagttttgctcttggtggcccagggtgggagtgcaatcagt

SEQ ID NO: 180158 - DNA, 453 bp, Homo sapiens
gaggcatgagttaacttttttaggccgcctcgtattttctttttagcctgggatttaatattgcaaaagtagtttacttcactacagagtttatgttctgggatttgtctgtctgaggcagtgagtcctagaggtaatatgtttcacctaaagattactcaaaatgaagaaagtattgatttttttttaacatctaattttgaaagaagaaagctcgcaaatacatcttttacagtagtatctagaattgcctttctcattccacctctgcttcacattctcttgggcctttgctttctgctttccctcattatgaccccttcaccccctttccctcctttctctgagttttctttcatggcctcccagattcactgtccctttgcttcccttctctggtttcaactcctgtccagaccattctgcttcatatttttcttatgctctcacacc

SEQ ID NO: 180159 - DNA, 743 bp, Homo sapiens
cgagtatgtcattagccaaatatgagattctaatgttgtctggcatttcgaatagtgtcagacttctacatttgtaaataaaagactgaagcatagattccttaatcacctgtaatatagtaaaaagagttttggacttagagtcagaagacaaattggaatcctggctcagctagtttagaaaaaaccttggtagcatggcggaatgataatatggatgctggagtcaaacagaggcaggaatgagttggatttcaccacttacattaatacattttgatgaaagaaagtttggatacctttggcctgtatgttgcagaaaacaaccagaagtagcatgaatcataagtgtgttatctcatagaacaggaagtctggaaattggtatttatgtgttaattccatggcttaatgatatcttctgcaacacaggagtatttaaacttttggttctgtcattcttagtttgtttgtggtatcttcgtttgagtggtgatattgctgtaatagcaatagttcaagatattacatgcagtcatgatgacagccagtaaagagaggaattcctcccatttgtctctttttagtaggtagaaaaccattctcaaaagctgtagtacacaccattgattcaaattatgtctcaaactcagactaaaagttactcactagcaaggataatgaagatgccatgactgacttagacttttttttttaaccccacctttggatttgggggtggg

SEQ ID NO: 180160 - DNA, 492 bp, Homo sapiens
tgagagtttacaacagagatctaaaaatggaatgtgtcaagaaaaataaataaataatgtgcattcttgaagagcttaatataggcatgaatcagaaatataaaagaccattataacgaaatactgtagcaggaaattataccagttgttatgtaactatggtcattataacatcaggtttgagaaaaacttcatctaggtggggaaaaaaagatagtgaagtttgttgaaagaaatggcactctttcagaatgagaagaaaacaatttcatattttttgagtatgtgaatgaaagaaaggaaacataaaagtagtgatcacattttatatagaagagagagacagtattaggtttcataaggaagattgatttgaattaatcagataacaatgtctatgtagatgaaacagtatatattgtgtcaaatttggctttataatttaattagtgttaattattaatatatcttccttcatattagtgcatattt

SEQ ID NO: 180161 - DNA, 484 bp, Homo sapiens
cgggaggctgaggcaggagaatggagtgagcccgggaggcggaaattgcagtgagtcgagatcgcaccaccggatctcaactgggtgacagatcgagactccgtctcaaaaaaaaaaaaaaaaaaaaagatgtatatgatggccaagttgacagtgggtagatttatgatgcctaatgtgtcaacctggccaagggatatttggttaaaacatttctgggagtgtctgtgaaggtgtttctgaaggagatttaacatttgaattggtggactgaataaagcagatagccctccccagtgctggtcagcatcatccaatctgttgagaggctgagtaagaaaaaggtggctgggtgtgggctcaggctgggcatggtggctcacacctgtaatcccagtattttgggaggctgaggcaggtggatcaactgtggtcaggagttcaagaccagcctaggcaacatggtgacaccccgtctctactg

SEQ ID NO: 180162 - DNA, 616 bp, Homo sapiens
aacagatgtaggctgggcagccatatagtgaaatacagaggtatcggtgaagggaaggtatagaactcccagagtttcaaatagagcagtggcaaacagagacttactattctaagattctccacaaactgccaaagaggcacctttgtttttaaggtggtactgtcccagctcccttttggaagccctttttttgttctcttcctaccccacatcacctgctaggccattaataaaagcaatgctttgttttccacactctaaatcactactaatgattctctaatggtattctaggtggcgtgaaggacaacaggagatgattttgttgctgctggaaacaggaggcctacttttaaaactaaaaagtacaatattctagcctgcagacgaaagaacactcctaatggacttgttgtgacaaagggaagccatatactaggagaaataatgctgcccatgtttatcaacaggtacaggttgctcgcttccaccaagtccgacctggacagaggccttaaacaagttaggaagaacatattgccgcccttcacaggtctcctcctctctctctcaatccctgagctttggtttcctgagattttattgattaaag

SEQ ID NO: 180163 - DNA, 151 bp, Homo sapiens
gaggcatgtaggtatgattactatctccattcaagaactgagaaaacaggtgtacagagatgttttttgagcttcacaaagactcacaggtattaggattaagctggggatcaaacccatgcagaaaaggtttcaccaactgcctcttcca

SEQ ID NO: 180164 - DNA, 475 bp, Homo sapiens
ggcttttttggaaaataaataatttcaaataattcttgactgacatgcaggatatgcataccacactttaatgaaaatatgaattctacaattatatcaccttggacaaataatccagactccttttcttcatctgcaaaatactataatcttgagattaaaagatataaggtcttatcctgagctaaactctatccttccaatggtccccctacaaaatacagctgtgtaaaacaaagcaaaataagaaactgcacaaaacaaagtagtttttttctaagcagaatactgagagaaaattaattttcggggaatataaaaaatgtgcaatgggaagaggtcaaataacattaacaggagttcggaagaaattgattccaacccgcatggatgactttgagggattcaaggcttcagaggaagaagtaactgcccatgtggtagacacagcagtacaactagaattatacctaga

SEQ ID NO: 180165 - DNA, 438 bp, Homo sapiens
tgcctcagcctcatgagtagctgggattacaggcacctgttaccatgcccagctaattttttgtatttttagtagagacggagtttcaccacattggccaggctgtcttgaactcttgacctcaggtgatccacccgcctcggcctcccaaagtgctgggattacaggtgtgagccactgcccggcctttttgtgtgtgtgtgtgtatgtaaagtaccgatgttattgatcttgttctaggaatggacagtgggtatagattgaacacattctagaatgtccatccagtggagctgtttttcagtgatgggacttttctccttgggcctcacaaataaccctgtctaaaaatttacccaagtctcctatttggtgattgtaatgaaaagacttgtaatttttactatgggaggttttacattttattaatgatgcctt

SEQ ID NO: 180166 - DNA, 419 bp, Homo sapiens
attctttgtaaaggtggggtctcactgtattgcccaggctggtgttgaactcctggcctcaagcaatcttcttaaattacaggtgtgagccaccacacccagccataactgagtttattagctctttagtctcatgaatgacacacacacagaaatgatggaaaccaggaaaatacatatattaagccaggtgctgttgcatgtgcctgcagtcccagctacttgggaagctgaggcaggaggattgcttgaacgcaggaggttaagttcagcctggggaatataagtgaggccctgtctctaaattaaatagaagaaagaaaaatacaaaaggaaaaaatatatattaatttataatttggttagggagggaacagcctacattgtttacttatacttttgcctttatgtaaacatta

SEQ ID NO: 180167 - DNA, 427 bp, Homo sapiens
ctaaaatatcttggtttattgaattaacaaagttcccttttgtggaatttttttaatggtaatgaattataagtaaaataggaaaattatccttgagataataaaaaagatgaaattgagctaagaaaaaagtaaacagagctaaaatgatctccacactagagtttgaacaacacagaagtgagcagaaatgcagaaggaaaatttattggaatacagagaaaatatttagctggcatagtatgtaacatttcctagataaaacaagaaaactctgggagtaaatggctattctatggaagattaagaaaaggggtatctgtaaaaatactcactgcattagagaagatattataatctactggaaaaaacctatacttcttgaaacttacctctaagacatttgtaattcttaatgaaaactaaa

SEQ ID NO: 180168 - DNA, 339 bp, Homo sapiens
aaaaatcatggaaaaaccaagttgaataaacactttggcaattacgtgacaggttaactttctcagacattttcattggactcgtgaaagtggatatccagtggtagtgccttgagaaggaaatggaggtggaaaccaccaagagtggcttattctttgaggtactggctcaagggaaagggcagagagagtagtattagaggattcagtgtagagttgaagggtttgggctttttcccccccaaaatgggaggatactgagcatgtttatatcctatgaataaagaatggatccttaaattgaaaaaaatgagatgaagggataaataccacattcta

SEQ ID NO: 180169 - DNA, 525 bp, Homo sapiens
ttctacaggatctatagggtcttagggaggaaggctccttcacttatctgaaagaacagcaaggaacccgacgtgtccccaggaggctgggagaccaggtacggggcctggtaggctgagcaaacacagaagcatgaataaggcctaagtccactaaaccccaagcacataattttatctggaagccacaactcatccagccacaccggcgcaccctccttcttgaggagagggcagcctccaatctgaagcacctctgtctcccctggactgtccgagacagagtggcagaagcctcgcttgtccaaacacacgacagtcaacgtctcccaggtcccccgctgcccaatttcagcctcaaagaaccaactatttgcctcggcctcccgagtttctcacctggagtctccgggctggctatgagtgttcgggaaactctctggctctggtcctgaaaggtgaaggagggtgcaggggcatgtccccccgtgacatctgtgcccgctccccaagcgccagcccaac

SEQ ID NO: 180170 - DNA, 245 bp, Homo sapiens
tgcctgtggcaccacagtgttaggtgaaataaatgaaaaaaagccacacacgaaaagcaagtgcctggattcatacacacaccaagtgtggtgatgtggttgtggtgatctcatactacaccatccccagctccttagctagagccagagcttaagaaagaaaagcagttggcccagaaatgctggtgctgtttctacagaaagcctgggttcttggttttgtctgtgaagaaaagagtgcttgg

SEQ ID NO: 180171 - DNA, 159 bp, Homo sapiens
attacaactgcctttctgttttaagaaatctctggggagaagcctaaattggtgcaataaaatatccacccagtactagaacttgctcccttttttttttctttttgagatggagtctcgcactgtcacccaggctgaagtgcaataggatagtctcag

SEQ ID NO: 180172 - DNA, 1115 bp, Homo sapiens
catatataaaaccaagcaaaacacaatgtgaaatatgtaatacagatctgtacaaaatgtcttagcaactcaaaagaggaagtgatgaattctgtcttgagacaaataaaaggcattgcagaaggaaaaaaaaaaaaaaaaaaaaaaaaaaaaaaaaaaaaaaaaaaaaaaaaaaaaaaaaaaaaaaaggggggggggggcctagcaaaaatcatcctcctctgctgagagccgcgcaacgtcagccgacaaacaccgcagttgttcggtggatagcaaagggggcccccccaaatgggagaggctctgcataaaaaaaagagagacgacgaccccaggtgtcaaaacaacgcgcgtgaggggaaaaaactcgctcatcagtggggaatactcttgggaagagacaccccatttccgcgggggggggcaacaatgatggggaaaaaatcacccgctgaaaatattaacggccgtgaagcggaaaatccaacaccctcgggagggtggtttgacgggcgggttccaacccaccgcgcagctaacgagcgccaggcggcggagacaaaacaatcggcggcaccgccaaagaaaagagcatcagggaaaaacaaattctataccccggcgggaccgcgtgcaagaaaaaaacaccacgcgcgcaaccgaccaacagcacgctacccagaaccagtcaccacaagcacactatcagcaggcgcggaaccaaccaccccccaaaccgacaactgccaacatgacggacgacaccggtaagacacgcagacacacagagacgataactacctcaccccataccatccatatacccaaccaacacacacaaaaagtctaacaaacacagttcccacctactcgcacacagactaaacacacaaaaatatcacaaaaaaacatcaacaatctataatctactactactacacaaaacaaaatacaacccacaacatataatcacccacaataacataaatcaaactcataaaacaaaaaacataacatcactcaacaaaacacaaaacaaactataattacatcacaactacaacaataacaacacctcatactcataaaaacatacacatatacactactag

SEQ ID NO: 180173 - DNA, 435 bp, Homo sapiens
tgaaaaactaaagaatacccaatcccctcctcaggtggctctatcactgcctcaccctgaggacagtatttccccatggggtttggatcactgttctctagttccctctccctggggcatgtgcagagtttcaacttcttgttggctgctctcttccactcaggatttaaaacattcacacttgattctttttccttctatctctgtaatcctaataccaagttttcttggcattcattatcagccgtggaatctgttgtacctgaattgttactcacagcaggtaataagagaacaagacctcctggaatttctgagccagactttgtactcagggttaccttgctgacccccatattttccagcattgctcttattaattaatggccctcagtcctgcacacaccatcagatcccaggggctgagcacagcct

SEQ ID NO: 180174 - DNA, 341 bp, Homo sapiens
gtcagtgggatatacaactttgttacatttactgaactcaataatgtatagacaacttcacgtgcttacatttttaatagtttttaattttatggagacaaatgagaatggggggaaaaggaaaaaataattctaagtatgggaaattatcttttgtgtctaacaattaggttaaacaaagtgggagcaaatgagcctagttccccttctattgtttcagggcaagaaaatacagacagatgtcggaatgtggaagcggtgacctctgacttgcacagcatggccactgccctggcacacaagtgtcctgagccaccatcgtagcaggatgcgtttttgaa

SEQ ID NO: 180175 - DNA, 355 bp, Homo sapiens
ataaagaaaaaatatctttcatgatggttggagtttgggggaaggcatgagttggggaaatgtgaagactggcagagtcttatcttctagacatggggaaatgtatcaggaagataacttggagcagagtaaaaagggtcccgtgtttgtgttagtactggacattatcaatgttaataggttcctataactaagcaggtatccctggtccttctgtgttttaaatcccttccactcccacaaacctcagatcccatcacttctctttctccttttcaacttctccctcttgaactaccatctgcttttaagttggtgcaaaccattctaccttaataaaactgctaacccatac

SEQ ID NO: 180176 - DNA, 290 bp, Homo sapiens
ctgtgctctgtacatccaatcatcaaatgctatcaattaactttagtaatacatcttacattcatgcctttgcttcctttcccactgccattgtcctaaactaaagcatctcacatagactattttcactgttcccttagtttgccttccagcatttggtctgatttctctgactaccatttaaaataccacggtcaaattaatcttttatttacataagttagtcatttctctgctcagaaactttcagtctttgcattataaattgaatcaagtatagactccctaag

SEQ ID NO: 180177 - DNA, 236 bp, Homo sapiens
cacacaggtgagggactagtttgtgttcctaagagccagagtagagagacttataatacacagggtattggttggggttctcaaaatggtcatacctaaatgggttaaattagtaccagaataaaggatgctatggacccaccataacaaagcttaaaaggaagcctttaaagaatcaaactaatccaaaagtaatttagttgcattttcacaaaatccaacacgctttatgctac

SEQ ID NO: 180178 - DNA, 267 bp, Homo sapiens
cccagatggggccttaccttgtgctgctgggattacaggtgtgagccaccgcacccggccagaaaattttctattttgcctgaatgataatgaaaatacagatatcaaacactgtgggatgcaatgcaacagtgcttagagggaaacttactgttttaaatgcccatactaccaaagaacagctgatagtcagtgatctttaggcttccatttcaagatgctaggaaaagaaaagcaaatagaatccaaagagagtacaaagaagga

SEQ ID NO: 180179 - DNA, 337 bp, Homo sapiens
gtcaatgaacacatgtggaatgaatacattattgtcagttaccattatggcctttcccaacaccgccatctggacctgccatcatactttttccacgtgtggattcctcttaaggatctcctcactcccaccccccaagtcaggttccacatcctctgcctctgaaagccaggccactttggcagtggtaagtatagaggagagaagtgggctttgtgtctagtcctacaacctcattaagcaaaactaaaagctggctcctaacccatctggtctatggctcatacccatcctcagctactacctactttcccccattgctaactctatctcctta

SEQ ID NO: 180180 - DNA, 651 bp, Homo sapiens
ggttcccatcactggaacttgccagctttaggctaggagagaaatcagacccattttacaaatgaatagcaaatgcacactcccaggtgtcattaactgtttaatcatttgtaagtggaaccccttctgggggtctccccgtggggatgactgttcaggagacaaggtggatcctgggtgtgtcgatagaagacagctgctttctttgccttgctgttgccattcatcaagatttctgtggcctggctagtccttggcagaacaaaaacaaaagccgatgaccctgaaaggtcgaaaaaggtgtacagactgaaacaggatttataaatcccacaaatatgcagaactagtctccgaggtccttgaaatgatgaataaggtccttaacttagagcacacacaggacaccagagtctccgcatccaaaacaattcattatagttctgatctttccagactccaaagccgcccccaggccaggtccccatcagctccagcctcctgatgaccttctgcctttctctatgctgcacctacactgcagcctccgggcacattttatagtgtttggatgctttagaatcaggttttcaaagcttttgtcagtgaatttccccgctcagctcttcaatcccacgctgccccaaagtc

SEQ ID NO: 180181 - DNA, 536 bp, Homo sapiens
gacttatcattttctctaattactctaaactgcacacattttcacaaattcagtgttgtgtttagttctcacaaatctaattcctagtatacacagtaggccacctcttgtctggtttagtataatcctcattggcataatcatcttctttgtggctacaatgaactaaagttgacagactatgaggaaagcgacacattattcaactcaagttcacaagttgcgaaagttctgggcattgcccatttccaaatgactcaaactgcaagccttaatttataagcaagtttaaagaagccaagaatgtcagagaacaaactaaatcaactcactagattttaggtgaacaggtcttatatgatgttacatgagaagaacacaaagcaattttccagtcatcttttgccctagagatgtaattactatcaattctaagtaatagcagaaggggtaaactacgttaaaaggggcctcaacagttataacacattcttggttagtcattaagttatgaaaatataactctgatgaagaaa

SEQ ID NO: 180182 - DNA, 838 bp, Homo sapiens
aaaagatacaaaagatcttaaaagatgctataaaacctccaaatctaaggaggttaatgcaataaaatttaattctgagtcatgtaaagtccaattctgattttctcctgggggacagttctcctgagcagccccatggggcttctgtcttatggcttgtggctatctcaaggcttcatcatcctgtagcttcaagatttccctgttgttgggaaaatgatctcacacccagtgcttaatcaccgaggttataaaccaaacatcagtttccttcacattccttcggcaagaactggtcacatggtcccaccatgctgaaaaggaagcctagaaatgtcctggctagacagccacttcccagtaaacatcttagttggttatgttatggtaaagagttgctgtctcaagtcccgcaattgctctaccacctgctggtccactgggagctcctgaacctccctacggtctggtgaccaaatgcccaaaactaagtaggatctaagacattgtttcaaagttctgcctggaatcccttctgattagttgatgcctattcagtactgattattaaatatttgacatagcacgtcagcatctagtatctttgcaagctccattttccaaactcactggcactaacttgcttgctgtggtcactgacctctaatttcagatctcttcctttggacctgatgattggtaccttcctgaagtgcttcatctttccttgccaggatacagacctacttctctcaaaccctcacttaaggcgacccatctccaccttactgtctgcccatttcccctcccaggtctcttaaccaccccagaggagccc

SEQ ID NO: 180183 - DNA, 993 bp, Homo sapiens
ctgacttggacccttctttggagaggagcaggaaggacctccaaggtgaaggggtgaggggatgccaggtttctgagcagtgggctggccctggcataatgctatggtgttgaacgaccacagctcacaggtccctcatggaggcctgagcccttcaatgccaggacttggacctgccattctggtcagcgccacggctgtggacacagccatctggtccccccaacgggatggagcaggcctgccatctagatcctgccaggggccgaggaggcgagagttgctagggaagtgattagtttacccttaagtaagtacctgagcctgtttcagtgatcaataaaatcagcaatgttagccgggaatggtggcttatgactgtaatcccagcatttcaggaggctgaagccggaggatcgcttgagcccaggagtttgagaccagcctgggcaacatggtgaaaccctgtctctactaaaatatacaaaaattagccaggtgaggtggcatgtgcctgtagtcccaggtactcaggaggctgaggtaggaggatcactgatgtatgtgtgtatacacacacacatgtatttgtagattgggggtccccaagaccacccttaggtttgacaccttgctagaagaactcagagaatgtattaaaaactattatgctcatggtcatggtttattacagcaaaaagatacagattaggatgggtgcggtggctcatgcctgtaatcccagcactttgggaggctgaggagggaggatcacttgaggtcaggagttcgagaccagcctgaccaacatgatcaaaccccaactctactaaaaacccaaaaattagccgggcatagtggtgggcgcctgtaatcccagctacttgggaggctgaggcagaagaatcgcttgaacccaggaggcacagattgcaatgagcctagattgtgcctctgtactccagcctggatgacagagtgagactcagtctc

SEQ ID NO: 180184 - DNA, 392 bp, Homo sapiens
cttctttgtaaaataaagatttattcattgagtcagatttgtaaaaccagcaaaaaacagcaaggttttaggaatactgagaattggcttttgcagaggatggtttttttgttttttgagacaaagtcttgctgtcaccaggctggagtgcagtggtgcaatctcggctcactgcagcctccacctcctgggttcaagtgattctcctgcctcagcctcccaattcgctgggattacaggcatacgccaccatactcatctaatttttttttttttttttttttttttttttttttttaaaaaagggatttgctgggatttcgcagggttaacccattgcccccgggccgttttattttcaacctggaaataaacgggtaaaatttagttgg

SEQ ID NO: 180185 - DNA, 756 bp, Homo sapiens
gcatagattaatttttccaaggttacatagctagtcagcagtaaagtctagattcagatccttagcagtttttctccagagttgatcctcttaactatttcactatgttgtaccttcaatccagatacactgagctattcttataaattacacagttctatgtcagtgtgctctgtggtactatatttacatacaagtacactacacataacacactgtatcttttgcacagctgattctttatgaatgctcctgaaaatggaaggttcctaaaacattctattcttttcaattcatttttattcaaatgggttcaattcaaaaaatactgattgagctccttctaggctgcaagcaatatatttgtcctacatcttacctggcttgagcacagcaatggaggtagagacataaaccaataatggcaatatctgtcaccagttcagtaatagagataaaatttaagagcagaagtggcacaaagtgaggattgtttggttttgtaagcaatttgctttacacatttcagagatgtgccatctttttaacactgtaattttagggatcaaggaaatcacacacacaaaataccctccaaatgcattattatatctaacttttacttgcataataactgggatgaggatacatgttgatgtaattgtagtagtgcttacttatgcctaatgttctagtgtaattaataatagcaccccttttaactttcataagtaaaatggtttggatgatgaattg

SEQ ID NO: 180186 - DNA, 407 bp, Homo sapiens
attacagagtttagagagttatcaggagggttcaatcaggtgacccaagtgccaggttgcaggagctggtgttcccggcagccaagagacggattaacacagataagtgcagggttcctgtcatgcattcattcattcaatctatcattcgatgactgtttattgagcacctactatatgcctagacctgggctagtcacaggcatgggggaaaatcagaaacgatatctctgtcctcttaagactcatagtccatcaaagatgaaagctcacagataagaacataatgacaaagagcagtacctgctgtgaaggaaagagcaggggtgtcaggacaggaagcaccagagtggcggtctgggcagatgacatcctagcagactggaagggtcaggaaaagctggctg

SEQ ID NO: 180187 - DNA, 869 bp, Homo sapiens
ctcgctgtgggacgtggcggagcagctggggatccgcccggcctgcacctgagcggaggttttgcaatcaggtcagtggaggcagcgaggcgcggctgcagctagtcgtgaggctctaaatttggaaccgtccctccttcggggtgtgtttaaaatcaccagaacggtgctttggggctttctgttacgtttccatcacctggatagtctaagggatgcctgatccctgaagctggaaggccttgggtgagaagggacagggcttcctcccgctggaatctgtggacgtttggggccccttggggaggaattcattttctgctgaaggaagctccggaggcatccggtgagcgctccctggaatcccatgcgctccctttgggctcagtgttgacttggctgcgcaggctctgtcggggggacttcacccactaggtccttcaggcatgatccagccctcaagcccggccgggcccaaggccgtggcgcaggaggggctggccgcctgcccctgtctccattcacgtgtttgaccgtgtgggtgagtcactggctccagagcactgagtcagtcctgtttctcctctggttagagaagtattcgccagatactcaaggaacaaggaagagtcttttaagtgggactcaataaaaagtggggaggcagggttgttttgatattaggtcccctagaactagaagctaaccttctgctatatcttactgaaaagaaatttcttttgacctggggcaggggtgcggtggctcacacctgtaatccctgcactttgggaggtcaaggtgagaggatcgtttgaggccaggagttccagactagcctgggcaacacaggagaacttgtggtctac

SEQ ID NO: 180188 - DNA, 337 bp, Homo sapiens
ttgtatccccacctggcagaaagagagtgagaaatctctctgtggtcccttttataaggtcactaatcccatttaccagagctctcctctcatgacctaattacctcctaaaagccccatctcccaataccatcaaactgggggttgggacttcaacatatgaaatttgagggggacacagacattcagttcgttgcaaaagaactctctggagaagtggtgttgaagcagggacattcagagatctgggagaaagaatgttctaggcagaaggaaaaggacgggaatgagtcctgaagcaggagcctgtggaagtgtctgtggataggtggggagg

SEQ ID NO: 180189 - DNA, 401 bp, Homo sapiens
atttctttcttctggccccctagggactcagtacaacaggtcttcaaatggcctatgccacagtgaaatttaggatatcacacttctattctaataatgaatcaggaggcagcttgacacagtccttcccaactccttaaagcttccctcctccactcaacaattaacttattttaagcctcctttcataaggctggttgggggttagcatctcactctcctggcctcacattcttagtctatgagcttttttagtatctatttactcctctgaaatcacctctcacgactactctttgttcccagatctggaggtcagccagtccacagattcagccccacttagtgacttgcatctgtgtttctttttctttttcttttttttttgagacagagtttca

SEQ ID NO: 180190 - DNA, 287 bp, Homo sapiens
gcattaaagaatcctacttcacccacaagataatattcaaattcaaattccttagactggaatgttagacctctcacaatctgtccctgtttttccttttctccctgactcaccttgaggcatgtatcctttatactgaagctacccctacattatctggggctcctaaataggccctgttagaatgtttccatctggactctgggaccatctttaagattcatttcaaagactggcttcctttaaaagtatgaccttgcctattacctcacttagtacactctctc

SEQ ID NO: 180191 - DNA, 273 bp, Homo sapiens
agttatctgtttccttattgatctgtcttgatgttctgttcattattgagagtggtatattgaagtctccaactattgtacagctgcccatttctcccttctattctgttagtctttgtttcatgtattgggggctgtgttgattggtgcatttgtgtatataattgttatagctccttgatgacttgatttttttaatcaacatacgatacccaaggctaggtgctgggattacaggcgtgagccaccatgcctggccaatttttggttttt

SEQ ID NO: 180192 - DNA, 538 bp, Homo sapiens
ggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaag

SEQ ID NO: 180193 - DNA, 786 bp, Homo sapiens
atgacactgtgacaagggtgcagtttttttgagaggtcttggttaataattaaaccaacaatgccccttacaagctaagtaacatttgtcaacttacttattccctctaagcactgattttctccaagtcacagagtttatcactaactcagagggttgctgaggctccattaaaacttgataggtgctaatcactgaaaagattgggagccctactctcccacaagttactcaaagtaaacacaaggctactctgtaaaataatggtaaaagaagtcaacaaagttctgatttttcctatgatgaccacagtatgctattttatttctttaggaatatcacgttcccaaaagataatttggtaggatcctactttactaatgctcaaagcacctactccacttacagagaaagccgagctgtgcaggtattcatcccaaagcttcacactactagtgctaaatatatcaaaacacaggcttttctagaagtgatagttacagaaacaattactttcttcaaacatttattccagaaatattctatatgatatactcgtttatttttacaaatgagagagccgtgtttggaaatgcaaacctatgtgtatgcaaaagcttatattgtgtaatattcatgattaaagtcttagggaaggtccctatccctgcaggagtgcttaagtaaattgtggtacatcctcccaattgaatcctatgtaaccattttttgaaaaacacaaaacaaactaaagcctctatgtactgatatagaaaactccataac

SEQ ID NO: 180194 - DNA, 757 bp, Homo sapiens
ggataacctttgcttgagaaaactttattcttcttcacctgtataatttattctggcaacttccgaatgtgttttcctaaagcttcttccctgattggaaggaggtttaatattttgtgacacatgcaaacttaacagcccctatgtgaaatattttctacttttgaaggtgtgaaactggttaaaatgttttaaaacttttcccttaattgcaaaggaaatgtatgtacatgttagaagatttagaatatatagataagccaataaaattaaataacagttctatgttgacactttttgatgtatatctttccatacattttctgtgctgtgcactcacacacatacacacatgcatccaaatggaataaactagtgaaactttacacaaaaacacataagccaaagtaataatgattaatatttggtagtgtggtttactaatacatactgcttgatatgagctttcttggaattttaaatgtaggtggaacccaaacctttttcaaaattttactttaatgcttttaagtttgagttgtagtggtaatgcaaatgtcattaccttgaaatcattctttctcaaatgatagagttctcacaatacacgccaggaacgtactgatgggattttatttgtgtgcttgtttgttttcattgaactgtttgaattaaactcttagaatcattcttatggtttgaatcgccattacttaaaaagtaattattattatttctgaaaatatctccagtaatt

SEQ ID NO: 180195 - DNA, 504 bp, Homo sapiens
gattcgacggcttcaacggaactttaactagacattttattttgcgctttcactaactacataattacctgcactactgccaaatacaaagttctgtgaagatttggtagcataatttttttttctcattctgtcccccaggctggagcacagtggcgcgatctcggctcactgcaacctccgccacccgggttcaagcgattctccttgcctcagcctcccgagtagctgggattacaggtgtgagccaccacgcccggctaatttttgtatttttagtagagacgggtttcaccatgttggccaggctggtctcaaactcctgacctcaggtgatccacccgcctcggcctcccaaagtgctgggattacaggcgtgagccactgcatctggccccaacatgtactttcactagatattttattttgcgctttcactaactacttaattatctgcactactgccaaatacaaagttccgttgaagccgtttggtagcataaa

SEQ ID NO: 180196 - DNA, 709 bp, Homo sapiens
tcttggaggctttgttcgtttctttttactcttttttctctgaacttctcttcttgcttcatttcattcatttgatcttcagttactgataccctttcttccacttgatcgaatcggctactgaagcttgtgcatgcgtcacgtagttcttatgccatggttttcagctccatcaggtcgtttaaggtcttctctgtgctgtttattctagttagccatttgtctaatcttttttcaaggtttttagcttcttggcgatgggttcgaacatcctcctttagctcggagaagttggttattaccgatcttctgaagcctacttctgtcaactcgtcaaagtcattcagaggaaggagttttggaggaaggagagacctagggagggttttttgttttgtttttgtaagagaaggatgttggccaggcgcggtggctcacgcctataatcccagcactttgggaggccagtgcaggccgatcatgaggttaggagattgagaccatcctggccaacatggtgaaatgccgtctgtactaaaatacaaaaaattagccaggcgtgatggtacacacctgtagtcccagctacttgggaggctgaggcaggagaattacttgcacctgggaggcagaggttgcagtgagctgagattgcgccactgcactccagcctggcgacacagcgagactccgtctcaaaaaaaaaaaa

SEQ ID NO: 180197 - DNA, 762 bp, Homo sapiens
cagcttgaagccttctagcttacacagcaggagtttctagaaattttaccgctgagtcctctctggctctgagcctgtcctcactggctgcttcacgtccctctctatgctgccatctcaagtttttatggctcagagagttcctgtcacttccctgctgaattcctgtgttcttccttagaaactctattctatttttgattatctactggctgttttgtttcttcttcgtggagaaggtaatttgaaggtagcagtatttctctgaattctaggaatgctcaaggtgttaccaattgtgataatgctacgaggtgaggcctttaagaagtaattaggccatgagggctcttcttgcaggaacggagatccaggatgagttcagaccctgggctatccatggaccatggctgacccttggcctaaagccacatatccaggcctatgaaatggatttgacccatctgtgatctgattaccccaccactgcatgcctacagcacacaaggaatgcgaaaacatcatgttccagggacagtcttcatttgcgctagacaaaagacaaacaatccttccttgaatggacccactcttcttttttcactcatctcctctcactgatctccctgctggtggtggcggatagaaggcagagatgtggtcaacaccaaatgagattatgttctgggaattcagagattacagtctgaagaattcaagataaggtatgatgcttctaaacatatgagtgtctcttttctc

SEQ ID NO: 180198 - DNA, 1040 bp, Homo sapiens
  misc_feature (698)..(698): n is a, c, g, or t
  misc_feature (724)..(724): n is a, c, g, or t
  misc_feature (750)..(750): n is a, c, g, or t
  misc_feature (1040)..(1040): n is a, c, g, or t
cagcttgaagccttctagcttacacagcaggagtttctagaaattttaccgctgagtcctctctggctctgagcctgtcctcactggctgcttcacgtccctctctatgctgccatctcaagtttttatggctcagagagttcctgtcacttccctgctgaattcctgtgttcttccttagaaactctattctatttttgattatctactggctgttttgtttcttcttcgtggagaaggtaatttgaaggtagcagtatttctctgaattctaggaatgctcaagatccaggatgagttcagaccctgggctatccatggaccatggctgacccttggcctaaagccacatatccaggcctatgaaatggatttgacccatctgtgatctgattaccccaccactgcatgcctacagcacacaaggaatgcgaaaacatcatgttccagggacagtcttcatttgcgctagacaaaagacaaacaatccttccttgaatggacccactcttcttttttcactcatctcctctcactgatctccctgctggtggtggcggatagaaggcagagatgtggtcaacaccaaatgagattatgttctgggaattcagagattacagtctgaagaattcaagataaggtatgacctccataaagaaccttcatatcatcttgccctgcatgaaatatattanaagcctttgctctggtctttcatggnacttttaaaggatattatcatttacnaaatggaataccaatgatctttcacaagggggtttatcaacttaagcatgtaccttaagtaaatattttgagaggaatccattaacctctggatgaatatgctaaaaaaaaagatgaaacagattttagttgcccggtgtttattttgtaaataaaatgtatgtgccaaaatgtccttaccaaatacacaatagttgctcgagtggcatggccaagatcaaaaaccctaagaagataacttgggtttagtagagatttaaaaaatagaccttgatgcggccgttaccttn

SEQ ID NO: 180199 - DNA, 1000 bp, Homo sapiens
  misc_feature (698)..(698): n is a, c, g, or t
  misc_feature (724)..(724): n is a, c, g, or t
  misc_feature (750)..(750): n is a, c, g, or t
cagcttgaagccttctagcttacacagcaggagtttctagaaattttaccgctgagtcctctctggctctgagcctgtcctcactggctgcttcacgtccctctctatgctgccatctcaagtttttatggctcagagagttcctgtcacttccctgctgaattcctgtgttcttccttagaaactctattctatttttgattatctactggctgttttgtttcttcttcgtggagaaggtaatttgaaggtagcagtatttctctgaattctaggaatgctcaagatccaggatgagttcagaccctgggctatccatggaccatggctgacccttggcctaaagccacatatccaggcctatgaaatggatttgacccatctgtgatctgattaccccaccactgcatgcctacagcacacaaggaatgcgaaaacatcatgttccagggacagtcttcatttgcgctagacaaaagacaaacaatccttccttgaatggacccactcttcttttttcactcatctcctctcactgatctccctgctggtggtggcggatagaaggcagagatgtggtcaacaccaaatgagattatgttctgggaattcagagattacagtctgaagaattcaagataaggtatgacctccataaagaaccttcatatcatcttgccctgcatgaaatatattanaagcctttgctctggtctttcatggnacttttaaaggatattatcatttacnaaatgaatacccatgactgttggcatgtgagctatcaacctaagcatgtgcttgagtgaaatattttccgaggattgccttatcctctcggggaatagttgtaaaaatagaaggaggcaggcatatgagcctgctaaggtggcgaaacgaggggatgtgcgaacggcattcaaagtacaatttacgccgttgttgtatttcttgtggagagctctgtattagtgctaaggactagaacaaattggtgagc

SEQ ID NO: 180200 - DNA, 206 bp, Homo sapiens
gaaagaaatgcagtttcaagacaaaaagcacaactaattctctaaagaaaataattgagcattcaatctttgattagtctgtcaaaaaagataaaatatctttgctaattttaatacatgctacactgactcatttttagattgtaaagtataatctataaggctgctgaaaagcagtgactaataggcggcgtggggtaggaggt

SEQ ID NO: 180201 - DNA, 455 bp, Homo sapiens
ctgcagtgagtgaatgtaaaaggatttctgaagcggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagagacccaaatggaaatcctaatactgggggagggagggaataaggggcaagagggctgagggagttgtggatttgttgtttttgtaattatctgtgggtttttggggggatgctgtaagtgaaataaaaaaactagatttcttctttttctggcgtattgcatcttgcaatttcaagacatttcagaaatgtctgtagcagaatagctccttgtatgcctaatcctcagtcttgttgaataaatgctaaagtc

SEQ ID NO: 180202 - DNA, 488 bp, Homo sapiens
gcgctttatgtccccctcgcttagctgcagaactgaggcaacaccaggactttcacaatattacaacacaattttccaggagcttcgctcatttaagtctttgcaatgtcaccccctcagtaaggtcttccccagctaccctacttaaaatccaacttccactccagtactccctttctcccttctgccccaacccctgctttagttttcttcactgtacttctcacttaggatacagtagggagatccctactgtatcctactgactttatccgggtctaagatctcctatttgggttactacagcagctaccgtcttccttggttcattacattctctcctcactctaacttaacctgtagatcattaacaggtttaccttcctggtttaccacattaatccctggcctccaaactttcaaaggctctctataccttgcacaacaggataaaagtagaaatctcctcaattcagcactcaaactct

SEQ ID NO: 180203 - DNA, 573 bp, Homo sapiens
tttgatagcacatgtagagtgactacagttaacactagtttattgtatatttcaaaatagctacaggagaagatgtgaaatgttcccaacacaaagaaatgataaacattcgaggtgatggatatcccaactaccctgattggctcattacacactgtatgcatgtatcgaattatcacagggaacccataattatgcatagctattatgtatcaattcaaaaatcagtgaaacaactgaaacatgaatcttaaaccaacatcactattgttatcaatattttattcaaacaagtttttatatggtacaaagctatgtaaacagtgagtgtctaaatgcaatcagattgcattagaccagtacccacacctggctctttctacaaccctacagctacctcggtgaaaaatagcacttaggtgttttggtataaggtaattttatttctaaacttctcttgtataactgccatctgcttcaaaatgataaacatgctaaagcaacagcacgtatattgcctacataaatctaggattcatattttcacctgcatttcagatgggtacactgtta

SEQ ID NO: 180204 - DNA, 607 bp, Homo sapiens
tgcgctcctctttgtctgaaaaatccattctcctgttgactaacatttgttttttccaactttttgcgaatacaaacaacactaaaatgagtatttgtctgtttctttacatatctaaagtttataactagaaatggaatttctagcaagaaactgtaaaatgctttgtaaaatatctgatgaaatgtcacactgtatagtcattcacaaacatgtcatctttcacttttgattagggcagatgtcttctgttgtaatttttgttgttgttgtttttgagacggagtctcgctctgtcgcccaggctgaagtgcagtggcaccatctcggctcactgcaacctccacctcccgggttcaagcggttctcctgcagccccctgagtagctgagattacaggcatgcgccaccatgcctggctagtttttgtatttttagtagagatggggtttcacaatgttgtccaggctgatcttgaactcctgacttcaggcgatccacctgcctcggcctcccaaagtgctgggattacaggcatgagccacagcgcccagtcctgttgtaaatcttttatcaagagatcttggttagacaaggggaaacagta

SEQ ID NO: 180205 - DNA, 670 bp, Homo sapiens
tttttgtgatttatctcctctttgtaaataaatattcacttttgaacctagttttgtctttgaaattagtttgctttttcttgaagagtattcccacaaaagccggatttgcagctagtcagaaagaaagatttctttgcctgcccagagatgtaagggagaaggaaaccagacttgcatggaagaccttcaggagagcccctggcaggagcagaagttcttttgaaaatatgcatagacaggctaatagcatcttagggaggtccttagaagaaaaggttcagacttggctagaaaggcattttctgcccaaaaacaaaacaaaacaaaacaacaacaaaaaaaaccacccaataactgataactggctgatacagtttggctgtgtccccacacaaatctcatcttgaactgtagttcccataatctccatgtgttgtgggagggacccagtgggaggtaactgaatcatgggggtggttactctcatgctgttcttgtgatagtgagttctcatgagatgtgatggttatataaggagctttcccccccattgctcagcacttctcctttctgccgccaagtgaagaaggacatgtttgctttcccttacgccatggttgtaagttccctgaggcctcctcagccatgtggatgtgtgagtcaatta

SEQ ID NO: 180206 - DNA, 471 bp, Homo sapiens
tagttagtaaccaacatggaaggtatttatgattggctacaagaagcaggattcaaaggcctgcagtgtgtctggatcaggaaagaggtgactataaagaagccatgagtatataagaaataggtatacaataaattggcagtctaaagcacagactagcagagattggcaaactgtctctgtaagccacttatagtcttggttacatattcttttttcttttttaaaaaaacaacgctggccgaggtgggaggatcacctgaggccaggagttcgagaccagcctagccaatatggcgaaacctcgtatctactaaaaatacaaaaattagctaggagtggtggtgggaagaaacaaccattcaggagtgcctaccttctaacctcccacctggctcttcacaattgttcctcctctagaaaaagaaaagagccgggaacagtgctccaagcctgtaatcccaacacttt

SEQ ID NO: 180207 - DNA, 483 bp, Homo sapiens
ggatccataagagaaacgctaagagaaaaaagcccctgtctgaaaattaagcatcagaccacttggatgacttttcagtttcatttacagtagcaaaggacaaactcacacaaataggaccatttgggaatatatgaccaggcggaactcagaccaaaaacttgacaaattccaatttgtctcaaccaatactattttacctatggcctcccctgccgcaaaagaagggtttagggcgggtctttccatttgtgcactcgagtggctttccagcttcacatgcctgggatataaaggccaaggtgggggactcaatcctcataacttggaagagcaccacatggtggacagtacactggagtgggtgactaatcccagctctgtgaacaccttgtggctagacgtccacaaccatctctccaacagccatctgacactgtgggaacagtagcagtggcggctgcagcagcaatcgctcccttg

SEQ ID NO: 180208 - DNA, 492 bp, Homo sapiens
caaatcatttatataaaaaagacgtttgtttgtttgtttgttttttcccctaaattcgcctgttaagatgctcagtttctttccttgtgttgtttatgaaagtccagctttgtatgaaaactggaaagtccggggtttcgcgtgagttgtcctgatctccttgcttgccccaggcatgaattatcaggctccctggccacaggataaaagtcacctcacaactgatggatgggccttatgataatagaagatcttaatttgagacaacatgtgggtccatctcacgctgtcatttttaatagtttatgaactgtaaactcagtagtatattagatataatgggaaaacagcaaattttgagagattaatggctagagtaaatcagttcaagttgtcaaattacttatttattataaaaagtatgtttgggccaggtgtggtggctcacgtctgtaatcccagaactttgggaggccgaagcgggcggatcac

SEQ ID NO: 180209 - DNA, 137 bp, Homo sapiens
ctgtaaataactttttctctatcatttagttacactgagttacagcttattcaaaaaactaggataaatgcttgattcttttattattatttttttaattatgagttagttccctgccattttccaaaagtaactac

SEQ ID NO: 180210 - DNA, 463 bp, Homo sapiens
aataccatttagacaaaaggagatagacttaaccttgatctgattaggtccttttgttggccccaagttcatttaaaaaaaatgctgccccaaaataaaattttctgaagcaaatagtttcagagagcaagagtgaaatcaatgggaatttatgttacagcagatttcaactgtttttacgttttctataaagccttaataactatatttcattgaaggaatagtcatacttgtgaccactaaaattactggaattcagtaaactgcacaaaactggactcgatgacttccaagcttctgtcctaaccgagactttttattctaaatgaaaagtcaatatcacaattatactacaattacaatctgaaaatatttcatttcagtattgagatattctcagcgcctgatacagatccataatacaatgaatttctcccaagaaaggtgcttcaaggacagcatg

SEQ ID NO: 180211 - DNA, 110 bp, Homo sapiens
ttatattaggtaattctttacaagcaaagggaattgcattttaattgttaatccttgccttgtgatagccagaggctatggaaccccagcaaagatgtattttgctaaaa

SEQ ID NO: 180212 - DNA, 341 bp, Homo sapiens
tgttaatagttgttaatgtttctgcgtggaggatgtctcagctctactaaagtttaaggatctcagtggatctcagctctactaaagtttaaaggccactgttttacttggatcaccttgatggattgctttagagcagcagtcaccaacctttttggtaccagggactggttttgtgcaagacaatttttccacaggtcggggttgcaggggggcagatggttatgggatgaaactgttccacctcagatcatcaggcattagattctcataaggagcgtgccacctagatccctcacatgtgcatctcacagtagggtttgcattcatgtgagaatctt

SEQ ID NO: 180213 - DNA, 1386 bp, Homo sapiens
tgtgtgaggggagaccagagtagctgttgcacatacatcgactctcttaatattgaagcatatttaaacagttgtttgaagcagagctagaaattaatggtgatacttctaacagcattttgatgttataaatattactttaagtttatcaagagaaaaattccagtagtagcttgcgttataaaattaattgatttattatgtttctgtataattttattgaaattgcttttttgtggtgaatataatatagtggcaacgattttgaggaatctttaaagctgtttggaagagatggccagcctttggctagatttttactagaattttgaaataagaaagtgtataaatatgttttcagttaaattagccttgaggaagaatagttattatatgagttttaagggtcttgataaatgttgggacctactctaaaactcatgaggttcctcactgatcaatactcttgcattgtattttatttctcaaaataatgaaatttttatggaaaagctcaattagtggaatcttttattcaatattcccttactcttctttcttccttccttctttctttcctttcttccttccctccctccttccttcctagttctttcattttttcaggcaagaagcttccttaataatatagtttctacagagctttcttacttatttttctaataatggatataacagtgtgataaagtttaaatgctccgtgagcaaaactcttatcaaacaactgaagaaatacactgctgattaaccttttccttggtcttgaattgtctccagcatatttgctagtgactaaaccattaatggatcttattagtataaacacatgtctgtgtggttatcaacagtgttgtattattgtcacatttatttacatttttggtcaaaaatataaacatgcgtgtgtgaagcagtctgttttatagagtgagcatatatgtaatcgttttcatataattgaaaatgtgctgtgtgttgcattttattctcatgtcgacttttctactatgtatacaccgattgtctcggtgcctttttccttttgtataattgtattacatacagaaattgctgacctctgtgaaaacagtgtaaaaaaagttaaaattattattccgatgagattttaatggcagtttaattttccagagaataaattttgtgtgggttaaaagttatttttcttcacctttatgtaaaaaatctgtttacgttttagtactcacatggaatgggtaaacatctgacttcattgatgatgatacataaacatcagtcctaattcttgtcattgacaaataaatgttaatatgaaactgctacggcaataatatctcgggggggggcgggggggggcgggggggg

SEQ ID NO: 180214 - DNA, 1374 bp, Homo sapiens
tgtgtgaggggagaccagagtagctgttgcacatacatcgactctcttaatattgaagcatatttaaacagttgtttgaagcagagctagaaattaatggtgatacttctaacagcattttgatgttataaatattactttaagtttatcaagagaaaaattccagtagtagcttgcgttataaaattaattgatttattatgtttctgtataattttattgaaattgcttttttgtggtgaatataatatagtggcaacgattttgaggaatctttaaagctgtttggaagagatggccagcctttggctagatttttactagaattttgaaataagaaagtgtataaatatgttttcagttaaattagccttgaggaagaatagttattatatgagttttaagggtcttgataaatgttgggacctactctaaaactcatgaggttcctcactgatcaatactcttgcattgtattttatttctcaaaataatgaaatttttatggaaaagctcaattagtggaatcttttattcaatattcccttactcttctttcttccttccttctttctttcctttcttccttccctccctccttccttcctagttctttcattttttcaggcaagaagcttccttaataatatagtttctacagagctttcttacttatttttctaataatggatataacagtgtgataaagtttaaatgctccgtgagcaaaactcttatcaaacaactgaagaaatacactgctgattaaccttttccttggtcttgaattgtctccagcatatttgctagtgactaaaccattaatggatcttattagtataaacacatgtctgtgtggttatcaacagtgttgtattattgtcacatttatttacatttttggtcaaaaatataaacatgcgtgtgtgaagcagtctgttttatagagtgagcatatatgtaatcgttttcatataattgaaaatgtgctgtgtgttgcattttattctcatgtcgacttttctactatgtatacaccgattgtctcggtgcctttttccttttgtataattgtattacatacagaaattgctgacctctgtgaaaacagtgtaaaaaaagttaaaattattattccgatgagattttaatggcagtttaattttccagagaataaattttgtgtgggttaaaagttatttttcttcacctttatgtaaaaaatctgtttacgttttagtactcacatggaatgggtaaacatctgacttcattgatgatgatacataaacatcagtcctaattcttgtcattgacaaataaatgttaatatgactgttacacaaaataaaataatgtcaattacataaggaa

SEQ ID NO: 180215 - DNA, 1163 bp, Homo sapiens
tatactctaatcacataagtgacaacctgacattttcaccatagtctgttcatttgaagtgagccactaggtccagcccacactcaaggagagactacacaagggcatgagcaccaggaggcagggacgcactgagagccatgtcagatgccgcctcccgccatgtgtgatgaaatacactatagacacaactgttttaagagcctaccagttttatgaacccaagtatgtctttttagtagaacatctaaatctagacagctagaagaactacattttataaaaatctgaattttttttttttttttgagacagagtctcactctgttgctggtgccagagtgcagtggtgtgatcttggctcactgcaacctctgccccctgggttcaagcgattcttctgcctcagcctcccaggtagctgggactacgggcttgtgccagcatgcctggctaatttttgcatttttagtagaggtggggttttgccgtgttgcccaggctggtctcaaactcctgagctcaagcgatccacccgcctcagcctcccaaagttctgggattatagcgtgagccaccctgcacctggcctgatgaatgatttttaaattgtgactcccctatgctcaaatgagattggatcaaatgtcttctctagcaaataaataattccatagctagaaagatctttggtaggtagtttccttcctcttgtgtgttccctgagctctcctactgacgttttggaatattttcacagattcttgaatactcctccctgccagaggtaaagagcttaactcttatcctcttaagtgtggactagatttcgcgacttgcttctaatggatagaatatggtagcagtgacagtgtgtgacttctgagaatagctgtaaaaggcatcgtagcttcctcattgctgtttttcttggatcacttgctctggggaagcccagcagccatgccgtgaggacactcaagcagcctttgaaggagctgctggtgaggaactgagtcttcctgctgacattgacatgagcgaagcatcttggaagtggatcctttcatttttcaggtaccgtgccagggcctgtgagggaaccaagacgtgtaagacatggcctctcattagtgtttaagcagtagagaaagctggtgcca

SEQ ID NO: 180216 - DNA, 394 bp, Homo sapiens
ctttctcctctcagtcttctacttttgtctctcatccttacaacccaactgaaagccagagggcaaggtaacacatagctgctggtctcccggggcacaaagcaggatggcaagaacagggaagcctggaaatacccaagctcaaaataatttttcttcacaacatcatgtctctgccttctcatgcctactagtggcagtgaaatatttctgtaccagtctgaagtttctggttcacttctggaagtgaataagcttctcttgacacttggtgctttgaaatttcctgggaataagtttatgtctaggtcattttgtattcatgctaccaagaaatcagtggacattttaaatctaaaacctcagatactctcagaacctcagttctaagaaa

SEQ ID NO: 180217 - DNA, 238 bp, Homo sapiens
tcagttattctacactcaaagtgacttggaagtttgagaaaaagttattctccaacctccctctccaaatcatactaaaacaaacaaatcaaagagaggagaaaaaggcaaagtatttacaggaaaataagctacaaataactggaactaagcaaagaaagccgaatagattactatgttggtggtaaaaactctttaaggagagtcaaaagaacagaagcactttggacctttgtct

SEQ ID NO: 180218 - DNA, 432 bp, Homo sapiens
agagacaaattatcaaatattagaaacagtaacattttatttttataagttcccaaataatactgccactgacacaagcatttggacatgctagcaggagagaccctgcatacttgcttccagtaaagcagcgctttcccaaatgctccataaaagtgccccatctattgaaaacaccctccaaatggtaagttctatatccctggacttggcatataggagagtcagttggtgcaaaagtaattgtgatttttgccattgaaagtaaggctaaggccccaaatacttttgtaccaacctaatagctggcaaataacactcgaattttattttcacttattcctgaccctgaaagttactcgtttgtaaagaagaggattcttttctgattatttctaatagtgaacatgaatgatgtgtgaagtacaagaa

SEQ ID NO: 180219 - DNA, 547 bp, Homo sapiens
tgggattacaggcacatgccacaatgcccggctaatatttttgtatttttagtagagacggggtttcaccatgttggccaggctggtgttgaactcctgacctcaagtgatctgcccgtcttggcctcccaaagtgctgggattacaggcatgagccactgctcccagcagattatgaatcttttagttaacctatgaggtagggagggagtgggagtaggggggatgctaggtcttgtttgaagatagtctgttattgaggattatgtttcctacagaagtatgaccctgttggaggggagggggagagaaagagaaggagaaaagaaatcctacagcttcttcctctttgcctaaaaattccttgatatatcctctcttccagtcctctagtttctaagcagaaagattgctactcttctaagagctaaaccctttacctatgtctttgatctcaatcaaacttcttacctcttctgagtaaaaacttaattactctttttaatatttaaactgtatgcaagctgagtacagtggcccacacttg

SEQ ID NO: 180220 - DNA, 182 bp, Homo sapiens
gaagagcattgtttgtggcaccttccacttctgcagcactcttggatgctgactatttacaaggactttcaactgcctccttcacccatctggtattaatttttatttcttcgttattgagtctctgattcatctctacgcagacctttgagtttcctgaaggctttgcttccccagacagg

SEQ ID NO: 180221 - DNA, 639 bp, Homo sapiens
cttgtgatcctcctgcctcggcttcccaaagtgctggaattacaggcgtgagccaccacgcctggccacggtgcaccagtttacacagctttctctagcacatacctgctggctgtcctccaggatgcacggaagagaggatgcatccttaagctccatgtctaatattccttaaatgtcatcaccaataaacacactggttaaggaatgtgcctcgaccaattcttttttttttttttttgagatgagtgttgctctgtcgcccaggctggagtgcagaggagccatcttggtttgctgcaacctccacctcccgggttcaagcgttcttgtgtctcagcctcctgagtagctgcgattacaggtgtacaccaccacaaccaactaatttttgtatttttagtacagacggcgtttcgccatgttggccaggctggtcttgaactcctgacctcaagtgatttgcccaccttcgcctcccaaagtgccaggattagaggcgtgggccactgcgcctggcctttttttttcttttttgagatggagttttgctctgttgcctagcttggagggtgtatgaatttttaacaaaaaaagcttaaaaagtataaaataaaaatttttttaactagaaaaacc

SEQ ID NO: 180222 - DNA, 434 bp, Homo sapiens
gcggcgccctttttttgtctaatcacatctctacatgttcagctctctgggagctcctcaaaccctgtcctcttccgtctcttatggagactttattggatagtcatgattaaagtacagacaaccatgtagaaatgtgattagacaaaaaagggtatgatctaatattaatagactgagtgtgaaaatccagcaaggattgtctgttcagattcttcttggtctctctgtgtagctttccttcctccagggtatgggggaggaccccttctgaaatgaaggtcttgtggccttcaattagacaaggaaggtcagagaatttctttatggccagctccaagatagaaaggttgggggagatgagattatatttttagtttctacggcctgccttggggagaaaaaggagcaggcgaaaaaagggcagaaggtca

SEQ ID NO: 180223 - DNA, 604 bp, Homo sapiens
ctgggctgaggagtatggatattacagacttgggtgtttatctcatatttgcaatggaaaatcctctttaagagcaaccttgagacaattcaatagttcacaaaatcagtcaaggaaagctaaaatcaaccatccccaggagagccaaattcaacaaaaacttccctcaaaggctcactcactcttaccagcagaaggtgtgatgtgtggagctaatctaaaagcaaattcacggtgggtaaaataataaaagaatgcttatatgaagcaaaagatattgcttttcttgatcaaaaaaccaaaacaaagcaagatatcacttctcattatgccctgttcttgcagagtagtaatgactcaatgattatcttgagaagcccagtatcataaagatactcaagggtgcgcaaaatgcctctgagttctttgcttcttccagcataagggttatctacgtatctcttcattttcccattcacacctattccttccagagctattgctcatctctgccccttcaggaggaattttcagagggaattatctttactcattgtcttttttttttttttttttactttccattgactccatagtccattcc

SEQ ID NO: 180224 - DNA, 452 bp, Homo sapiens
cactggtcccacacttcttaacagaataaaaggatgagccctaatacctgggcaccatattcaaggttctttgcaatccttgctcggaaatctctccaacttcatctacaattattcaacccttctacctacttctctctctggtgacactagatgttgttatttccagaatatgctctgaacttgtgcaatttaacacatgctattcactctcactggaatgttactctcttattccataaaaaatcttttcctatctttcaagattcagctaaaacatctcgccctctagaaaactgactccaaccctctcctctcaccctgagcagttatttgctcaccacctttatttatttatttatttagcttatttatttattttggaaacaggtctcccggtctggtcacccaggttgagttgcaggaaacaggaccggttaccgagctcgatt

SEQ ID NO: 180225 - DNA, 369 bp, Homo sapiens
gtagtttatcctattgagaagcgtagataggatgcttattagcagtaactgctcttggtttcaacttgcatcttacttagctttttcaccgttttgtggtttcttggaggaagaatacccataatatacatttggagactgttgttctgtagtgtcaatgaaatgtgggggtgggaaaatgtcattcaagactcccatacaaaatgtctattgctgcctatattttgctatgggaaagtagccacagataatgttttttttttcctcattagtattttaagattttccatcctagtggaaagatatgatttgattcatcctatttactttgtatattaaagtacagtagaacctgccactttttttgga

SEQ ID NO: 180226 - DNA, 404 bp, Homo sapiens
ggaaagaaggtaaagcatcttctccaaggactcactgccctaaataacagagttattgtacctcaagcccttaacccaatcacagggcctctattaacagccctgcacctagactagaaagagagtcattactaaagttgaggcgaacatctcccttatggggtgatggtttagaggtaattatgccttggctgctattctattcccctctgttctctagcctgtactcccctttgtctttaaataaatgtctcagggccaggcacagtggctcacacctgtaatcccagcactttgggaggcggaggcagcagatcgcttgagcccaggagttggagaccagcctggacaggaggatcactcgagcccaagaactggaggctgcagcgagccatgattgcacc

SEQ ID NO: 180227 - DNA, 350 bp, Homo sapiens
caggccatagaggaaacattggtcttgactcttgtttcagaaaataaggtcccagcaaagtcaatgggttaggaagtgtgggagccctgttctctgatgactgttggaaacgagattcatggaaggaagcctgggctctcctgactctgtgcttcagtgtccaggcagaatctcctcagttaattctccagaagagagcccccacccttcctctttatacactctggcaagggagctcctaatcttgcagtcccaggctcccaaaatctctgtagcagacatttttgggggtcccccatctcctgtccaaaccttggaattcgtaatcattttagtgcttagggaaagag

SEQ ID NO: 180228 - DNA, 706 bp, Homo sapiens
ccaacccttctaagggtatgttaggcatgtgattacctgcagagaatataaaagcctgtagagcactccggagatcatcgagatgtatagtcttggtgaagaattactatacaatgaaggttggcaaagaagccaaatataattgtttagaaaccgggtttcacactataaagttgaaagggttggtagcccactgctagaagctgttaattatgagaccctcagttaatagactttgtcattaaaaggcatcaaagtattcctaattactaggttcacataaggaaacactgctagctcagaaggtcaactaaaactggattaatagagttacccttacctgagtttcctctctgaaagcaggacaggtatctaaatttaccaactgggtctagaagcaaagaagctcttaaatctgtcttggtcttggaaagggctagaggaatgtcagagaaggtttcacagaggacatcacttttgaaggaatagcagaagtttgctgtgctggtcctgagaggtgaaagatgaggctggcaaggcaggcatgtgtagatactggccctaaacactgtaggcgatggaaaccactgaaggacttaaacagtgatgtgatcaaatttacagattagacactttaaacttctagcctatgtgtgcggagaggaaggggtttcattcactaacttaaggtaacttaagaggaata

SEQ ID NO: 180229 - DNA, 354 bp, Homo sapiens
aacttccaacacccactaggaagtgtctcttagaatcatacatatgacaacgcttaaaaacatgggctatgtcctcacacacataagttcaaatcttggttctgcctggtacaaaggcacatgatcttaagggatctctggtgatgataatcctgcttatcttccagggtggtgaagattacatgagttttccatattagatgctaagcatatttcctggcttgcagaaagagcttggaaagtgctagccatggtgactatcagttctttctcacacgtgccccatctggggcagacccccatcactgcacacctgaagacaagggagcttcctggctgctctcctgcccctag

SEQ ID NO: 180230 - DNA, 177 bp, Homo sapiens
agtcaagaattccaaagcaggggagatactgagacattagacgaaacaaaatattgaagtgctttttaggggagacagaacgtagccagtcttcttgctcatgccataagcacagggcccggggagaagaaatggcagccctgactgcccactacaccagtgtctcccaaatagatc

SEQ ID NO: 180231 - DNA, 281 bp, Homo sapiens
ctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaat

SEQ ID NO: 180232 - DNA, 364 bp, Homo sapiens
  misc_feature (1)..(2): n is a, c, g, or t
nngtcacccagacggtgatattttttgatattttgtgacagcagcccatacaaaccaaggctatcttcaagcaaacaatttagaagttcacaattttttttctgtcaaatatgtggtgttcgcaaattgaaagcatcttggatttcaggttagtatccctagtacatattttaaaacttatttagagattcaattgacttattttatttgagtctatgtccacctttctcctgaggcagagaatgcctctgccacaggtctcaaaatcctctggttaacacaaaaattacagaaaatgcaaaattccagcctaggaattaaacactctcatgtgtaaatttgtgtaatgtagaagtttaatagc

SEQ ID NO: 180233 - DNA, 514 bp, Homo sapiens
ttatcgttcgaggtgtgggtgttatcaagtgaattagtcacttgaaagatgggcgtcagacttgcatacgcagcagatcagcatccttcgctgccccttagcaacttaggtggttgatttgaaactgtgaagggtgtgattttttcaggagctggaagtcttagaaaagccttgtaaatgcctatattgtgggcttttaacgtatttaagggaccacttaagacgagattagatgggctcttctggatttggtatagggagaaataaacaatgtttattagtcctttgggctaataaagaatatctattagcacttccaaagctattagaagatgatgaggaaatcatgccttaagtgaagtaaggtagggtaagaaaccagcctgaaagtcttatatctaagtaaataaaataggaacaaatgacttttattggagattacacacagcccaggtaataaaaccacatgtgttatacctatgccacagctagatgctagattaaacaacttata

SEQ ID NO: 180234 - DNA, 247 bp, Homo sapiens
ggggttgaaccttgtaaagctacaatggtggagctgcccaaggcctgggaatatttacccaatgcctatagcccctttgtgtcttggaagtaagtaacttgtttttgcttttttattttacaggctcataggtagaagggactttccttgtctcaaatgagacttgggcttgggacttttgaattaatgctgcagtcagttaagattttgggagactattaggaaggcatgattgtattttgcaata

SEQ ID NO: 180235 - DNA, 671 bp, Homo sapiens
tatctcagcagcaaaatttccagataaatgcaatctacttcagtaaatgctaaaactccttaaaaaaaatcaccttgatagaaatcatcttaaaatattctctcaacttccttttctctgcaggtagaaaatattgcacagaatgtaactctctcggtatcttgctcatcatcgtgagggtaaatattgtacctttgtgtgatggtgtcattagggtttgttaatatgtgtggaactcattgtccctcaacatgagccatcccaagactactatgtactttgtgttcttttaaggtttgtcagggttctcttctgcactgctcccacgtgtcagtccccagcagcctcttgccacctcgcctcttctcatattttacatcaaataacttgctgtgactgaggaatgagatcgcatagattatcaaggtgaatgttaagcaagaataaataggccctgaatgcagactagatgaccccttccacaagttacctctttaacttgtgtgtggacaagcatgtgaactttcggatacgtatttcagcttctcagaagtgtgtctgactgagggtccatgctgtattctggttagttaaggtttcaagataaatgagctgtcattctgtgactcatcgagaactgttttaagcagctacacagccttggagaataa

SEQ ID NO: 180236 - DNA, 240 bp, Homo sapiens
tatctcagcagcaaaatttccagataaatgcaatctacttcagtaaatgctaaaactccttaaaaaaaatcaccttgatagaaatcatcttaaaatattctctcaacttccttttctctgcaggtagaaaatattgcacagaatgtaactctctcggtatcttgctcatcatcgtgagggcagagacagaaccaagccctgagggccacattaagcagtgagaaacatagcctagctcat

SEQ ID NO: 180237 - DNA, 401 bp, Homo sapiens
tatttcaactccattttgcagaaaagcaaactgaggctcacaagaggtagggtaatttgctcaagttcacacagacaacaaatggggccttgagctccttccagtacaccagggtctttcccagtggacatggaaggccaatcaaacaggaaacagggagaactggggataggagaggttgggagttgacacaggcccaggcccaacatcctgggctaaggaggaaccccgaggcatctgaatttgaatctgggtatctggcagtgatggagtgaaaggtcagcaaggagatgagaggaagaggaaagcagaattccaccagcctcacagcctgcctggaccatcccctggggagccagcctggagctctctgccagcccccgccccacccccagtggaag

SEQ ID NO: 180238 - DNA, 247 bp, Homo sapiens
tgagttcctgaacatctgttgcatcaacaatcacagtacctgtactaacatattactaaagactcaaacaaaacttggaggttcatgttatttgctttatttctgtatatgttaacagtttttcattaaaaaaattttttaaaactcttcaaacataaattccatgaatccacaaaagatcaacttaggctgaaattgggtggcaatgtaaataaagaacctctaataaaaagaaaaatcttgaatt

SEQ ID NO: 180239 - DNA, 196 bp, Homo sapiens
gggaaaacaaaggggtcaattaaagcatacagaagacacgaaaagggttgaaaacaaatatagagggggggtgattcaaggaaggctttgagtaagatgcaaggcttgaggtgaatattgaagaatagggacctagcttggcgtggagaggaggggagaggtcagatgggtttgtagaaaaggaagattagacaca

SEQ ID NO: 180240 - DNA, 660 bp, Homo sapiens
atcagtgctttcagaatgcccatgggcagtgctggatgctgctggtgcctcctgcctcctcgggatgcccccaggcaactgttgccctgtagattcccatttctcaggaggctgggtcatctcactcggtgctaccttgcttctctcactagccccttttttgcctctgccctgtacccatcctgggatcaagcatggtgttgacagagaggtgagactatcttgcaatgaggcttggctaagacataagctttgacagctcaccctggtcccaggaatgatgccgtggaggtggagccagcccagcccatctgctctaagggcagatcctgtccaagaccctgtgcctctgagcccagctggtgctgaacaatgactaaaggagaacgtgctgacagaaatctgaggctctcctcatcaaaggggtgagaccaccttactctctcttctcattcacagcgatttgtacacccatttgaatctaattttccctaaacaaaatgtcagagtgcaatgagaacaaagtatgacttatttggccctgaataatcctatggtccagggactcctatatagtagaaaccccacatatcctggcaagaaagagatttcttattagagagctgcccacacttccccctctactactgttgatgtctg

SEQ ID NO: 180241 - DNA, 1201 bp, Homo sapiens
  misc_feature (3)..(3): n is a, c, g, or t
  misc_feature (73)..(73): n is a, c, g, or t
  misc_feature (150)..(153): n is a, c, g, or t
  misc_feature (159)..(159): n is a, c, g, or t
  misc_feature (181)..(181): n is a, c, g, or t
  misc_feature (198)..(200): n is a, c, g, or t
  misc_feature (275)..(275): n is a, c, g, or t
  misc_feature (277)..(277): n is a, c, g, or t
  misc_feature (290)..(291): n is a, c, g, or t
  misc_feature (316)..(316): n is a, c, g, or t
  misc_feature (330)..(330): n is a, c, g, or t
  misc_feature (384)..(384): n is a, c, g, or t
  misc_feature (401)..(401): n is a, c, g, or t
  misc_feature (406)..(406): n is a, c, g, or t
  misc_feature (426)..(426): n is a, c, g, or t
  misc_feature (439)..(439): n is a, c, g, or t
  misc_feature (448)..(448): n is a, c, g, or t
ggngggctctcatgtgtgttcagggcagtgaggcagctctgcttcaggatgtccctggggcatctgtgtgagngcccccctctcccatgcagttctttatcctccagccatccagcccagggttcacctcagcacagggcatgaccccannnnagtgantggacatgtgcaaagccttttnaggtctaggctcagagnnnccaaccattgcttctgggaaattctatcacctaatgcaagttacaggacaggtcagactcaaggggtggggaaananacaccacctcttnntggaaggaactggaaattcatatanccaagcaagtgganacagggacatgtgattgttagagggcatgttcctaattaatctatcatttatangatatgtgtgaaataanatatnaatagttatatgtatgaatntgaatatatatanatatattanttctttagagacttaaatgtattcttgaaataacatctcccaaattttacctgtgttgtcatattctctgtggttatgttttcacaaacaaaagtttctatccttcatgtagactaatttttcatgcctctttcttgtggttggtgagtgttgtgtcttatcctatattgggaatatcacaatatattactgtgttatcttacaaaattgttaatattctttccttataaatttggttaattctaatgggattgactttttaaatactgtatgaaataaggatccaaatatgcatatctaatttttgaatttttagcaaaatttcccaccaacatttattgaaaagttcatatttgctcacataacttgatttttttacctgtaacatatatgaaatgtccatgagcaattatctggcctctcttccatcttcagttaacttatttacttttctgtactatgatgttaaaaagtaagtttcacttccagtatggtacaaatattgttctaacttcttcatttatttaataatatcttagctattcttgactaatgtgttatttaaaactttgaatcatcttattaacttccacaagcaaataaatgtttagtctcttgttgacattgtaataagcctccagatcaatgtggagagaactaaatgtttgacaatattgagatttccaatgcatgatcataatatgaatttcccacttattaatagccttttaataaatatataattaatttcgc

SEQ ID NO: 180242 - DNA, 523 bp, Homo sapiens
ggcccagcagggaccagccatgggaaggaccagccatgggaaggaccaccctttcactgagctctcaggctatccagagcctgatcaggatgggaaagcgtggaaactgcatattctgctccagcattgttcaaagtgctctgggtctcaggatagggacagcagcttttccaatggaagaaggcagggagcaagggacagagggaggaaggaaaggaaaggatgagggggagtgaaggggaggatgggaggagttctggacatggggagtttaagaacacaataggccaggggcctgtaatcccagcactttgggaggccaaggcaggaggaaggcttgagctcaggggttggagaccagcctggccaacatggtgaaaccccgtctcttctaaaaatacaaaaattagctgggcgtggtggtacatgcctgtagttccagctacttgggagcctgaggcatgagaatcgtttgagacccaggagctggaggttgcagtgagccagattgtccctgcacaac

SEQ ID NO: 180243 - DNA, 703 bp, Homo sapiens
gattttagcagactggaaaacacacaattctcatggtgtcaatgtttcaattttgacagcttttgccaacatggccatgcactgtccaaagggaccaggaaaatctgtcaacaacccagataaatgtgaactaggtaacagtccttatacactaggaacatagggactacacaatgtactagcagaaaataattctatttgcctttcagatatggactgaactgagtgtaaagaatatgtaacgcattatattctagccaagtaattagctttttaaaattataagttattaagttggtaaaaatatataccctgcaattcttatcttaaaaagtacagctgggcacagtggctcatgcctgtaatcccagcactttgggagactgaggcgggaggatcgcttgaggccaggagttggagaccagcgtactcaacatagtgagaccttgttataaagaaaaaaaaaatccaggattaaaagaaatctttgatttgtttgggatttattaatttaccgtattggaaattgaaacaatttagtaaaatgtagtcatttgaaaataataagcacattagcgttggtaacatgaataaaatattgttatgaaaaataactattttccgaaacaaaacactaaaaattagaaaagtggtattgtgtacacgttcagtaattaccgtggagggatcttagagtgaccgg

SEQ ID NO: 180244 - DNA, 338 bp, Homo sapiens
acgacggtttctctaaaagggtacagatctcctagaccatgcctgtaaccccagcactttgggaggcacagatggacaaacagcattgggaggccttagccctgctcctctctattccatcctgtagaggtcaggagtcaggagtcgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaa

SEQ ID NO: 180245 - DNA, 426 bp, Homo sapiens
ggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccac

SEQ ID NO: 180246 - DNA, 620 bp, Homo sapiens
agtcaggaaaatattgaccgagaaggcagtcattgacctgagtcttaaagaatgaataaggtttttacagatggagtagggtagggataactttccaggtataaggaagattttgtattccagggacctttgaatattttagaatggctagaaaacttggtattatgtagcacagaaaaagtggtatgactgaagagatagagaacttaccacaaagggtcttgaatgccatgatacatagtttggattttcttctgtagggagcaaggagttagtgaaggattttaaaagcaaaatgactcttgggaggtagattcaatgtgaggctaatctccgaggtataggaaatacaggaaggaggagcaacaggtcgggtagtggtggaagcaggtttggaaaatgtgattagttttgtaaacgtttttgagtttgaattgccactggggaaggcttttggaaatttatttccagagttgaagactgagctatcattgcagtttgctcagctatttactgagctatctactgtcaatttggatagtatctacagttttcattgtagatactggatacttggattggctggtgcaccctgtttgtgagactcactggagtttgaa

SEQ ID NO: 180247 - DNA, 374 bp, Homo sapiens
tgtgggagacatacatacctcagctacaaagaatggcactaaaggcagatttttaagcattctgtatactgttatgccagatacagagcttgtagtattgccactttaagtgtttaaaagcaaagcatgaggagaatgacaggactgagaataggaagagacaccgagagaaaaagagaggcagttaaatcccataaaaaataaagcccggaattgcagacatgacaagtcagccttgggcaacagcgagtgaccggtcaactggaggaggagggatttgtaactgtcctgatggaagattttataatgtgttgaagaaaaaatgatcagagatgacttatactttcataactgaccactcccttttgaatctt

SEQ ID NO: 180248 - DNA, 588 bp, Homo sapiens
accactgcagatttggctcttttgaaatgactgtgaattacctgtgaaaatgataactaaagggttaagatttcaaaaaaagagaaggttcaatgaaaaagagacttgcttcacatataagagaaacacaaacatggacaactgactatgttttctcatctttcaaaaaaagttggactaaaatatttttggcacaacagtaaccagcaacaaacaattggttctagtatgagaaaaaaactgtcgaaatcttcaaacaaaaactccattccaagaaaacacctaccacaccaggcagtagtcttcaaactgtttttgttgttgttgttgctttgagaaagggtctcgctctgctgtccaggctggagtgcagtggcatgatcatagcccactgcagccttgatctcctgggctcaaacgatcctcccacctcagccttctgagtagctgagatttcaggtgcccgccaccacgcctggctaatttttgtatttttagtagagacgaggttttactatgttggccagggtgatctcgaactcctgacctcaagtgatctgcccacctcagcttcccaaagtgctggga

SEQ ID NO: 180249 - DNA, 447 bp, Homo sapiens
ggacctccaaggcctctgggagccccagccttgtggctttgttggtctcagtccacctggctgctctcgcgagttggagttctgtgcctgtaacttccttaggctggtgttacatgctggtagctttacagttccggagtctttgtggcagctgtatcaccgcaatgagtctctgcctaccccccgccacctcccaccctgtcccgggctatttgtgacatcctttgaaatctagttggaagaagccatgttctcatggctcttgcattctgcacacttgcagaattagagcaccacgtggacaccaccaaggtttacagcctatatcttccggagcggtagcttgagctgcacctggactggccggagccacagctgtgctggctgaggaatgctaaggggagcagagacttgtggcagcacagggcaatgaatggtgacctcgag

SEQ ID NO: 180250 - DNA, 296 bp, Homo sapiens
gttcaatactcctcattttgtgattgagaaaagtggagcccagagaaattgcacgaactgcctacagcaagatgagttcattggtaaactgtgggctataacatatctgcattacccaacattgctcccaagtgacatccctcactaggtttcacaggacaagtgaatcagggagctgaggcatttctacggtgggatggggaggctgctaagcccagaagtttctaggtaatgagcaaaacaatgaacaaagacactgtgaccaagactctgggcaatttgctgtgaggaataca

SEQ ID NO: 180251 - DNA, 334 bp, Homo sapiens
aaatctcctattctactaaatctctattgcttctttaaaaacttgcacttttacctggtccacacctttacaatgataagatgtctctttcacttgaaatgctctctttttaaatttattttacaaatttgtttatctaggaagcttttctagtttttctctaatcattgtctcttttatgttacctctgttttttgaactgttgcatttgtcaacgtattgtcatgatatgtttacataccagtatccctattcacctggaaatctttgaaagtctggttctaagtaccattcttagcatggtacttagcataaaataagtgtaaataaattt

SEQ ID NO: 180252 - DNA, 328 bp, Homo sapiens
cctgagagtagcgggtgggaaaacggagaggttgaggaaaagtaactaatgggtactaagcttaatacccgggtgacaacataacctgtacaacaaatccccatgacacgagtttacctgtataacaaacctgcacgtgtactgctgaacttaaactaaaagttaacaaaaggccaggtgcagtgtttcacacacgtaatcccagcactttgggaggctgacatgggtggatcacctgaggtcaggagttcaagaccagcccgaccaactaaatacaaaaagttagctagatgtggtggcaggtaatcccagctcctctggaggccaa

SEQ ID NO: 180253 - DNA, 209 bp, Homo sapiens
cttttatatttttttgaattttttgctttgacttgagtaaatggcatcaccatggtaccattaggtgccatgttaattaggcagttggaaatacgagcttatagctcagggagaggtttggacgttgttctgggactctgaagatctggctttttatcctagctctgccatgcagctgttatctgtgacaagtcaatagtttatgctgt

SEQ ID NO: 180254 - DNA, 251 bp, Homo sapiens
cggattgctatcaaccaactattttgtttatttggaaagatggaatgtttcagggttttattgatgaggaagatgaagtgcgctgacagaggctgctcctcctaggcaccctagctcttaggactcagttctctgaagctcaccaagggcatctatcttaggaccatgtgagtaaacttcctttcaaccaactattttgtttatttggaaagatggaatgtttcagggtttactgatagaagatgaagtgc

SEQ ID NO: 180255 - DNA, 351 bp, Homo sapiens
ttttaaagttgtttttgttgagatggaagtcttgctgtgttgcccgggctggtgttgaactcctaaactcaagtgatcctcctgccttggcctcccaaagtgctgggattataggtatgagccactgtgcctggctttattgagcagattctgtcaagtattaagtatcagtttttgtgagagattaaaaaaaatctaaatcatgatttcttccctgaaagaatttagagtctccttggaaagggaggccacttgtgcattaaagtttaaggttgcggttcagaaggtcagagtcatggggtttgtgagactaatgacgagttaggctttgaggtgaagatgggatatcct

SEQ ID NO: 180256 - DNA, 295 bp, Homo sapiens
taattgttttcaaatgtagttagtctttaaaataaaaggataacctgaaaagtacttttgagatatttgttgggggctattttcaaacttaattggatatgagactaacagaaaaatcaagtatcacataggtacagagaacaaagtaggagagattgagtggaataaagaatgttaaaaatgaacaatcggagcaggctacatttagtttcacggtctcttccctgtaatgactgtgcactagcaagtccttcctgttctttgtcagcgttcttgatgtggcgatttgaaatgt

SEQ ID NO: 180257 - DNA, 570 bp, Homo sapiens
ctcagaagctcctcctccaaagttgtcacacttcagaatctgccaatcactgctgacaagtgtcagagccaggaccaggcatcagccagattgaaacacttttgatgaccctgagcagctcagggctgggctgtcttagagtgctctgtgagcacaaacctcccacaggaatatcctgtgagcacaaacctcccccatgggataggcactctcattgcctaaaggagtcatctgcagcaagaccagcagtggcacctgcatcttgggctatggttagatgtcatcctcactatcacttgcagaggttggtatgggtgtccccgttccatacatgaggaaactgaggctctgaccttacctggagttgctccactactaagtagcagagccagatacagagcccaggtccagctgacccacggccctagggtgctctcctctctgccttggacctgtgaagcagtactggattctaagggaggcagggcaatgccagtcctcactccagcagagaccgggatgtggcccaagaagagcgttaatatcacgcccagcctgcagtgtcttcct

SEQ ID NO: 180258 - DNA, 433 bp, Homo sapiens
aaatgtggcttatatacagtcaacccaaaaagtaattaggatgggtaaaatatggtatagctactcagcaataaaaaggatcaaacatcacaaaacgcagtagcatagatgaaccttaaaagcattacaccgagtgaaagaagctgttcaccaaagtacacagttcatatgaaaaatctagaaaactagagacaaaaagcagatcaagggttgtctggagctgagttaggcttgactaccaataggcccaagggaacttgggaggtggtggaagtattctaaaactggattgtgatgacagctcaacagctgtgtacgtttataaaaattatctaactgtacacttacagtgggtaaattgtgtggtatgtaaattaaatctcaatgaaccagtaagaaatatatagctattagggtctcttgaggaataccc

SEQ ID NO: 180259 - DNA, 169 bp, Homo sapiens
gtagagaacactcccatcttgttggagtggtttcttttttaaaaagcagacagctggcgggaaagggaaaccagaaaaacctgatctgttccttgtgttcagtgggctgtgtggaagattggagatgaggttttgtgtctggcagtaggccagaaggatagtgtaactt

SEQ ID NO: 180260 - DNA, 223 bp, Homo sapiens
ttcaagagatccttaaaaaaaactcacagagagatttaaaatagagttactgaacaaatactctaggcaaatatgaaaatcaataaaaagccagtatagtaaattattaccaaacaaaatagaattgaaggcaaaatgtcagaaataaagagctacactgcataagagcaaagggaaattatctagcaataaagtatgaaaatcatgaaattgcatgcacctc

SEQ ID NO: 180261 - DNA, 152 bp, Homo sapiens
ggtcagtcttgaggtttgatcatgctccatgagaggacttagttgtctctttccttggttctctctggcaaactagtgtgactacagttcagcttattggtctcatgaagctatgaggttactcttattaataactgcttaaccaaaacctc

SEQ ID NO: 180262 - DNA, 246 bp, Homo sapiens
tattgaaatgtaagggttttcatggcctgaaaaaacaaaatatgcattacaactttcctgctgtgtgtgtttatttcagttctgaagctagcctgaaataacctctactttataaggaaattgatgctgagttgtcattatgcccaacatttataatacatatacagctaatttgaatgttataagtatagaaaaaatatcaggtaagtctgtattcaaataggaatatcaaagtaaaataaccag

SEQ ID NO: 180263 - DNA, 403 bp, Homo sapiens
gcccttgataatgtggtcaagatgctgggttcaccctccctggaacctgccctgctcctgagcttccttttctgtgagataacaaattcctacaatgtttgagccaaattttggttacttcagccagaagcacctcactgacacaggccctgtgctctgggggagttactgagcctccattaataatgttgatattagccaggtgtggtggctcacgcctgtaatcccagcactttgggaggccgaggcaggcagatcactagagctcaggagttcgagaccagcctggccaacatggcatctcaaaaaaaaaaaggaaaatgaaattctccttcactatggttggcaagtgtatcttggagcagtgtagccattagcagatgggatatactctcaagatcag

SEQ ID NO: 180264 - DNA, 229 bp, Homo sapiens
gcctacaatttggaccatatactctgggtatttgggcattgaaaactccaatcataacgcagcaattccatttttgttagtactttttacactattctttattcatggttggactgaaactatgtatctattaaattcttctattaatttcatacttgaaactcgttgaacctgaaattcattatagcaaatattattaaactaagttaaagtgttcctggttaacttt

SEQ ID NO: 180265 - DNA, 248 bp, Homo sapiens
cttaatacactcaaaaaaaaaataaaggactggagcaatgctgatttaatctaaaaagctcctgtcatgatcatcttaaaagctatcagaatagcttacataccaaaatactgggtgtaaaagtgttatactctctatctgtccctctagttaaacacattctctctggctagttacagtgaaaagaaatgagatgcatgcactgctgttcatctcctgcggtccccacctgatacttttcaaacaat

SEQ ID NO: 180266 - DNA, 556 bp, Homo sapiens
acggtgatgcaaagatcttaaagcaagctttgatgaacaagatgttagttttgatatttaagctgttttagttggttcatgatcttactttctagggattgtagagctagattttcctaagacaacaaagctgctgtctaattttgatctctggcatcttcaacatctcacaccctctcttcttccctcccctcttctctctcatttttttttttttcgcaagatagtagtactatcactgtagagccttggatctaattaaattcagatccagttaagcgggtttgggatagggcctgagaaactgctattctaacaagctcccaggtgaggcccttgctgcctgtggatggcctgcactttgaagagcagaagtctatctacagcatcatatttgttgagcagcagtcctttgtgccatcttcatctcttctttgtcttctaattcagattgcagatcttgggctctgaattaagcatcctcatattccaaacttgaacttagtctttgaataaatatgtcattatctgcatccctgattcccactgggcataa

SEQ ID NO: 180267 - DNA, 335 bp, Homo sapiens
ttctactctcagggagctgagctcaatatattgttgagtaacacttccaaatcatagtgtccatctttacattatcctaagcatgcttgctagtccttgctaattctagtccactctttctcccattaacatcaaaagccatttaaaccctaactgtttcccataaaatcctacttctttttctcgacactttcttggcatactccctcacccacttactgctaaaaagtgattttggaaataggaaaaaattttacctcttccaggaaacagacattcaaaaataacttgccaactctctgctctttttttctaaccctgtgtactcccatata

SEQ ID NO: 180268 - DNA, 179 bp, Homo sapiens
gtgatctgttcctaactgttttacatctgtaacatttctcaaatttgcctattttccaccatttctcctatcccttaattcaggctgcttctcacctagatgactgctgcaggttcccttgttgtctactcattattagtttctcattccaagtcattgattagatggctgccaaaagt

SEQ ID NO: 180269 - DNA, 716 bp, Homo sapiens
gcctgggtttaatctcttaaagaagccaatcctttccttgcctgtttggcatttcctaaaacatccctcaatgagggaggaaggcagggacaccctggaacgattcgtgctttcctttgggggagtgggaaggtaggtgggaaatgacaagatgagtgaggagttggcacttggccaaacagaggagcctggaccccaaggcttattctcagaggaggcccaagagaggctgaggaagagggggaacaaccctccggcgggggaggagggtgagacctcacactggcaagttcaggtccagccacttcctgaggctgctgggtggggccgcacctcacggtccttccctgtagaccatcttcccgggcacattgctcctcagaaaaggctctgggagggtctcagtggaagctggcagctgtgccctctggccctgacttggcctcttagggtattcctgggaccctccctctgtccctggccttcgtcttcctgaagtttccctgggaggcccaacctcctgcccctctcagggacagaggccagcagaggagccagcttacaggatgggagctgctgaaaagaatttttttcccttaattttatgaacctctccctcttcttcctctaattgtgaccgtttcctgtgtcagcctgtattcatgttttcttggacatctaacaattgaaacagcttttccctttcagaaacactc

SEQ ID NO: 180270 - DNA, 786 bp, Homo sapiens
actttctgtaatttgcaaatgatataacaataaagacagtaagtagtgtagggaactcaaacacaggctatctgcctctaaatcccaagctcatgctccaatcccacgctgcctcaggtcagttgagcaagttgacaagggcttgaagaactgaaaggaatggtaagaataaagtaaagtaggaagagcttcaaaggtcagaaaaaacataaatttgttaaagtaaacacagagcaaggtagagtttaaggcctgccgcaagaataggaagagaataagcatacagtggcaaagtcttaggaaattaatattcttataaagtagttggttaatttttcaaagatactatatttcatacaattttagaatttcagcatcttagtgtgggaatggaccttcctatccaggtagccccacttccaggggtagggagcacaggacttagaagggcagccagtaattactgttactcaactctaatcagaaaattcttctcacttctctagtcatttctaccccacagcctcaggtctatcctcataaggaacatctacgacttcttttctgcaaaagacctttcagattttctgcaatgtccctaagtttcttcttcaaatcgagatccccaattttaaaaagtattgttcataagccctaggatccaagctattgactgtgcattgtaaacctgggtgtgttatcagaactcaattagatattttactcccacatcaaagcaggtacatagtcacctctgtacactctaactttaggagtcctcttagt

SEQ ID NO: 180271 - DNA, 631 bp, Homo sapiens
ttagatgcctttaacctctcactcactccaaatactaggttttataaattccactaccagtaacctaaagattcctgtattttaagggggcccaatgtttccagaaatccatggagtacaagcaatctatgatcagaaacaacactaaggctgacagaggcttcagcagttatatctgtggcttcagcccagtgaaatccattcaactctgcagaaaagaaaaatcctgcaaattgtgctcctgttgtctctattttagctgtttggttattcttaaaaaaaaaaaaagatattaatccaatctcgggggtttttaaatttagtttattctactattttaaatttccagataacattaaaggtattatagcactcccccacccccacaaaaaaagagttagtataaatacatgtacaaggggccaggcgcaggggctcatgcctgtaatctcagcacttggggaagtcgaagtgggaggaggatggcttgaagccaggagttgaagaccaaccttggcaacacagcaagaccccaactctacaaaaaaaattttaaaagttgtcatgtgtggcgtcatatgcctatagtcctggctacttggaaagctaaggtgggagaattgcctgatcc

SEQ ID NO: 180272 - DNA, 870 bp, Homo sapiens
tgtcactctgtcccgggacgctgtgatccacggcggtgggggagggggaagggggagggacaagcatggctcgggtgaagttttaaactctgttcttctctcttgcctttctttggggacattctcccctttgggatctgtcctggacttcgcaggctgcgagaacttgttgacaagtgaaagctcggtagagccccggcttggtttgtggtctgcttattttttgcaaagtgactgttcctgtttgcgctggtccttatcggtgcccctttgggggacttcggcactgatcagcgcgctgacagccgccgtccgggctgcgggaaaatggggcgcgccctccggggggcgagtggctgtgtccttgctaatttcctccgtaacctttaaactctcgctggaagctaccgccgcggctggtcacgtgaggcgagccctgggctgctggggaaaaatttcctcggctgggagccgggaccgggccggcggccggcgagggactgccccgcgcccgagactgggaacctgggagggcagggccggagcgctgggccccggggcgcggcccagctgggacacccgcgaagacggcggcggtgaagaggtcggctccgctgccggggagctggggattatgcaaatggggaaagaaaacctccgccctcgcccttctgccaagtcaagtctgggaatttgtaggtattgtggtaagctgagtgttcatctggcgggtctggttagtgtaaaccaaaatttaaaacgcgcctcccgatcactttttcctcagtgggtaaaggttatcattgcctgcggcttaaaagcctaaaaaggcttaaaggcgaggaaggaggcagtcccctggaaaaacag

SEQ ID NO: 180273 - DNA, 432 bp, Homo sapiens
ttaaaccagtatatgcaaaatattactattttgacacaattgttatgacatataaaaattattagtgagatatgttatactctttttttcatactgcctccaaaatccagtgtgtattttaacatagcacacctcaatttgaaccaaccacatttcaagtagtcagtagccacatgggtgagtggctgctatgtcagacgatgttgctctagagcttacagactataaataatgatttattataaaacgtgcttaaattctttgtagattctggatgttagccctttgtcagaaggatagattgcaaaaatttgtaacaaaacttcatgttctacacatgcaccccagaacttaaagtaaaataaataagtaaataaataaataaataaacatgctaactatgcctaataaatgtctaatttatgcagctca

SEQ ID NO: 180274 - DNA, 792 bp, Homo sapiens
aagcctgcagttttcccctttccgtcagagcatattgtgttatgcgtttcctctgattccatcattttttatccttttgtttatttgccctcatttttctcctcttttatcttctgcaaagccaccttgcttccttccatttattcctgaaggccacgtaacctctgatggtgcctgcatgcccagcaggaaaatatggatgataatgtgtcctgcttgctttgtgttcacaaaagactaaaagcctctagatatttcagtattttatccttgttattattgttattctaacttgtccccatcattatgtattgtgaaattgatacctttttctgtactagaaggtcatgtggaccttaaacagtaggaaagatctagcttgaacccagtataggggaggcttcagaccaaccacaagccataggtagaaatggaaagtgtaaatcagatttccaataagtatcccaggactgggagaattttagttcaattgctcacatttttttttcatctgtagtttgtaaaataatcactggcatttagcatattgaccaaagaactttaaaagaaaaaaaagcatcattctgagaatgcaaacaattaaaatttaatttattgctggtgggagtataaatcgaaacagttaagaagactgttttgcattatctactgaagtcaaacatatgcataccctatgaccaacagttctactcctaggtatacatcaacagaaatatgaaccataataaatacagaatattacttatggcagcactattcaaaatagccaaa

SEQ ID NO: 180275 - DNA, 183 bp, Homo sapiens
tgagttctctataatcgaccttccatcccgttgatgtgtgtgtgtgtgtgtgtgtgtgtgtgtgtttgagaatgcatgtgtgtgttgtatgtgattgtgtgcatgtgaccgtgtgtgtgtgtgtgagaatgcatgtgtgtgttgtatgggatcatgtgcatgtgactgtgtgtgggtttgtgt

SEQ ID NO: 180276 - DNA, 737 bp, Homo sapiens
gcacctcctcgccagcagccgtccggagccagccaacgagcggtgagctgcgcggggcgcggggtgacgcggctccggccgggcaggggagagggcgcccgggcgctgcttgtgggcgcggtccggagagggttcggctccccgggaccgggccggggcgcgcgcggagagccccacagcctgtgctctgccctccaggagcggggcggcgggcagcgatctgggcccggggcagtcgcctttgattatcgagggcgctggcgttcggggaaggttggcagcaccttacgagacccacacacgtccccggggcggcacgggccaccttctgcggagcctcgtgggcttcgccgccgtcgcacctccgccgcctgcgctctgcggccccagagtaagccccatccggtgacgagccgcagtctggtcaccccagtcccaccaggtcccgctgcgaggtggaggcggaggggctcgctcagcaaaccagacggccgctccagtttctctaattggggttggagccccgtcacccttccccagatcacggccgcgggggagcgaagggacttcccaggactgcatagggcgcctcccgggacccacagcttggctggcccggccccttttgagcatcagctgaggctggacttggaggagatctcgctgtgtagcgcgaatgagttcttccaccgggaccagctgcggccgggctgcagccgctgtctggttgctgatcc

SEQ ID NO: 180277 - DNA, 634 bp, Homo sapiens
gaaaaaaaatacatgttgcatacaatggaaaaaatgataaatatgacagcaggttcttgcaggaaacagtgcaaacaagagcacattagagcaacatttaaaagtacttttaaaaaaatgtcaacatcaaattctatacccagaaaaaaaaactttaaaagccaaaatcaaggtagagattttcagacatatagaagcagaaaaacataattaccaggagtccacactagtagaaatgttaaaggaagtctttcataaagaaggaaaattataccagatggaaatatacataaactaatggcatgcaccaaaacataacctaatgggtaaatatataatattttttattatataagtcattttaaatgtaaatgcctctttaaaggaagtaatgacattcactttaggggttttaacaaatatatataagtaaaatgtataagaaatattgcattaagggaaaaatgaaggtattttgttgtatggtttttatcctatatgtgaactgatgtaatatcagttgaagataggctgtgataagctaaagctgtataatagtaaccttaaagcaaccactaaaataacaagattgtaacaaatagatgaacaaaggggatgatactggtttttttaa

SEQ ID NO: 180278 - DNA, 707 bp, Homo sapiens
ccaggcctcctcttcctttcctgctcttttttcagacttaaaaacccctctgctctcccaggcaatgtggccattcccagatcttcctcccaggcctccttggaatttccctcagcttgcggattgcagttctcactcagcaggcaaaaccacagcagagctcagcaaacagctgcactgtgatggcctgtgggttcttacacctgcccggggaatccctctcgcttcatcccatcacacctaaagaaaaggagagctgcaggaggtctgacggtgggtgcatggggcccagctgggcagtctgcccaagctcctgcccatgctggcctttgttcctggggcatttccaaagctcagggcttgggcctttgtccattctcaggatccggtaaatgatgcctgaccacccaaaacccagcaatctttcctgcctccaaacaaagaggccttttgatttttcttactctcttggcccttacatgagtgccaaaatgtcttgggtaataaaaagaagattatcaggaaacactcacagagcacttactatgttccaggtactattttaaacattatagttattaactcattgaatcccaggagttgagaggcactgtgtgtgtgtgtgtgtgtgtatgtgagtgtatatgagtgtgtgtatgtgagtgcgtgagagtgtttgtgtgcatcagtgtgtgagtgtgagtgtg

SEQ ID NO: 180279 - DNA, 288 bp, Homo sapiens
caaatctatagagataggaaatagatgagtggttgcctagggctgggagtaggaatggaggttgattgtaaatgggcacaaagtttgattttagtttgatgggaatgctctaaaatgggactgtggcgatggcgggataactctgtaatagactaaaactcattgaattcttgctcaaaataggtgaattcatggtgtggaaattgtttctcaatgaacatattctttttattttgttttgctttttgaggcggagtcttgctctgtctagagacggggttttaccat

SEQ ID NO: 180280 - DNA, 498 bp, Homo sapiens
gcaggtcaggctatggcagttttcatgggtctcagtcactcagtttaacacaattaggttcatggtggcactatttactattttgggttgggaggaaatgtacttatcccaccttttctagtcaggagagtttgtcattccatggtaaaataaataaataaataataatcctaaattgtcaatggcttaacataacagtttagttttcaaagaactgcactttgaggtagccaccaaatctgaacagggccacatggacaagcacagtggatgtttcagtgattacctatctggacctatgactgaggaccagatattcttttcctctctgtgcctcatcaccacttaagtctcagaggtcagaaatgcaatggaaatctcaattagggaccaaaggactcacagagtgagaaatgatggcattgtggaaaatacagtcttgaacaagggcatttgtggaccaagatttatattttcacacaatgcaggggaagttaa

SEQ ID NO: 180281 - DNA, 662 bp, Homo sapiens
  misc_feature (631)..(631): n is a, c, g, or t
aagcctgatccgtgaacaggtcatgaggtcatgaaaccacagggagctagaggcaatgagaggatggtacagagtgctgtgggcacagcacctgctggagaggaagggaggatgtcactaagagatgacagcgggactggaggtggccaggtaaggaacacagcatatgcaaaggctgcaagggaaggagccagagaaaagggagaagagggacacaatgggtgacaagaaggggtcgaggatcagcagcctggtcagcagcgctaaaggagcgagagtcagagaccgctctgaaccgccaggcttctgtagcctgctgtgtcctgcagggtacagctgcttttgggtgtcctgtggtttaaaaagctgtggaggttgtcgccatttacgatgcgccatgtccctgcatgagtgtggttggcttccgctcatgcctctatctgccacttttctccactctctgtaactaatacgtgtgggacaaagaataggcatttaactcgaatttgttggctggttacaggggctgtggtgacaaaatttcacaaatgcccacaccaagctcttgcaaaagaggtcctcgtgtcttacatgtggcggctactgcagatgacagcagaccacatggcangatgggggcagcaggctggtttgggaaaaag

SEQ ID NO: 180282 - DNA, 393 bp, Homo sapiens
gccattcacagttatctaggggtagcctcatctctcaggcagcaacatatcatcactattatttcaaagagacatattctgaaaaaaaattacatagaggtgccatatgacactgaaagcagtttgtttgtaaggcatattcagcctggtgaagcctcttgtcattttgctacctaaggattagggccaaagcactaaaagaatcaccttttttctttctattccagaattgttcagagtcccacagcataatcctaattctataagcaatccagagacctccagaattgtaatatagtagaaaatgtacccactgctacatatgtttcactctcttcttgttcaatattcatacttaggaagagagagcttatttctatcagtagagaaaaa

SEQ ID NO: 180283 - DNA, 325 bp, Homo sapiens
gtccaacatcggttgccttggaaacaggtgcagaaaaggttttctctcttatctgattttttaaaaattttaccaaagcagtgatgagtttttcctgttatcacggaatttgggaataatagtacattttatgtagtgaagcatatttctagtttttcattatttgataaataaatgcattctacattatttcattttacaatatttatttaataaataaatacgtttctatccatttgatcaaatcactatcacttggtattcaaagatgaaatgcttagcgtctgggtctagaaatatgactggagaaaaaatgtgtatggcc

SEQ ID NO: 180284 - DNA, 518 bp, Homo sapiens
gagggcaacggcagtgggcccttcctcccagaactgctaaaacatcgccctgcggaaagggcccctcgcagcccaagacgccggggaagcgctggaggcgccgaagactcggtcgggggtctcgggcgcagccccaggacctgcggaacccggcccggtgcgcagacgcgcacactccagcaggtggcgctgcctcccctggaacgagtcggctcccgcaggcggcgcccggggcgggagggaggcaaagggagggaccggagagcagggcgcctccctctgccccgccggcccaggcgtccgatgcggcccctgcgagccccctccccgggagttctcattgcctccccctgcccccgctcccggccgctccgatgcctgtggcaaccgggatcccgcgcccgcctcacctgggtgcgggggtgcagggtgacctttcacgccgggccaacgccagtacccccttctcagcacacctgggtccccgagcgggccaggtggttccgtgggggcggccg

SEQ ID NO: 180285 - DNA, 397 bp, Homo sapiens
caacttcccacacactcctgctgtgtattgctaataaaaattctatataaccaaggctataaaaatagtgacatttttgctatcttttttttttcctttttgaaacaggttctccatctaccacccaggctggatttgaaaagtaattgttcttggggaatgagacattgggacaggacagcaggaaagcattgtttcttgttcaagtcctgtcggctatataccgtgtgcatgtacaactgataaaaataaaagcctaaattttctctttttttttttttttttgagacaccaggctggagtgcagtggtgcaatcatggttcacttcaacctcggcctccagagttcaagtgattcccatgcctcagcctccgaagtagctgggattaaaggcat

SEQ ID NO: 180286 - DNA, 547 bp, Homo sapiens
catgtatttaccacaaattaatttattgaataattaagaaattagaatcatttgatgatggagagatgtatatttcagatatgtattggatgcataacaatccatcccaaaatttagttgcttaaaaccacgatggtttatataggtttgcttgatcattcctctgttggttcccctgaactcatgtggatgcatttggctgaattattggcttggctgggcagtccaagatggcttcattaataaggcagttcgtgttgatgcttggctagagtcccttggatctttttcaggtggcctttcgtttacatgacagtagtggagtaacattccaagaaagtaaaagctgagctgcaaggcccgattggggctagccttggatgtcactaaacatcccttctgccatattctgttggtcaaagcacataagagccagcccaaatgtgtgaaatacatttatctctagatggaagcaggtgcatggtacttgtggccatattcaacaaatcataatgcagcaccgtatttctttaaaaaagaagaagaa

SEQ ID NO: 180287 - DNA, 326 bp, Homo sapiens
gggtgatgtataccctaaaatccctgacatcactactgcacaatttctgcatgtaacaaaattatacttgtatgccatacatttatacaagtaaaaaggaaagtcaggctgagtgtgggctccttcctgttccctatgtctcttccccccaccctcactggcttctcctggaagcaattgatcactacatcacttgcaactgaaatcttggctcaggagaaccttatctaataaaacagtagatttaaacaacaaagtaaggttagcaggacacagtaggtgtgttatcaaaagacccatgcttgcagctctgccgcgtaacagct

SEQ ID NO: 180288 - DNA, 603 bp, Homo sapiens
caaaaaaaaaaaaaaaaaaaaaaagcaagtacatctaggctacttaatatagtattttgcccatagtaggtgcttagttcaatgtagttactgttattatcattttagtattattattctcagtgtttgtcttcttaactactgtatcctcagtgctgtcacagtgcctagcatctacttggtgttcaataaatatttgttgaataaatgtattcatctggcctttaaaatcctggcattagtaagatcataatgttgcataagatatggtgcttactaataagaagaagattccctgataaatagaagcatcttgccttttagaataagtaataggagctcctactgctgtaggagcagtgtgatacagtataaaggatagtaaaccaatgtttgaagctgggtgaccttgagagagttgcttaaaacctctctcagcgttaggtttttttttttcctttccttttaatctgagcaaaggacaggccagctgatttttcacatattttccagttccaaaaatgtgtaatcgtctgaaaattgagctttgtaggtctataaactatttctatttccatgctttaaaaagaatccaggagtggt

SEQ ID NO: 180289 - DNA, 231 bp, Homo sapiens
tattcacggttttgctgcccaatggtccctgaagaatcagatccatttaaatgagaagagatcaggattcattaatgctgaatttccagctgcgtcctctgactgatgatgtttatctttatgtttttaatcatactttcctcccagagctaaaatagaagtcagagaactgggggcctgctggaaacatctaaatctttcccaaacttcacagccatctttacaatgtgc

SEQ ID NO: 180290 - DNA, 253 bp, Homo sapiens
ttcctatcataagtatctttatctgtgatagggaacgggaatgtctgcctgatgtagtctagaatcctgtgaattcaaacagatactttgttcgttcacactcccgcagcttatgtctagcgtgttatgctataacgaatagggttctaacattaaacttattttttgagaaatcttcaggaaaaaataccatcttatgaataggtatagtatatataaatttcatggcccggcgcagtggctcatgcctgta

SEQ ID NO: 180291 - DNA, 564 bp, Homo sapiens
gctaggaaagaagggggacgccactccttctgttggattcagagataccagtctcttctagtatcccacccacctttgtcagtttcttttcagtttcccctgttagctcttctttctgcttctgtccttcagccgtcttttatgactctgtgttatgatggtaggagaagtaaaccatttccgtggcttcatttacctgtagtttgacacctttaaatactttatctccagtctcagtctcttttctgaattttccttctccatttccaatttcctgttgcatatcttctcttggatcatccacagtcatttcaagcttaatgtatttatcatggaatttattaggcttgtgttaacttgttctgttttgggtaatggcactattagccatctaatggcccagactagacatttcttctctttttctcaaacccactatatccatttgcttatctaattctattgattatgtttcagattctcattatttctccctttagcaaccaaaatgatttaatactttctagtcaatgtcatctcttaatttatctccatattggcaca

SEQ ID NO: 180292 - DNA, 713 bp, Homo sapiens
actcagaggatcccctcgaatcgacggttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgaaaacctgtcttgaaaaatgaacagtaagaaaacaaaatgtttgtggccagatgcagtggtgcatacctataatcccagtaccttgggaggcttgaggctcaagaattgcttgaagccaggagttggataccagcactggcaatagagtaaaaccctgtctctacaaaaaatttaaaactaactgggcatgcccgtctgggatgtgaggagcgcctctgcccggccgccaccccatctgggaggtgtacccaacagctcattgagaacgggccatgatgacaatggcggttttgttgaatagaaaagggggaaatgtgggaaaaagatacagaaatcagattgttgctgtgtctgtgtagaaagaagtagacatagaagactccattttgttctgtactaagaaaaattcttctgccttgggatgctgttgatctatgaccttacccccaacccagtgctctctgaaacatgtgctgtgtccactcagggttgaatggattaagggcggtgcaagatgtgctttg

SEQ ID NO: 180293 - DNA, 805 bp, Homo sapiens
cacaacaaaagaagaaggcccaaacttaagtgggagtatgtttccctccctccaattccaatagggataaatattataccaaacatctactgtaaagggtattgaagtaaaatatattcttttctagataagccaaatctatcacattttcaagtggtttctgaaacaactttggatttccctctaccattctttaattcattttttctgttataaaaagagaccttaatactagtaagaaactagattgtctactattaacatcaactctactatttgtagtacattttcaaatggtgtgactgacattgcaattgcttggttctgttcacacaaatttgcattatttcattactagaagaaaacaggctaaaattttctcagagtcacagttactttctgataagtttctagaaagtttcttcaaattctaaaataatggcttgtattgcctacccaacaacaactactgagtgtttgaatcagagataagatatttaaaaatgtttctaagtataaaatttcatctcctttctcaatgctgcaataagatagcaatgtcaggtcaaaagtatgatattcctgtctcctagttactatctattttagcatgcagttaccatgctcagactggagagaaaaaaaaaaataaagataaatagacataaaaaccagccaggcacgatggctcacctgtaatcccaacactttgggaggccgtggtgggtggatcacctgaggtcaggagttcgagaccagcctggccaacatggcgaaaccctgcctcaactaaaaatacaaaaat

SEQ ID NO: 180294 - DNA, 499 bp, Homo sapiens
agccccaccagtgtgctccatccccacctgtgtgctcatccccacctgtgtgctccatccccacctgtgtgctcatccccacctgtgtgctccatccccacctgtgtgctccatccccacctgtgtgctccatccccacctgtgtgctcatccccacctgtgtgctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaagacgcacacaacgcctgctgacatccagtcgagtggcc

SEQ ID NO: 180295 - DNA, 690 bp, Homo sapiens
  misc_feature (1)..(1): n is a, c, g, or t
nggctggtacggcccggggtactgtggatgagagagtattctggcacacgagagtgagaacctgcgcaagcgctgacctgccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaagacgcacacaacgcctgctgacatccagtcgagtggcc

SEQ ID NO: 180296 - DNA, 432 bp, Homo sapiens
acacagtgagactccatctcaaaaaagaaaaaaaaaaaaagaataaagttgggaatatgcccaggccccaggcccccacctgtttcctgtctccccctcaggtggagacctgaggtggagccaagagtcccagtccatcctaccaccctggcctcctccctgtgtccccagagatggggaggtgacttgctccaccctttcccacccttggagtgctacacttggaggctctgggtccactggggactcagaaaattccaggttcacacaagccagacttctgtgctacagagggagaaggggcagggcactctgctctttcccactccctgaaggcgctacttctaggctgggaaagcagtgctttgggaagagctcaggggggcaagggctgcatcataaaaaggcagatgtgaaagatgtcagcgtggg

SEQ ID NO: 180297 - DNA, 330 bp, Homo sapiens
actctgtctcaaaagacaaaatacaaaaattagccaggcatggtgacaggcatctgtagtcccagctgcttgggaggctgaggcaggagaatggcttgaacctgagaagcagaggttgcaatcagctgagataacaccattgcgctccagcctgggcaacagagccagactccgtctcaaaaaatatatatatatatggggaaactgagtcacaggaggaccaggagtgaaacggagaggaaggagaagtgtatgcagggcagcacccccacaggcaaaagtgtgcagacttgggatctgcagcaagctcacccctctgtaaactgaatt

SEQ ID NO: 180298 - DNA, 242 bp, Homo sapiens
gataaaataacttgcaaatgatgacagatgtctttaccctatattcttttctatctggaatcaaagcttgtttggagacctgtatcatcatcccagtacaaacctcttgccctcccagcatggctgccataaataatgactcatgtgcaaagaaccaaccccccccccccccgtttaaatgggaaaagggggggattctttaaaggcggccctggggcaaccaagcttgggcctgggcgggg

SEQ ID NO: 180299 - DNA, 593 bp, Homo sapiens
cctgcatatgcctcattttatgtaattaaaagtttcctgataattatactcccagtttccaataaattcttccaccacacacacacacaacacacacacacatgcatgaagtagaagaaaagcttttagagatcatttactgagcttattgacacaaatgagagttttaagaagcacaagcaaacaattttagcatattttggccaactttatatatattaatatttcccatttccttgtcacgtgcatgaagcccacatcatgtctttttccacagggtataaggccctatgctcaatagcttgaattagtcacagaatgtctttctgttggcaacttttggattaacatccacaaattaaaatcagctcaacctcaaactaaagtatctggttatcattaataacttcgccactggacagaatgataaaaaataaaaagagaaaactcattaatttattatgatctcaaactaaatgtttttctcttatgtattttaaagatctgagaagcaaaattacaatttgagtttattagtaactatctgagtccactttctgttgcttataacagaatacctgaaactggttaat

SEQ ID NO: 180300 - DNA, 601 bp, Homo sapiens
tctataacagatgtatgcacacggcaaagaaaaaatacctaatacagccagtgaaggcattataaagacttcctataggaacttactctttggagtcttgaataatgaatgcaacagataacacagcaaagaaagaaagactagggtagtaacaataataagggcaagcagttatgacagactaaagctttaattccatttttcagtgtggctgaagagtagcacagatgtgaggaagtatgtgaagatgagaaaagaaggcaagaactggattatatgaagtgctttatttgccattttcattctatcaatgaagagaagcactacgaccagagtgggattttagaaagatcactctgtcaacagcacagaagcttaactaaaggaaataaggttgaatactgaaaaactgagtaggtaggctcttccagtaatccaaactgagacttaagcaatggtagtgttataaaaagttaagagaaagatttaagagaaatttgcttatgtacattgtaaagaatgcagactttagaaagtttaagacctaaattcaaatcccctagtcactgtctatgagctttgcaacttagaacaaatcatt

SEQ ID NO: 180301 - DNA, 447 bp, Homo sapiens
tatgtgaggagtcattatattcatctatttatatgctggttttgcagaataaaattctaaaaataaactactttacaagttcatttaacaaatctgagccattatcatagaccaggctctgtattaaatgttaacagaaataattgtaaagaagaaatgagtgatgttaaagtgagaatgttgctataatgagataagaaaacaaaacatagtaaagatgcagttttgtttaagctaattatcctatctgacaaaaagaatgatacagcaggtgttcagatgtacccacatgtgcacacacataggtacccatatatgcccacacataagaaccatagaagaaagacctaaatacatgagagagacacttagataacaagaaaataagtatatgtgggtcttccactgttgtaggcagcttccaagatggctcccagtgaatctgcc

SEQ ID NO: 180302 - DNA, 192 bp, Homo sapiens
gattgagtccaggaaattctagacaaactggggaaacatagtgagacctcctctctatgaaatataaacaaaaattagctaggtgtggtggcacacacttatagtcccaggtactcagggggctggtacaggagaattgcttgagccccagaggttgaggctgcagtgagctacgactgcaccagtgtactc

SEQ ID NO: 180303 - DNA, 718 bp, Homo sapiens
gcatctgtggatggaggaccatctgtgagcagggctccaggctgtgcatagacagggaggagttgtcacacttcactccactgaactgctcgtcacacatgcctgagtcgatggctcagaaaaccaacccagaaagaagagcaagaggaatcaattccaatttgttagagccttctgggtgtgataaagccaacccctgccatctccactgtcttcctgtttccccttctctaagaagtgaaagcaccattcaattaaggtaattaaattcacccgaagatcttgggctcaaaaaccacactaccggcaagtggtcaaacccagcaacaaagcaaaccccagtggcttcctgtggaaagatgggcagggatgaggaggaaaatggaacatatcttcagcagctcaggggtgcaccttgggcctgcaggggagcccccagctctgcagagcccagctgcctgagcctcccgcagcaccagagccctccccaaacaggaaggactcatgtttacaggctgaatcaaaagtttcacttctgtggatgtctgggagaactcagctgagaagatccttattacatgacgtgaaagtgaaatgaaaccctcgttttctcccccagagacaccaattctcccatgaactccagcccatgagccataagcggggctggcaacacctcccaggacacgcctaaggaagcctgaatccacaggccaga

SEQ ID NO: 180304 - DNA, 189 bp, Homo sapiens
aaggaaaattattgtgttcaattctgcatattatttttagacagaagttgctatattgtgacaaagacacaagaagtaaacaagttgacaagcagtccataaactactgctacctgaagaattgggatgtctggcctgaagaagcacgggggtgtgtgtgtgtgtgtgtgtgtgtgtgtgtgtgtgtgt

SEQ ID NO: 180305 - DNA, 457 bp, Homo sapiens
aacttatcctcccttaaagtcactactccttgttctgaatggatttcaaagacatcagagtgatttttgaggaaagtactaaaccttgatagatttaacatgtgggggacatcatttaggagatatgatagaacctgtcactacttctaaagattgctcttgtgaaataatgaaaaagctattatgatactaaacactcttccatcgagtgaacagatacatgtattggcctcctttaatggtgtattctcacagaaaagtgaaaaggctagacattttatattctttttctggaaccttttactcttcttttttctgttttaattcacaaatttgtatattaatatatattacatatatatttttgatgcatttgtaaattataaaattatttccaaatatccatacaaaagatactttttaaataaagcttttggcaagaaaccaacaccaaagt

SEQ ID NO: 180306 - DNA, 743 bp, Homo sapiens
gaatgcaagtacattctgaaatgctattcaactaccattcaaggctttgaacaggcagctattgccataactcattcagaaaaacacctcaagattaactaaaattgtctttattccatgctgttttcaatccagtctaaaaactaccaacatgtgtatagcaaaattaattttgcaaaatgtacgaatagtattttctatgtaaatttttttatgttaagaaaaaagtattttactttctaagttttgataaaccctttcttattgatttttaatctccttgattatatccaccctggagttttatggataaaagttgaagatgattgtaggagaaaaatgagagagaaatagaaattttctcttttgtgttaatggtaaagttagcctacttacctaaagataaaattaataaattacttgacagattttcattgttaatatagcccaaaatgctctatatttcccttttatagtatgatagaaacctttggtcacactttaataaaacaaaatgctatattaagaatcattgatattacattataaactttatgacctctaaaaaaaaaaataatttcaaagaagcataacttgtgagcatgtggtaaagcggcatcccactgaagatcagtgttactgcttttaatctcttttaagttaatacttcagtatactggtagctataactatagggcctttgttttggtcgatgatatttaacctaccatttatgttaataa

SEQ ID NO: 180307 - DNA, 829 bp, Homo sapiens
tttgtgtttcagatcttttctacagtcctcactaaaggcaatacattatagcgaatgaggttttgaaagtcgtctatattcaaagatgggtagactttaatttgttgtcgtgattataacacaagaaattccatcttttaaatattttccctttgtaggttagaaaatgattctggcctttcccgtatctgtttcttttgtgcttttttgcatgtgataatactaataatcccatcttacatttgagctttccagttttttcttgtccatcaccttatttcaagccaagataattttagaacattacttcttacaccagcagttgcctgactgtactgatctcacaaaataagcaggaaaggatgttgagaaatgaagtgaacgcctgtgaccaaatcatcaaagaactagaagagggaaactgtgagtagagtattcctatagaaccttctttccaatatcatggttgtgactggggagggtgcctgagagaaatatgatggaaggaccgggtaaacacacctgtagacttgtcacctgtcctaaggtgagagtaggggctggggctgtgaagaaggacttttgtttgtgtacctaccatgtgctaggtaggtgctggtagtttagcgcatgtattttttaaaagttaggcattgttactaccattctgcaggaaataggctcagagaggtatgagtaagtcatcaatatgcacttaaaaataaatctagtgttgctatactcaggtgatacttatagtaaaatttctactgtggccttttggtgtgtttccctagtcttttttagaaattatatggaaggctgaccg

SEQ ID NO: 180308 - DNA, 277 bp, Homo sapiens
ggaagatactgtccttcttgctattcggggagggagagagaggaatatgatatgataaagaaaaatagtaaaataaaagagcacattgcccactagcatttcccattacccccacatctggaactaccctcctttcaagtaggttgctctcctgattctataaatcagtttcagggaaggaagacgagtgtctggtaggcatctggctggagttcaaggtcatgtcaggtggtgtgcatgctcctcatgggcagcgtggtccctccccgggatacag

SEQ ID NO: 180309 - DNA, 420 bp, Homo sapiens
gtggaaggcaaccagtgcagattgcagcagatcagaatgctccaggaaagatttcctcaagaagataaaagtgataaactggccgggcatggtggctcatgcctgtaatcccagcactttgggaggtggaggcgggtggatcacctgaggtcaggagttccagaccagcctggccaacgtggtgaaaccctgtctctactaaaaatacaaaaattagctgggcatggtggcacacgcctgtagtcccagctactcaggaggctgaggcaggagaatcacttgaacccaggaggcggaggttgcagtgagccgagaccatgccactgcactccagcctgggcaacagagtgagactctgtctcaaaaaaaaaaaaaggaaaagaaaagaaaaacaagtgataaactacttaatgtttggat

SEQ ID NO: 180310 - DNA, 1119 bp, Homo sapiens
tatagtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaacagaaagcaaaagcagaagctaacggaaggacgcagaaagctaaaagaaaaacaaagacagctgcattagcagctgctcggattagctaggagacagaagaggaggacagtcgacagcaagccttgctggggaacagcaagggacaaacaggatatccgaaaaaagcattaacaaacgggaaaaggcaaacacttcgaagagtcatgcacagttattgatgaaaggaaatggattggaaaagctaaacagatccacaacgagcacagaggagaaaaggggaagagcgggagtagaacatttgttagaaagggatacaggatagcatccaaggaaaacaactcgagggaaagaaaagagaaagacagccaagaagagaaaaagaataaccaagggagagaggacggaagagaaaacgaagatggattaacggccaagataacagaacaacaaggaagtacaaagatggtgcgggacgcccccatagaacgggaaccaagacaatggatgggaaaaggacacaacgatacaagtgatacagagggaagagaagaacacaatacaggtgggataatactcaacaagaga

SEQ ID NO: 180311 - DNA, 965 bp, Homo sapiens
tatagtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtcatgcgacaagcatctaagaacacagagaaatcaactggtggaggtggaactggaagtaacaaattggtcagaagatgatctacaattactaattaaagctgtgaatctgttccctgctggaacaaattcaagatgggaagttattgctaattacatgaacatacaattctatcctctgagagtcaaaagaactggccaaagatgttacttggcacaagcaaagagtctccaaaaacttgaccctcatcaaacaagatgacatacataaaaaggcatttgactcagtccacacacagaacatgggagtggtaactcacagcagagaagcacagccttcagaacgattggagggcatatcagacttacccttgcaacgcacacaaactttgacacat

SEQ ID NO: 180312 - DNA, 189 bp, Homo sapiens
caaagggcatggacagataatatggtaagttgaaatggccatacacacaatgtatgtgaaagccaacacacaatgtagctcaactcaaaatacagacttcaaaacctttcccagagaattcacagtggaacacagtcaggtgtccaggtgtggaatgagctagttccctacagcgatccctttctgtta

SEQ ID NO: 180313 - DNA, 692 bp, Homo sapiens
ttatattgtcattgtaaattatgtggataaattaatttaaaaatttatactgccagttcaatattgtattccagcattataacatttttggttgttggatttttgtgtcataatctctattgcaatatctattaaggaacaaagaaggaattttgaaaggggattatatttcaaatgcacagtggggctcttttgatttcacatttgtgttcattttattacctatattcccacggggaaaacatgatgaatactaatttttattgtttttaaaaataacaccttctagaattctacaaatgcagatggcaattaattgttagattatttctcttgattcctcagtcttattattactttttatttattcaacaaatatttacctatatatgtttggcatgctctaagtactagggttgcaacaaacacatttctataaaaaagtaaagtatgttatgtacatatattcaggctcagaggtaaataatctgccaatgaaatctaaaaaattagtataatcgactaggagattgtgatttttttttttaaacattcatacgttttccaaactggttctacttagaaaaaagtaggagttccttgtggaaactttagtttctcattgctaataatatttattcattgtttggtaaatattaataaattacttaaatttatttgcaactctccca

SEQ ID NO: 180314 - DNA, 417 bp, Homo sapiens
tcgcttgaacccaggaagcagaggttgcagtgagccgagatcacgccactgcattccagcctgggcaacagagctagactccgtctcaaaacaaagaaaaaaacaagttctagacatcgggcctaggaatctatatttaaacctgctctataagcgatccagatgcacagcaaaggttgagaagtgtttcagatgtagcttcatcccagctcccaaagtgccgcaaattgcacaaagtgctggtgctcactggaaggccacatcctcgaccccaatcctctccaccatgccctgaccatctccttgatcttgtcccagcactgtctagcgagacctcaagtccctctcctagcaggagcctgggcccctgggataggcaatttttgctctaaccctactcctgataccatctttttt

SEQ ID NO: 180315 - DNA, 259 bp, Homo sapiens
aatggaaagaaccaacaacatgaaatcagcactccccaacagcagcgacctgccatgcatccagcagccgccaccccgctcacatgagcacacactcctctgctcaccatagtccctgccatctcacactccaccggctgatgttgcccatacctacactcaagtttaggatgcccaatatataaacttgaggaaattttgtactagtgtcatgctttatgggcctggtcatatttcccagtgttgtcatggtcactgg

SEQ ID NO: 180316 - DNA, 604 bp, Homo sapiens
gtgtggctctgtagctcagcagccgcactgggctctcaagggccccaaggcttgtgggtggttaaaacaaacacctttgtgacacatggccaggacgtcagggccactgtgatgaccataaaaaggcgaccaagtttatctgtggtataattcattttaagagtgtaaataattgcccctgaattttacacttatgctgcaattagacacgttacggtgtccggctgggccatggctctgctcatcagctctgtgggtcattacagagccagcatcccagaagctccgccagaatcacggtggatcctgtgagaatgtcttccccagagcagagtgcaaaactccaagaaatgagtcaaaacacttttgcatgtacctacatagctttatgctcaaattataccccacatttcagaaaatggttttaagtcaattaacatgttgggttttatacccacacatatccaagtgatgtataatcgcaagtagatacaaaatttagtatttataaaattatcctttagatttctaattttatctaaattttaaaaacaatatattccaacagaaaaagccttagaaattatgcctaatttcaaacatg

SEQ ID NO: 180317 - DNA, 707 bp, Homo sapiens
gtatctctgtcattctgaatcccattttcccatcctccaaaatttaaagaaatagaaaagtttcaccgggctgaggaaggtaatgttcttagtattagtttctagggctgctgtaacaaattaccacaagttgggtaacttacaacaacagaaatatgttatcttacagttctggaggccagcagtccaaaatccagcagggccacattcctccagggaacttctggaaagggctcattccttgccaatttcagcttccgggggttgcatcagcatttctggctgcatctctccaatctctgcctctgtctttacatggccttctttgtgtgcccatgtcttctcttctgtctcttataaggacacttatccttggatttagggtccacctgagtaattcaggatgatcacatctaaagatccttaagccaggcgcagtggctcatgcctataatcccagtgctttgggaggctgaggcgggtggatcacaaggtcaggagatcaagaccatcctggctaacacggtgaaaccccgtccctacttaaaatacaaaaaattagctgggcgtggtggcacgcacctgtagtcccagctactcgggaggctgagaaaggagaatcgcttgaacccaggagacaaaagttgcagtgagccaagatcgcaccgctgtactccggcctgggcgtcagagctagcctccgtctc

SEQ ID NO: 180318 - DNA, 693 bp, Homo sapiens
gaagaatgcaaagtgtcactttgaacttctcgttcaccacacacgtgggagtccactcatgtcagcagcctccgtgcacaggccccaggtgaaagaaagaatgaggtctagttggaccagctaacactgcctgccttgtgtttacgaaaggcagctgcctctgtggtgtgatttcaggggagccagacagggccggggccacgaacctgcatcctgcatcctaagcacctattgccatgcgtgaggctaactggaaactcacttgctgggtgcagatagcttccaaactattgtgatgctcatgcttgacttcccaaggaacgtgtttcaggaaaggccattgccctcattatggtctttgataagcaggaagaagtttgttgttccttttttttcttaatgccctacttcgtgcaacatacatccaatcagtcatatcctattgacgctacccctaaatatctctgggcctggcccgtgctcagggcactgccttcattcagttactgcacttgcctgctgcctgtgctcctggtctcctgcttggactcccccaggccagcagccacactactgccaaaatccagtcgaaaattaacttcaggtaaagcacaattccaaacctaacactgcccccctcaaaagcctctctgtagccttcagaataaagaccatattatttgacaagacaaa

SEQ ID NO: 180319 - DNA, 527 bp, Homo sapiens
gatcgagctcgtaccgggtcagtacggatgtggcacgaacctgcatcctgcatcctaagcacctattgccatgcgtgaggctaactggaaactcacttgctgggtgcagatagcttccaaactattgtgatgctcatgcttgacttcccaaggaacgtgtttcaggaaaggccattgccctcattatggtctttgataagcaggaagaagtttgttgttccttttttttcttaatgccctacttcgtgcaacatacatccaatcagtcatatcctattgacgctacccctaaatatctctgggcctggcccgtgctcagggcactgccttcattcagttactgcacttgcctgctgcctgtgctcctggtctcctgcttggactcccccaggccagcagccacactactgccaaaatccagtcgaaaattaacttcaggtaaagcacaattccaaacctaacactgcccccctcaaaagcctctctgtagccttcagaataaagaccatattatttgacaagacaaa

SEQ ID NO: 180320 - DNA, 215 bp, Homo sapiens
aggggcggggcttcgtggagggcaggccaggactggggaaactagggcgaaaggggcgtcatgaggacggggttcccaggagggagagcggagcagggagaggcagccctttcccaggcattggaacaggagcctgcctcttggagaatcccagccttctatgcggtccccctgcactggctggggacacagaaggaagtggggtcatggatccc

SEQ ID NO: 180321 - DNA, 300 bp, Homo sapiens
tgagtcactgtaacaccatatagctcagagaaaaggcagttccaggtgagacagcttgttcagagcccttgagctcagactagcttagaagaaaagatactgctttctcctcttgtgccccctaggggtctactgctcaccacttgactaccacattactgggagcctcaggaattttcccagtatcctcataatctccaacttgaacccaactcctccaacagattatgaaaatcaaaatcagtgccatcatacctcacaacatagttgtctatgttactatgctataatgatcagatc

SEQ ID NO: 180322 - DNA, 479 bp, Homo sapiens
ttgagatggagtctcgctctgtcgcccaggctggagtgcagtggcaccatctaggctcactgcaacctctgcctcccgggttcaagcgattctcctgcctcagcctcccgagtagctgggactacgggcacatgccaccatgcgctgctaattttttgtatttttagtagagacagggtttcatcatgttagccaggatgttctcgatctcctgacctcatgatccacctgcctcggcctccctaagtgctggtattacaggtgtgagccaccacacccagccaaacttggaaccataataaaagtaagaagtgtgggtgtgggggaaactgggaagggagggagatgatgtatttgtgttacagacaaaagacaagttctgttcctccgcagggacaaatgaagaaccagatgatggaataaactgaggtcagagagtttccccccagaaatcccggcggcccgaggttacccgagct

SEQ ID NO: 180323 - DNA, 1460 bp, Homo sapiens
ttgagatggagtctcgctctgtcgcccaggctggagtgcagtggcaccatctaggctcactgcaacctctgcctcccgggttcaagcgattctcctgcctcagcctcccgagtagctgggactacgggcacatgccaccatgcgctgctaattttttgtatttttagtagagacagggtttcatcatgttagccaggatgttctcgatctcctgacctcatgatccacctgcctcggcctccctaagtgctggtattacaggtgtgagccaccacacccagccaaacctttcctcttaaaatgttcaacttatatgtctaacgtctcttgtccaattttttcctcatacactggctacgtaaaaagtatgtgttggaggattagggaatagtgggacagtagaaagagaagttgagcaaagaaacacctgtctcctacttctctggttgaatttagaatacattgtctagcgccctagttaggagagagaaaaattccattctgcctctttgctcttccaaattcctatagccaagttgttcaacagcagttgaatggcacacataattgacatcattgattggaaccataataaaagtaagaagtgtgggtgtgggggaaactgggaagggagggagatgatgtatttgtgttacagacaaaagacaagttctgttcctccgcagggacaaatgaagaaattgtttcctctttttttaattattattatttttgagagcaagtctctctctgttgcccaggctggagtgcagtggcacgatctcagcccactgagacctccacctccacggttcaagcaattctcgtgattcagcctcccgagtagttgggactacaggtgtgagccaacacactcagctaatttttgtatttttagtaaagatggggtttcaccatgttggccaggctggtctcaaactcctgacctgaggtgatctgcctgcctcggcctctcaaagtgctgagattacaagtgtgagccactgtgctgacctgtttcccctttaaacagctccttttaccactccctcaaagtttgttccattgggagggtggagaaaagtagtgtcttttttttatcttaaaggggaggagacagaaaagaagaaaacagatataggattacacgttgtatctctccttgaaaaggcccaatatttattttcaaagtattatgaatgaaaagggaatgtaaaggagtggttaaatatttgtttagtcttaaaaatgctccaagaggccaggtgtggtagctcacgcctgtaatcccagcactttgggaggctgaggctggcggatcacaagatcaggagtttaagatcagcttggccaacatggtgaaactctgtctctactaaagatacaaaaaattagccgggcatggtggcgcacacttgtaatccaagctattcaggaggctgaggcaggagaatcacttg

SEQ ID NO: 180324 - DNA, 1447 bp, Homo sapiens
ttgagatggagtctcgctctgtcgcccaggctggagtgcagtggcaccatctaggctcactgcaacctctgcctcccgggttcaagcgattctcctgcctcagcctcccgagtagctgggactacgggcacatgccaccatgcgctgctaattttttgtatttttagtagagacagggtttcatcatgttagccaggatgttctcgatctcctgacctcatgatccacctgcctcggcctccctaagtgctggtattacaggtgtgagccaccacacccagccaaacctttcctcttaaaatgttcaacttatatgtctaacgtctcttgtccaattttttcctcatacactggctacgtaaaaagtatgtgttggaggattagggaatagtgggacagtagaaagagaagttgagcaaagaaacacctgtctcctacttctctggttgaatttagaatacattgtctagcgccctagttaggagagagaaaaattccattctgcctctttgctcttccaaattcctatagccaagttgttcaacagcagttgaatggcacacataattgacatcattgattggaaccataataaaagtaagaagtgtgggtgtgggggaaagttcctccgcagggacaaatgaagaaccagatgatggaataaactgaggtcagagagtttcccccattgtttcctctttttttaattattattatttttgagagcaagtctctctctgttgcccaggctggagtgcagtggcacgatctcagcccactgagacctccacctccacggttcaagcaattctcgtgattcagcctcccgagtagttgggactacaggtgtgagccaacacactcagctaatttttgtatttttagtaaagatggggtttcaccatgttggccaggctggtctcaaactcctgacctgaggtgatctgcctgcctcggcctctcaaagtgctgagattacaagtgtgagccactgtgctgacctgtttcccctttaaacagctccttttaccactccctcaaagtttgttccattgggagggtggagaaaagtagtgtcttttttttatcttaaaggggaggagacagaaaagaagaaaacagatataggattacacgttgtatctctccttgaaaaggcccaatatttattttcaaagtattatgaatgaaaagggaatgtaaaggagtggttaaatatttgtttagtcttaaaaatgctccaagaggccaggtgtggtagctcacgcctgtaatcccagcactttgggaggctgaggctggcggatcacaagatcaggagtttaagatcagcttggccaacatggtgaaactctgtctctactaaagatacaaaaaattagccgggcatggtggcgcacacttgtaatccaagctattcaggaggctgaggcaggagaatcacttg

SEQ ID NO: 180325 - DNA, 1499 bp, Homo sapiens
ttgagatggagtctcgctctgtcgcccaggctggagtgcagtggcaccatctaggctcactgcaacctctgcctcccgggttcaagcgattctcctgcctcagcctcccgagtagctgggactacgggcacatgccaccatgcgctgctaattttttgtatttttagtagagacagggtttcatcatgttagccaggatgttctcgatctcctgacctcatgatccacctgcctcggcctccctaagtgctggtattacaggtgtgagccaccacacccagccaaacctttcctcttaaaatgttcaacttatatgtctaacgtctcttgtccaattttttcctcatacactggctacgtaaaaagtatgtgttggaggattagggaatagtgggacagtagaaagagaagttgagcaaagaaacacctgtctcctacttctctggttgaatttagaatacattgtctagcgccctagttaggagagagaaaaattccattctgcctctttgctcttccaaattcctatagccaagttgttcaacagcagttgaatggcacacataattgacatcattgattggaaccataataaaagtaagaagtgtgggtgtgggggaaactgggaagggagggagatgatgtatttgtgttacagacaaaagacaagttctgttcctccgcagggacaaatgaagaaccagatgatggaataaactgaggtcagagagtttcccccattgtttcctctttttttaattattattatttttgagagcaagtctctctctgttgcccaggctggagtgcagtggcacgatctcagcccactgagacctccacctccacggttcaagcaattctcgtgattcagcctcccgagtagttgggactacaggtgtgagccaacacactcagctaatttttgtatttttagtaaagatggggtttcaccatgttggccaggctggtctcaaactcctgacctgaggtgatctgcctgcctcggcctctcaaagtgctgagattacaagtgtgagccactgtgctgacctgtttcccctttaaacagctccttttaccactccctcaaagtttgttccattgggagggtggagaaaagtagtgtcttttttttatcttaaaggggaggagacagaaaagaagaaaacagatataggattacacgttgtatctctccttgaaaaggcccaatatttattttcaaagtattatgaatgaaaagggaatgtaaaggagtggttaaatatttgtttagtcttaaaaatgctccaagaggccaggtgtggtagctcacgcctgtaatcccagcactttgggaggctgaggctggcggatcacaagatcaggagtttaagatcagcttggccaacatggtgaaactctgtctctactaaagatacaaaaaattagccgggcatggtggcgcacacttgtaatccaagctattcaggaggctgaggcaggagaatcacttg

SEQ ID NO: 180326 - DNA, 213 bp, Homo sapiens
gcacctgctgttatcgactctaaggatccccatcctttttttgtgtctgttgagatgatcatgtggattttgtcttttattctattggtgtggtgtagtgcattgattgacttttgtatgttaatccaatcttgcatccctgggataaatttcatttggtcatggtatgtaattgttttttatagccactggatttggtttgttagtattttg

SEQ ID NO: 180327 - DNA, 662 bp, Homo sapiens
gaaacaaatagtcatagctctgccgtaactgtttgaagtgtcaatttcagatttcaacttaaaattgaaatttcggatgacacacgcatgccttgtgcctaatgacaattttgtctttaggcacaaaacatgcgtgtgtcatctgaaatttcatgcttaattagctgtacattgcattttcattaaagagttgttagagtaaactattttcagtatagtggcaagactttggtccgtgtggtacaaatttcagtttatttaagataatctctgccccctccaaaatagtaggcaaaacattggcagtgcagttaataaagatatttgtaattttaggcgaggtatttggactcaaatcacttttctttagtctggaatttgttaattctgtttctaacaattgcttttctgacttcccaaatgattccgttatatatactcttaaaggttttgatatgtcttgaactaaaaatgttgaattttaatcaaataataatgtggggattgttactccagccagtctgttcttttgattatatggtatttcttcttgcacggaagcctggaatattttatctcaagatattagagagtttaattattgacttttatacaaaagaggcatatttagtgtgataaacagttttgaaaactgataattg

SEQ ID NO: 180328 - DNA, 695 bp, Homo sapiens
tgagacggagtctcactctgtcgcccaggctggagtgcagtggcgcgatctcagctcactgcaagctccgcctcccgggttcacgccattctcctgcctcagcctcctgagtagctgggactacaggcacccgccaccatgcctggctaattttttaaaaaatatttttagtagagacggggtttcactgtgttagccaggatggtctcgatctcttgaccttgtgatcacccatgcccagccatctttcttaatggcttcttttgaacatttttttgttcaggtttggtgtttgtagttaaaaaacagaatgatttttattttggtgaagtttaacttacctgtttttcatgttttacctgtaagaatccattgcctaatccaaggccacaaagatttacatgtggttttttgttttgttttgttttgtttttgagacggaacctcactctgtcaccaggctggaatgcaatggcgtgatctcggctcactgcaacctctgcctcccaggttcacgcgattctcctgcctcagtctcctgagtagctgggactacaggcatgtgccaccatgcccagctaatttttgttagtagagacggggtttcaccatgttggccaggatggtcttgatcttttgacctcatgatccactcacctcggcctcccaaagtgctgggattataggtgtgagcc

SEQ ID NO: 180329 - DNA, 555 bp, Homo sapiens
tggtgggagaccagagttttaatcattactcaaatcagtctctatgaacattcggggagcagagttttaaaggataacttggtgggtcacctgtaactacctttacctcctgtcgttctcaggagcggaggctggaggtgaaggtagttactggtgacgggcccagggcctgctggcaaatagcaagcctgaggctgaactgggtccctggatacaactcggcgtgggccacagttagcctcagtttccccttcaatctccagacctccttcacccttccgccttcgcctcccattcccaggtctcagatcctccttcagggcgctttgcttcgccttctccattctgtgctcctggtgcctccttgtggctaaaaatgtcaactgcagcaatgactgactaaattcgcaggaaaatcccagagattttaggctgccgagattgaaggacccttagaggtgattttagaaataactcgtatttgcatttttttcccagtggcgatactgatctgagcccaggttagaacccaggaaccctggtttctagacaagt

SEQ ID NO: 180330 - DNA, 417 bp, Homo sapiens
gtctgggctagaaaaccttcaggtctcagtataatgacttgtacatagaagtccttcttgttaatgctattggccaactaataatgaaatggggtaagagcccaaaagaagtttacagaatagatgaattttacatcatgttatagtggcacatactgtaaattacaaatagctagatggcaatgaagtaagggaagtttacactaaatatgaagacaaattaccagcaaatacaaccattttccaagggaaggacagaaaatccaacttaaatctaacaaggaaagacactctttgattcattcgatatggtcagaaaagcttgagacagtctataactctcaatgttatctacagttctgaaataaaaaactgtctacagtaaacattatgtgacaacatcaatacaaagtctca

SEQ ID NO: 180331 - DNA, 397 bp, Homo sapiens
aattacatattcaccgggcaggtggcagctgcaccactcgtcttctaggctgctcacgccgggcactgggtaaacgtggcaggatgtcctcgaaagaccgactgtgatcttcggagggatatttcatgcctcctggggttaatctcctcagattacacttttaaaagctcccttgtcttattacaactccaagagaaaagtacagtcaaatgttaagattcaaacaacaacaaacactccaaatcacaaagagagaagcatttacagagccaggaattctaattataggtattttccatcttacagaataggaccgcctgttggaagggctggtaaacacaattttcctaccaaagtacataaattctttaactgtaaaaaacacctgacaaaactc

SEQ ID NO: 180332 - DNA, 1050 bp, Homo sapiens
gttttcaaacaaatgtacttgctcccaggaggctgtgtggttgagtcaatttgctttgcctaatacttacgatttgctctcagtgattttaaatgcacaggcaccattcagtgtaattgatcttttgagtagaaggattatggcaagccatgttcttctttgtcacttatagaagttaaaagcaaatgcacatacaagctgatgaactggatattttccatattctttgcaaacatttcacttttagaagcatacatctgttttatacttgctaaaggatatacaacccaaagctttctatttctactaataattaagagcccttttttcttttacaacagcatgggtatattttattctactggagagtcacttaaatagttgaggacaaatgtgaatcccacttacacatcttctgtggaacagcatgatatgtgtataactctgaatcattcgagtatcatctccatgtgaatatgcatgtggttagaatagaggagtggacacagtctggaaatggtttgggtctggtttgttatttagttatcctgttaatatccttctacctatctgtgcttgctgtttgaacgggactggggttcaactttggatctccaacatggaacaataaagtctacatcgttcagtgaactttgggcataattactgtgtctaggacaccactacaatttcttttcactgttgtcttcctgcccatccttgaactcaccataatttgaaaaggcagtagatcatagaaaactaccaaaagaccaaccaagagctaaatagtttcttcatagcttctctcattttgcttttgctcaatttcaaattcttgggagtttccatagctaagcactgaaatgtgggcctattcccagtcaggaaccagataatcctttttgttggtatatatgttatgatgtagaaaatgaggagtcacttaaaaaaaattcaatggagaattccatttatttgtaggatttctttttctttgaggattcagagttggaaatgaagtgcctttggccttagagaataagatac

SEQ ID NO: 180333 - DNA, 618 bp, Homo sapiens
  misc_feature (432)..(432): n is a, c, g, or t
  misc_feature (466)..(466): n is a, c, g, or t
  misc_feature (477)..(477): n is a, c, g, or t
tgggagtagccagcagagccagtgaggccagggttcctgaccactcttcccacacatcacatgcagacttcctgggcggctgcaaggcccacagggcgtgaagaggctcagaaaccctccttgtcctttgaagctgcctaggggcatatgaatggaagtaaggtcacagcccctaggcgcatatgaatggaagtaaggtcacagcccctaggcgcatatgaatggaagtaaggtcacagcccctaggcgcatatgaatggaagtaaggtcacagcccctaggcgcatatgaatggaagtaaggtcacagcccctaggcgcatatgaatggaagtaaggtcacagcccctaggcgcatatgaatggaagtaaggtcacagcccctaggcgcatatgaatggaagtaaggtcacagcccctaggcgcatatgantggagtaaggtcacagcccctaggcgcatatgantggaagtaagntcacagccccataggcgcatatgactgcgaagtaagatcacagcaccatgcatcagcatataacctgaaggaaaggacaagaacccacgagaaggaagccaaaaggatgaaaaggaacagagccaaatacaggagaaaaga

SEQ ID NO: 180334 - DNA, 631 bp, Homo sapiens
caatgggtttgccgccagaacacaggtgtcatgaaaactacccccaaaagccaaaatgggaaaggaaaagactcataccaacattgtcgtcattggacacatagattcgggcaagtccaccactactggccatctgatctacaaaggcggtggcatcgacaaaagaaccattgaaaaatttgagaaggaggctgctgagatgggaaagggctccttcaagtatgcctgggtcttggataaactgaaagctgagtgtgaacatggtatcaccattgatacctccttgtggaaatttgagaccagcaagtactatgtgactatcgttgatgccccaggacacagagacttcatcaaaaacatgattacagagacatctcaggctgactgtgctgtcctgattgttgctgctggtgttggtgaatttgaagctggtatctccaagaatgggcaaacccaagagcatgcccttctggcttacacactgggtgtgaaacaactaattgttggtgttaacaaaatggattctactgagccaccctacagccagaagagatatgaggaaaattgttaaggaagtcagcacttacattaagaaaattggctacaaccctgacacagtagcatttgtgcc

SEQ ID NO: 180335 - DNA, 626 bp, Homo sapiens
taccgctgcactacagcctgagtgacagagcaagactctgtctctaaaaaataaataaaataaaacattctgtctcagtggctttccaaatcattggagacttccagaattcctaaaattttgccacaacacatcccagactgcctcttatatctaggcatggcacaaatctgatctttcatcagtatggatttttaatttcatgtatatagacattgtcatcgtcattggactcaagtaccttccactttctgcttcctctgtcattttctgcttaaatattacaatttcatttcctcagttgtaagtcattagaacagtgggatagtgtttggtataaagctattttgaggtaaaatgtctaaaagatatatttaatatccttagagctagcttcatttgcccttctttgtcagtgtttgggaaaatgattccaggagtccagaaattatgtctatctcacttgaatgagaggtggcagtttcacataaacagctcatatcccccttgctatgttgctgtggttactatgatccctgtgcatggaaacttgtttcagatgttgaagacagacacaattaagatggtttgtgtaataaacctaaatggaaaagagttaagaagtg

SEQ ID NO: 180336 - DNA, 509 bp, Homo sapiens
agttctgtgatccctgaactgagattgttcgaggacccgtttcttcctcggtggcccccgatggccctgctgagatgcagggatgcggtggcatcgctctgtcattcctcaggcagggtcccttcccagctggtctgagccactcacacctagagggcatgagcacttggacctccaagggcagagggggctcagaggccagcctccacctctctttcgtggacaggatttctgtccaggagcagcagggaatggtactcttatgccaactacacagcccgcggactttggacctagccttcagtatgtgctggcagcacagggttgtcccttgagggagccctggcaggaccctttgttgcactgttggaagctgcaccctccagtcttcactcctttgtcactaacctctaggttctcagagcctggattacagctccagcctctccagagaggagcagttagatatgtggcagtcagtcacactctagtgtaaatgaagccagccg

SEQ ID NO: 180337 - DNA, 430 bp, Homo sapiens
tggattcatctgaagtttattttggcatcaatagtagtgaaagtttgaaccttagtaatttttactaatgccatttattgacaaatcaattttcaacattgatttgaaatgctgcttttattgcataaaaaatccttatatatactgatcatcttctggactatcaattctattttgttgatctagttttctaatttcaaattatttaatatccccatagcagcatgctaaaatgcaaaggccctagaatgagggtgactgaggtcaaatcctaactctcccatttatgaaatatgtgactttagcctagcccctaaagtgtatttgttcttcagcttcctcatctctaaaaagataaaatgtcaaactagtattgcctaatgactccttccctaagccaaaatcttgagatggacagaagagaggaagg

SEQ ID NO: 180338 - DNA, 658 bp, Homo sapiens
  misc_feature (628)..(628): n is a, c, g, or t
  misc_feature (657)..(657): n is a, c, g, or t
acgttgacacttcagaagggacacgaaaccagtgggaagaccagattggtgggcaggaatgatgagcctgagaaagggtaaagagggagcaaagtgtgacgggagacctggacccaaacagtgcctctgattcatttgtttcccatctagtcagatgtatccagaacaaattaggacaactgaagaggcgagttcatgcctccttcatgcctgcatcctgcctctacagctcccacggcattcccaacataggatttcccgtagccttgttgatgggggaaacccccaaggaaattcaccagatgctgcagatcaagggctgcctgaggatgtagtgagctcctgagcagcactttcaaaactgaattagatgagctaggcatgttttttccgtgtcgtcccttaacttacagtgcctcacttaatcatcacaaggaagctggatcacttgaggccaggatcacttcaagtccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagntatcttgcatacaactgaagtgtcaacgnt

SEQ ID NO: 180339 - DNA, 373 bp, Homo sapiens
  misc_feature (22)..(22): n is a, c, g, or t
aaaaaaaacaaacaaacaaacnaaaaaaaacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcatactggagagaaaccttacagatgt

SEQ ID NO: 180340 - DNA, 1204 bp, Homo sapiens
atgtaaacatgtcgaaaaacctatcaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagacttgctaacaatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgcggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagagcaaccttacaaatgtaatgaatgtgggaggccgaggcgggtggatcatgaggtcaggagatcgagaccatcctggctaacaaggtgaaaccccatctctactaaaaataccaaaaattagccgggcgcggtggcgggcgcctgtagtcccaagctactcgggaggctgaggccaggagaatgggcgtgaacccgggaagcggagcttgcagatgagccgagattgcgccatgcagtcccggagtcccggctgggcgaacagagcgaggatccgtctcaaaacaatacacaacaagcatcgcaaaaaaccactgtttgaattgtgccaagctctcagtacattcactggtgccttccgaaacacgggagaaactaacga

SEQ ID NO: 180341 - DNA, 1142 bp, Homo sapiens
tcatctgctgccaattaattggggaaaaaattgagctggatttctttgagagaaaagaaaagctcctgccacacaacgtcgcgccctcggcattttgtctgagaacctccagcactagcggctgtttctgtgtctcccttctttgctggctttattattgaccataatgcctgcccacttgagcaactctgtccttgagcgctgaggagtcaagggcccttctggcagccccccaaacaggatggcgcccacagaaagaaaggaggctttgtaggggaagagggccccaccgcctgccagtcccgtcctgaagtcagaagaatggcccaggctgacaccctctcctggagagaggctcacagcgtagctgttcccaggaaaggggtgcaaagactccgaggcttcaggaggcaggccctgtcctcacagggcggctgtgggccggggcccctctgtggcctgagagtgagcaggagggaaacctgaagcagctacccgcaaggcgtccggtcaacagggtggagctgcaggctccctctgcccattcccagaaccagcggccccctttgtaagatgctgaacacgaagttccggtagctccccagacgctgtctcagaagtggtgatatcattgaccaagggcctggcaaggaccggcagccagggtccccatttgctcttgcagccctagggactgtgcaggtagaagccctgccagcagagcaggctggcgtttggtgttggcccacagacacccgtgaagggtcatggccgaatcaggcagctgtccagccaactgtctctccacccttccagaattggtgatcagcgaagaccaaattcggcaagccatccagagggagtgcagggcgcacagtcttagatgtgggcgcacctcccagaaccccacggggacttgttcacaggcgcgcttgcaggagggcaagccccttggtcctggaacacaggtgccccttggcctttccacctccctccttggggctgtttgcatccctgccaggagccttaaaccagccacctactgctgaagtctcttgtaacattccaaatctatgtgacacactgtataatgatgaatatttaatgtgaagctcttaatatactacaagtgtcttgtttac

SEQ ID NO: 180342 - DNA, 1118 bp, Homo sapiens
tcatctgctgccaattaattggggaaaaaattgagctggatttctttgagagaaaagaaaagctcctgccacacaacgtcgcgccctcggcattttgtctgagaacctccagcactagcggctgtttctgtgtctcccttctttgctggctttattattgaccataatgcctgcccacttgagcaactctgtccttgagcgctgaggagtcaagggcccttctggcagccccccaaacaggatggcgcccacagaaagaaaggaggctttgtaggggaagagggccccaccgcctgccagtcccgtcctgaagtcagaagaatggcccaggctgacaccctctcctggagagaggctcacagcgtagctgttcccaggaaaggggtgcaaagactccgaggcttcaggaggcaggccctgtcctcacagggcggctgtgggccggggcccctctgtggcctgagagtgagcaggagggaaacctgaagcagctacccgcaaggcgtccggtcaacagggtggagctgcaggctccctctgcccattcccagaaccagcggccccctttgtaagatgctgaacacgaagttccggtagctccccagacgctgtctcagaagtggtgatatcattgaccaagggcctggcaaggaccggcagccagggtccccatttgctcttgcagccctagggactgtgcaggtagaagccctgccagcagagcaggctggcgtttggtgttggcccacagacacccgtgaagggtcatggccgaatcaggcagctgtccagccaactgtctctccacccttccagaattggtgatcagcgaagaccaaattcggcaagccatccagagggagtgcagggcgcacagtcttagatgtgggcgcacctcccagaaccccacggggacttgttcacaggcgcgcttgcaggagggcaagccccttggcctttccacctccctccttggggctgtttgcatccctgccaggagccttaaaccagccacctactgctgaagtctcttgtaacattccaaatctatgtgacacactgtataatgatgaatatttaatgtgaagctcttaatatactacaagtgtcttgtttac

SEQ ID NO: 180343 - DNA, 138 bp, Homo sapiens
aggctggaccgccatgcactcttttcttcactttcacaatgattttctgctcctcaataaggaaagcacacttgattctgtcatgaacacactgagcacacatggaaccagggaagcactgcaggccctatagacatg

SEQ ID NO: 180344 - DNA, 812 bp, Homo sapiens
  misc_feature (757)..(757): n is a, c, g, or t
  misc_feature (762)..(762): n is a, c, g, or t
  misc_feature (765)..(765): n is a, c, g, or t
ggcacagtggctcacgcttgtaatcctcccaaagtcctgggattacaggcgcaagtcaccgcgcccagtcccacctctcactttaaaccaatcctctgcacaacagtccccatatttcaggcaacgtttgcctggactatgcctctatgcctcggtggcaaggggtaagtgtgggtggcagcatctcggtgcaagggtggaagaggcaggagctgcttttcacagggcattacaaatcttgctgagacctcagaagcagactaattccatatacaatgcttggatgtgttctgtgaagtgatttgattttttttttagccaggggtccatatatattggggaatcatatatttcatcaaattcacaaatattcaaaatattgctaatgatttattctctattaatttattcataatttgctcataattaattcctattactttatgatacccctgacaagtctactcaaacatctcatgctggagaattcaccactttaaaatagttcatttcattgacacagtaaaaatatttctctctagtctgcacccttgtttcgtcctctggatttgatgtgaaagtctttccaaaaaacagcccctgtttctcctatgatcttcttttctccaagctaagcagttttctctaaccacaccccttcaatggcccatgatgaggtttcagcagcttgagagacagctggttaataaaatcgtgttgtggaaacaaacaacacaaaagaaaaaaaaaaaaaatntgggnccnccaaaattaaaaaggtggcgcgccgataagaaagaagggctcaaacg

SEQ ID NO: 180345 - DNA, 1054 bp, Homo sapiens
ggaccattctcccatgggcccaaaccagaaatacaaagtcaccctttgctcacttccctcccaccacctcccagatcgggctctttaccttcggctctcatactcttaccgagaaatggtgtcccccgctcagagtaagtgagtgagtgagagggcccaggtgcaggcaggtgcctgtgggggtctgcactccttatgcaaatatccctatgctccagggtacacaacattatatagcaaattaaaaaaaaagaaaacaaaaaaaaagaaaaaaaaaaaaaaaaaaaggggggggcgcgcgcccacaagagaatataccccgcgcggggggcgcccaggatgaaagcgcgcgcaaccccacgttttcgtcggggccaagaggggggcccactaaaggggagagagggaatattataaaacgcagagggaccgcgggcgccgcgcggccttataacaaagaggcgcggagaagctggggaacacaagcgggaaaccgcggggaaaacccttggggagaagaggaacacctataacaccgcggggggggggagccacaaatatgggggacaacaaacatccccaacaggagaaaatattataggagcgccccatcagaggggaaaactatacttacaaaacttcaaaagagggggtatataagtgggggtataacacaagcaacgcgcggactatatagtcaagtcgctacgattagcaaaaatttaggggcaaccaccgagaagatttactacatttaagaccaaacactttttttatcaccacgagagaactaaaatagagaaaaaaaagaagggagcatactgttgggggggggtagacaacgaagaaaaaaagaacacacgacgagcccaacaaagagcgcacaacccacaacacaccaacaacaacacaccggaaaggcaaaagagacagacacaaacaccccaaacccacgtagagggccgaccaacacacaaccaacaaagcacacaacaagcacaaccacacagaaaaacaaaacgaacacgaaacaccaccgacccaacaaaaagca

SEQ ID NO: 180346 - DNA, 598 bp, Homo sapiens
tgacaagttctcactctgtcacccaggctggagtgtagcagcatgatcagagctctctgcagcctcaatctcctggactcaagggaccctctcgcctcaacctcctgaatagctgggacaataggcatgtgccaccatgagataacgtttttttttttttgtagaaatggggcctatgttgcccaggctagtcttgcctaaagaaaggtctgggttttacccttggcttcttggaggtaatctctagctcttggaacatcatgcctgataggaacatctttgctttcctggggaccttgagccagcaagatattaacaatgtgatttaaagtggggttggagctttgagtcacaggctacatgtcctataggtctgaaaacttaagacagccacatgcacagtcaactatctagtaatggataagactctggacatcaaggctcaggtgagcatccctgcttggcagtactacctaagcaatgtcacacattgatgccaggaaatgctgtcctgattccacagggagagaacaataggaagcttcacatttggtactgtcttgggcttttctctatgcttcccttttcttgactgata

SEQ ID NO: 180347 - DNA, 530 bp, Homo sapiens
tctgagacagagttttgctcttgttgcccaggctggtgtctcggctcactaccacctccgcctcccaggttcaagcgattcttctgcctcaacctcccaactagctggattatagccacccgccatcatgcccggctaatttttgtttttttgtagagacagggtttcaccatgttggccaggctggtcttggactcctgacctcaggtgattcgcctgcctcggcctcccaaagtgctgggattacagttgtgagctgctacgcccggcctgaagtgtgcttttaacactttgtaggaatgctagtggcaaagctaaggcttttgcttaaacctttgcctcctgggttcaagtgattctcctgcctcagcctccccagtagctgggattacaggcatgcgccaccacacctggctaattttgtatttttagtagaggcagggtttctccatgttggtcaggctggtctcgaactcccgagctcaggtgatccgcccacctcagcctcctgaagtgctgggattataggc

SEQ ID NO: 180348 - DNA, 240 bp, Homo sapiens
attgggttcttttgtcatgcaccacataatgactagtttttcttcacgcttatatcccttaatactttggggcttcagaatggtaatattctaatattttatttttgtttttatttattagctgaaataattttgtgcttcactctcatctactctgattacagttcacataggaaaaggggggtaaatatgcttcttcgatagcagaaatggcagggcgttccagcttcatcttgaaca

SEQ ID NO: 180349 - DNA, 666 bp, Homo sapiens
gagagtattttaaatggctggagtttggaggaggcactgaaacagtaacgtctgactcctatttcactcaatttttgacaagacttgggatgagaatgaagaagagtgataacaattgaagagaattttattcgctttcattctttcacagacacctgccccaatagcacacaccccaaatggacaaagttcagctctgctgaagccggcacattaaatgagtgaaatatttttagtaagagcagtggccaagtacaatgacaattcgatttttttttcaaatgacaactcccgcctctggcagctcatctctctttgctgccatctggtgtcacctcacatgaacctgacctgggtacagatgaagggactagaatccttcaattctagggttctccagaaagggactgagagttaagcaaacccagttctggaaaatgaacaaatatggagaattgaagccccaaatttgacacattgagattttgagcaataataaatgcccggggtgtgggcagggtttgaccgtcagtaggctggccttgccatgccgcctgaaattagaactttctacatgataacatttggattaatcagaagacagaggactcactatcttgagcaccaaatggagcacttttcattttaaggcccttaagttttata

SEQ ID NO: 180350 - DNA, 672 bp, Homo sapiens
actgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaa

SEQ ID NO: 180351 - DNA, 229 bp, Homo sapiens
gccatttctgattcaaaccactttgtttctggaagccacttatcctacccaggaaaagtgaacaacgctgctaatgaccaggccagggtactaggccttatcaggggattttaattagtcccacactaaagaggccataaacctaaaataaagcaaaataaaacaggggcaggtgtcttctctcctattttgatcctttatagcgtttttgattccagtttactttctg

SEQ ID NO: 180352 - DNA, 255 bp, Homo sapiens
gtcccttagttcaaccataatctaagaaacagaattgcaaacatgctacatgactcagtctccagggcttagcttcccccttggcgttttacaaaccctatggaactgctctgcccattgtgtgactgtgtttatatttaaattgaaattgaatataaattaaaattcagtccttctgtctcattagccacatttcaagtgctccacgatacctgtggccagacagtgggggtatagtctaaaacacctccattg

SEQ ID NO: 180353 - DNA, 448 bp, Homo sapiens
aaataatttgctatattctgcacaacaaaccctgcttttcctgggaaggggtaattatccccatggaaaaagaaaaaaagaaaaaaatacgccatctcatattaagctaaagtctcatcaagaagagaaaaagtgcctcattacatgtaattaccagggaattagaaacatcatttaactaaatgagcgaataatgctcaggatattgaagaaacttgcctgcacttctgcaaagcactctaagtcccattacaaaaattgcccctctttaatggaataattttaggccttgtctgccttgctttaaaaataaagagcctccgagcggcagaaagaggctgaaactgccataaacaactgttgaaagggactgaagggaaggcgctgtctctcttggagaccaagacccagaatgactcataatctaccataatcaggaaaattaaac

SEQ ID NO: 180354 - DNA, 365 bp, Homo sapiens
gcttaagaaaatgttccaccactgttttcctatgagtccgatgatatgagtcagtccacagaattttaaaaactatctgtagtaattgctcaaactcaaaaaggaataatgtagaacctaaaggcagctgagacgtaatgaaaagaattggacttaaattcagaaggttgaggcaattccctagcccagtttttcctaacagcttagacctttccaaaacaagtatgccaatacttaacagagcccttgtgagaactggcatgatgtatggggcagaatagtctacacaccaatgtaaagctcttctatagaatgttgttttgaatccaaaacgtaaaacgcaaattacaacgcagcaatgaaaa

SEQ ID NO: 180355 - DNA, 267 bp, Homo sapiens
cccacagagcactcttcatgaagaaaagtgtgggcttgctgtcttttcatcaaaactcgtagaatttggctgactgcctggtttatcccaggacattagtcagcccacaaatcccgcatttgtttattcagtccagagcaagtgaatactgccattttctcatctcctttgttggcaacactttgttaacctgaattgggttctcaacataaaatgaagtgactaatcttttggggggttccccctcccaggttcttgtatgagcaa

SEQ ID NO: 180356 - DNA, 186 bp, Homo sapiens
taggaggatcgcttgaccttgggagttcaataccagcctgggcaacacagctagaaaaaataaacatcactacaaaaaataaaaaatataattagccgggcatggcagcacacacctgtagccccggctgtttgggagactaaggcaggaggattgcttgagcctaggaatttgaggctatagtgg

SEQ ID NO: 180357 - DNA, 572 bp, Homo sapiens
tcaaaaaaaatctccaaatttttcccaccatctccacatcccacaagttttcccagttcattccccttgtgcacactgggtatatatgcaagatgcattacaacgctcttttgtgcaaatgttacacatacttcagaataagacaaagtccactaacaaggacgatcagtcataatgtagagctctgcatttctaaagtatagtcttcagcccactaaatcagaatcttggggagggggctgggtggtagcccaggaatctgaatgttgagcacctgggcaactctaatgtttattaactttgagaaccaataggttccctcatctagtagttgctgagcacctactatattctaggtactattcttggcccatgtcctcagataacttatattcttttggagtatggggtgggggccagacaaataagaaaataaattcaatagtttcagatagtaagaagcactacaaaggatgtaaaactggtgaatgaaaaaatgactgctaggggatgcaatggaggggataagcattccaggaaagtttctctacagaagtgacatgtgggtagag

SEQ ID NO: 180358 - DNA, 640 bp, Homo sapiens
ggcacgctcctgtagtcccaactactcgggaggctgaggcaggagaatcgcttgaacccaggaggtggaggttacagtgagccaagatcgtgccactgcaccccagcctgggcgacagagcaaaactctatctcaaaaataaacaaataaataaataaaataaaaattagaaaatcccactgagtgtaggagaaagctactagaacaaataggtgagtttggcaaagttgtagcctacaagttcgatatacaaaatcagttgtatttctatatgtcagcaataaacaatctgaaattaagttttcaaaataataatttataatagcaccgaaaatatggaatacctaagggaaaatctgacaaaaagtaagtaagcaaggcctgtttattaaaaactataaaacattgtggagtgcaatttaagaagacctaagtaagtggaaagaaatatcatttttatggactggaaaactcaatattgtgaagacatcagttttctccaaattggtctatagattcaatgcaattgccattaatatgccactaagattttatgcagaaattgacaaacatttttaaatttatatgaaaatgcaaatgatatagtatagccaaaacaactttacatgtggaaagattt

SEQ ID NO: 180359 - DNA, 126 bp, Homo sapiens
ctggttatttgtttctgctgatttttctcatctcacaggtttctcattcccgaaggtaatttaggatgatgttacttaagaactggagttaacttagtgaccagatattaagccatgaatttcttg

SEQ ID NO: 180360 - DNA, 306 bp, Homo sapiens
ggaaatgttcagtggactatgggtgtgtgttgccaggcaaccagtgagaaggataactcagggatagaatacgagaagtgctctacaataaaggggaggatggtacatcacttggtaggcttgtgctggaggactggggaagacaaaccagctgaagcaggacttgaatgacatggcatttcacaagtagagaactgcggggagctgaaagaaggtcatcgtgggatgatgttagagggtgagcagaagcctctatgtggtcaagatcagggtttatttaaaggctattttttaaatgaccaatat

SEQ ID NO: 180361 - DNA, 297 bp, Homo sapiens
acaggtcatttcctatagggagggcagtagtataagcaaaacaacaaaatattcaaaattctcaaataagtactatttattattgaaaaactcagataaatgtagaagttattttttctctctattgagcagcagttacatatgctagaatcatagtttgaatgattcagactgtgtacctgtgatctgacatacctggattggagttccatctctgccacccactttatttgactccatagagaaattactcaagccccttaagacagacactgaaataggatacagtttccaaga

SEQ ID NO: 180362 - DNA, 195 bp, Homo sapiens
atattgggctaagttactcttgaggatagagcaacccctaagaacagtgtgttgctttgaattttttatagggatgtggtcttactctgttgcctcagccttctgagtagcttggactgcaggcatgtgccaccaagcttggcttgaaattattttaaggaatggttgggtagcacttctatgtcctgtaacttc

SEQ ID NO: 180363 - DNA, 451 bp, Homo sapiens
gagtcttgcctgaccgccccacgcacagtggcacctcctcataccctgtcacacatctggattcacggtcttccttgcgccttctgctgtctgaatatatttgactgtgtgtttattgcttatctcctcactagaatgtgagtttcatgagagtagtaggaatcttgtctggcttgttccctgccttatgcccagggactcagtgattatttgtcaagtgataaatgggttgtggaggtgagtgctccctagcacagggtccagctgtctgcaggcattgggaatctagcccattgtattatcgccagttgttctcctgtctgtctcttcttcgtccccgtattggcccacaagtcctccagggtggctcctactgctccctctccatatacctcacacccagcaacagcctggcactgagatgggactcaatgacgcttgctgcgtgaat

SEQ ID NO: 180364 - DNA, 450 bp, Homo sapiens
aagggcaaaatgcctgactgacatatttcctagatgaaccttcccctcacttacagaactgtttcacctgtactgaaaagaaaaacacacatgtgccataatggaaagaacacaggtttcagaactagacatacctgctcaaatccttgtccacagtactctccactgtaaaagagggatactgacatgttaaccacaaggctgttgtgatctataaagcatctttatgtacctggcatatagtatattctcaataaagatgagtttcactagaaccagctctccttcacaaccaaactctggagaataattttactcatttctcctcatttattcctcaatccatcatgatctcactactaccttctttgccatccccaccctaccaaaactgcatttcagaggaaacaagtgacctcctgattgctaaatatagggcaggccaggcat

SEQ ID NO: 180365 - DNA, 341 bp, Homo sapiens
cgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataata

SEQ ID NO: 180366 - DNA, 489 bp, Homo sapiens
ggaatgccatctacggtcaccctaacagagcaatctgagaggcacttctgagccctctctttcaacccaatatctatcaggtttatcatccttattaactcctcaaaaagacctattattccctttctcttcagttactctcttctgcactatccctttttgtctactgtaaacatattaatatttcaagggtcatttcccaactggaacctagcacaacttattaagatagtactattataaaaatagggacatctgcttccaccatgatgccctggttaactgctgtggaaattgccctcccatagtaaaaaactaaggactcgaaaaattatatgaaacaccagttttcagacactgaacactgatcactgaacatgaacattaatcacagttcaaaaccatgatccatgagggaaaaagcagcaaatgaggcaagctgtctgaatgccccaacgtagtgtctggagagttttgaggatccgtgac

SEQ ID NO: 180367 - DNA, 268 bp, Homo sapiens
cttgctgatccttctgcctgtctcatgtgcagctctgctactggaatagtcacatgcagacatttacagatctgggtttctgggaattctaaccacattaggactgggaggtaatatatctcaaaagacacaataagctgggttgaagtccctgttcctactcactagctgggtagcctcgggcaatctgctcaatgtctttgtgctcctctttcttcgtctttcaaatggggataatgttagttcctctatcaaatagccataaggg

SEQ ID NO: 180368 - DNA, 1257 bp, Homo sapiens
taatcaaaatcagcttacttatatcacatttatggtgtataacaatcgtgacctgaaggaaggaaaaagggaacagagtaaacaaaatggcaagccaaaagtatggcagccatcattgacgatgccctgaatgtacaaagagtgtctaagggaaacccgaagggccataaagataatgccagcaaaggctcttgcttcaaatgcaagaaaagaagacattgggcaaaggattgtgctaagtccccgccaggcccctgccgtcaatgcaagggcaccagtcatgacccctggcactggagaattgactgcccatgttcccactgaggggctcagtcagtcaaaactctagcagtgcaaaaggaggaattagatgaagactgaaggggcctgaggtcttcctcactgcccctgttcaggaacattgtaattactactgaggagccccaggtaactctggacgtcatgggcacccaaattcagtttctttttgatgcaggagcaaattactctgttcttactgcttatgcagtaaggcgttcctcccagtccacaagtgttatgggaatagaatggaagccacaaacgagtttttattttattttattttattttattttactttaagttctgggatacatatgcagaatgtgcaggtttgttacataggtatacatgtgccatggtggtttgctgcacctatcgacccatcatctaggttttaagtcccacatggattaggtatttgtcctaatgctcttcctccccttgcccccaaccccccaacaggccttggtgtgtgatgttcccctccctgtgtccatgtgttctcattgttcacctcccacttattagtgagaacatgcggtgtttggttttctgttcctgtgttagtttgctgagaatgatggtttccagcttcatccatgttcctgcaaaggacatgaactcattcttttttatggttgcgtagtattccatggtgtatatgtgccatattttctttatcccgtctatcactgatgggcatttgggttggttccaagtctttgccatggtaaatagtgttgcagtaaacatacatgtgcatgtatctttataatagaatgatttataatcctttgggtatatatccagtaatgggattgctgggtcaaatggtatttctggttctagatccctgaggaatcaccacactgtcttccacaatggttgaactaatttacactcccaccaacagtgtaaaaatgttcctacttc

SEQ ID NO: 180369 - DNA, 315 bp, Homo sapiens
ttaatgtatatgcacatatgtaagtatatttcccttctccaaagggaaaagctctacacagtttcacatgctccagcaggcttgtgaccaaggactggggacactatggtaggcagagtcctctgcttaaaccctgggagcccttcagagagatgtttacctgttaaaagtcgtttcccctcaagcctcactcagtgggcctggagctcaaaagtcagctcaaggtcattatttctaacgagaatccagagcaaggtatcagtctctcagatcctcccttgtgcttgatcatccaaattattactatcatcctgg

SEQ ID NO: 180370 - DNA, 135 bp, Homo sapiens
tgtaaaatgagagaaagaaggtaatcagggaaatttggtaagacatctactcattctaagcagcacagtatgaacaactgaattctgatttccaaaatccctgactttgacttctggctctttcacctagtagct

SEQ ID NO: 180371 - DNA, 368 bp, Homo sapiens
acctgtcagtggacattccctgtccccattctggggaaatgcctttcaggaaaacagacctacaaacactgcagcagagtagtcctctgacagccccctacaatgggccttcattcttgggtataaatagccaaataaggattgctagacatttgaggaaaaccatcagcataaaagagaaggaccaagaaaaaaataattcaaccagcctcagaataaagagacataactcagacaacagaagaaacttaaggcacttccttttttgagacagggtctccctctatcgcccaggctggagtgcagtggcatgatcttgtctcactgcaacctccgcctcctgggttcaagcgattctcctgcctcag

SEQ ID NO: 180372 - DNA, 206 bp, Homo sapiens
ctcagaaggaatgctggcaaggctgatggctgataaggtcaagcttcaccaccacctaatccaagaactcagggtggatcagcactttctcaccagagataacgctgcctctttcctagccacccagaaagactttcaatgtagactttgagtaactcctaggaactaggataataaacaaagtcatattcctgctgctacaaggg

SEQ ID NO: 180373 - DNA, 242 bp, Homo sapiens
gcatatagtagcaggagctcagtcagtgtttgttgtctgagtaaatgtcactcctgccttgcatctaacctgcagttttcacaggggctcatttgtggttttgcctgctgtgccttacagccagtatttgtccatatattttctattacccagagattgttgacatctcatctgctgcaccttgtaacccccatctctaaaccagtgatctccatcatatttttgacctgaaaatttttgta

SEQ ID NO: 180374 - DNA, 835 bp, Homo sapiens
aactccctgaatcaaatggcaatacagagactaagggttcttctcgatttggaaaattcgggtcattttgcaaaccaatggtatgttctgtatgatgggaaagaaaatagtttctcagcagacgatatttttggaaataactaagtccccttcccctaccccctgacaccaagaacaaggctccaagaagctaggggtctggcccagcaaagacaagtgggaagatgcctttgactctatggtactttccagggaggcagcagatgaaagccatgtggtttaaagggccagatagtaaatatttcaggcttcataggccatttgtggtctccatcccatacattttatcttttaaaatatttcttccaacgctttaaatgcgtaaaatccatcaggcgtggtcgcgtgtgctgatagtctcagctacgtggcaggccaaggtaggaggatcactcgagcccaggagttgaaagccagcatgggcaacgtagcacgacctcatttcttaaataaataaataaaattaaaaggtaaagactatccttagcccaggagccacacagaaacagttactgagctggatttggtagtattttgccagcccctgcctgaggaaacaaaggaaattaaaaaacctctcctggccaattcactctgtcctgtggcagggaacaacacaaatgcagaaactgtcccagatgtgactggggccctgtacaaatggagtgaggcactgcaaaagaacacaagttgagagcagagtgtggtagatgggcccttccatccaagccgccacagacactcagaggcagaggaaatcgagctcactaggtac

SEQ ID NO: 180375 - DNA, 454 bp, Homo sapiens
tgtattcccagtgcaggcagctcctgcgggactctgtttcccaaataaggtttgcctagttccaccctttgcctatgctgcatcacctatgttttagttggaacctaacactgcaccccttcccagctgcaagtggtgacctcaggaatgtcacttccccctggggggctcagttgcatcatctgtaaaatgggtcatcgtcgtgaattacacaaggaaggtacaaggaagtgcctcgaatacacaattggatttgctctcaggagaaacaggatactctgtgcccaagaaagattagccatctttcatggcgtgccttcgttcaaccaacacttgaccttgactccgccccttcttagcatccagctaagtgcagagagaggcagaaacaaacacccctgggctccagatctgccacactgggaaaataccagctgaacggtttctccagccg

SEQ ID NO: 180376 - DNA, 237 bp, Homo sapiens
gcacatgcatcatctggggatgttgctaaaatgcagatgagggctcagagggcctggggtggggcctgagagtttgcattccttcacactctcaggtgatgctgatgctgctggtctgaagactacattttgagcagcaagattcatagaaacactttcctggaaacactctcttggttgtcctcctgcctcatgggctgttctttctcagtctcctttgctggctgcgtgtcctca

SEQ ID NO: 180377 - DNA, 506 bp, Homo sapiens
ccgacacatctggctaactttttaattttttgtagagacaaggtcttgctattttgcccaggctgatctcaaactcctggcttcaagcaaccctcccgccttagcctctcaaagcgttgggattacaagcatgagccaccacccagcctgttgctcaaactttaaacatgaaagacatgtaaacggaaatcttgaggcttcaaaaactataatgcactggataggatccaaaatccaactgattcttactgaattctaagctctaatgaataaggttatgaagagttccatgtttggggcatgaggcagcatctgattttaaactgaatgcaagtggcttcttttttttttttttttttttttttgagacaaggtctggctctatcacccaggttgaagtgcagtggcatgatctcagctcactgcaacctccgcctcctgggctcaaaccatcctcccatcttagcctcctgagtggctgagactacaggtgcacaccaccatac

SEQ ID NO: 180378 - DNA, 409 bp, Homo sapiens
gtttgcttggcatttcataaagggcagtgatttctgcaatattggggttatttacagggggagagcacctatcaggtctcaactctatcttacaatagactaaacagggtaaaggtgttctttagcaccttggggctggggaggaaagggccaggtttgagggaagggggaagaaagaaggattggagaggagcaagttccctgcaagaaaggtgcagtgtggcaagacactcctagagaacacagtggctaccttctctggcagccaattttaaaatcagattttcaattctcattgtacttcaaagcatctgcattttttaaagatccccagatgattgagtcctatcctgtggatattctgattcaattggtctagggtgagaaccctgcattagggttttttttt

SEQ ID NO: 180379 - DNA, 536 bp, Homo sapiens
ccccgcgtgcccagccctgcaccaaagctgccacgttagagttctgttgagtggcgctcactccacaggtgttcctagggccatacaggcctaactgtccccatcccagcaacctgtggagtggccccatgggcagggcacatgtgcagagtctctgggtgccactgactgactacagaccttgggacagttcctcacttcatctgggcctcagcttttcacctgcaggaggacctcctagtctttcgtctttaggttccttctaaccttgctaggctgtactagctagtatgacttattttgcgctgggcacctcaaagacgtactcctttctaaggcctcagggactgtagccaccagcttccacatatgagcgtggcaagcaggtgacggtcatccacagtttcgggggtggactccatcccaggcccagtaccaggcacaaggactcatcagttaccccttgtcaaacctgatggccacattgcctagaagtttcctgccaaatcaggaccaaataagccacttccaaagtc

SEQ ID NO: 180380 - DNA, 104 bp, Homo sapiens
aggaaaagagaggcaaaaaaagaaaaggcacacatttaacagcatcaggagagatacaggggatagaactacagaccccacagacatcactgatacttaataag

SEQ ID NO: 180381 - DNA, 189 bp, Homo sapiens
tcccctaaatgccattattccccaggactgtcttcggtccattatcctccaactctctctagtcaaactattcctatagcttacactatcatccacatctaattaattacacttcatatcaccagccccatctattctgagcttcacatccagattttcgactgtttactggaccaggtggttttcaga

SEQ ID NO: 180382 - DNA, 273 bp, Homo sapiens
gtggattacaaggtcgggagatcctggctaacatggtgaaactccgtctgtactaaaaatacaaaaacaattagccaggcgtggtggcggaggcctgtagtcccagctactcaggaggctgaggcaggagaatggcgtgaacccgcattctcagcttacaatcctatccatagagggggcccaggatccttctcaaatgaatgaaagtagagtttaagtctgcagtttttttcctctttggaaaaaaacattcctttcctgcccatgacccag

SEQ ID NO: 180383 - DNA, 324 bp, Homo sapiens
cagccggtccaacatgcgaacggactgatccaatatttgtgacgaacatagaggtgcgaagttgtccttgaaaaggtgttggatcagtccgttcgcatgttaacatgcgaacggactgatcaataaagggagtggattagaagagcaagggtcaaaggaaaaaaaaaggaggtgaactctgtatttttagttttttttaaatgtagtcaaaccatattataacactggaaccagaagaaaaaagtaatgttctaatcctaggaaagcattagctgtctgggcttttattgagaaagttttagcaggatcagtcaatgcacattt

SEQ ID NO: 180384 - DNA, 1799 bp, Homo sapiens
  misc_feature (161)..(161): n is a, c, g, or t
  misc_feature (702)..(702): n is a, c, g, or t
  misc_feature (1085)..(1085): n is a, c, g, or t
  misc_feature (1191)..(1191): n is a, c, g, or t
  misc_feature (1655)..(1655): n is a, c, g, or t
  misc_feature (1798)..(1798): n is a, c, g, or t
ggggaaaatcatgtaccttggagttgtggaggcatgtttataagcagatctgagttttgccacactggaatttatttattcattgaacaaatatttaatacctactacaattcttagccgtctgttagagattgctggaggtccactacagacactgtttncctggatatccccagcagaggctacagaacagcaaagattcctgcctgccccttcctcttgaaggtttgttccagagggacacctgccagatgccagccagagctctcctgtatgagatatgtgttgatccctgctgggaggtgtctccagtcaggaggcatgagggtcagggaactacttgaggaggcagtctgtcccttagcagagctcaagtcctatgctgggagatctgctgctctcttcagagccagcaggcagcaatgtttaagtctgctgaagctgcgcccacagccgccccttcacccaggtgctctgtctcagggagaagggagttttatctataagcccctgactgggtctgctgcctttctttcagatatgccctgcccagtgaggaggaatgtagagaggcagtctggccacagcggctttgccatgctgcagttagtcttgcccagtccgaaattcctggcagctttgtttatactgtgaggggaaaaccacctattcaagcctcagtaatggcaggtgcccttcccncaatgaagtcgtatcatccaaggtcgacttcagactgctgtgctgacagcgagaatttcaagcgagtggatcttagcttgctgggctccataggggtgccaccagttgagcaagaccacttggctccctggcttcagtcccctttccaggggagtgaacagttctgtcttgctggggttccaggtaccactggggtatggaaaaaaaatctcctgcagctagctcagtgtctgcccaaacagccacccagttttgtgcttgaaacccagggccctagctgtacaggcacccgagggaatctcctggtctgtgggatgtagaaactatgggaaaagtgtagtatctgggccacagagcacagtccctcatgacttcccttggtnggggaggaagttctccagccccttgtgcttcctgggtgaggcaatgcctcctgctccccctccatgggctgtacccactgtctaaccaatcccaatgagaggaacnaggtacctctgttggaaatgcagaaatcacctgccttctgcattggtctcactgggagctgcagaccggagctgttcttcttcagccatcttgcccgctcatctctaaaattactttcttgattacttttttttccgtaaatattagctgcttttccatttatttagatcttttatttctttcaaaaaaaattttaactttacagtggataaatcttaaaattcttttgttttgctgttgttgtttacttttattttagatacaggggtacatttgcatgtttgttatataggcaaatttgagaatatgtagtatttggtattcctggtcctgtgttagtttgcttacaataatggcctccaactccctccatgttgctacaaaggacataatattgttcttttacatggctgtgtagcataccatgctgtacatgcatcacattttctttatctagtctaccnttggtggacatctaggttgattccatatatctgcaattgtgaatagtgctgcaacaaacatatgcatgcatgtgtctttatggcagaatgatttctattcctttggatatgtatgaatccattattacattgctataaagaant

SEQ ID NO: 180385 - DNA, 594 bp, Homo sapiens
agaaaactgtagcatcaactatattatgtttctgggcatgttcagcataggtaatgtgtgcactttatgtgtacacataatcatatttaagttttttgacagcataaactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttc

SEQ ID NO: 180386 - DNA, 181 bp, Homo sapiens
tcttcacgtatcttacaggacacccgcctctcctgactgtcacactacctctctggctactccctcatagtctccattgttagaccctcctcctcatctcaacttcagcttctagctgctggagtgccccacgtcagtttctttcagagtccacactcactccccctaggtagtctcaccc

SEQ ID NO: 180387 - DNA, 594 bp, Homo sapiens
gagcttaggattttggtaccagcttgggcaatatggcaaaaccccatctctacaaaaaaaatacaaaaacttagctaggtgtactggcatgcctatagtcccaactacttgggagactgagttgggacgatcacttgagcccaggaagttgcggctgcagtgatccatgatcgtgccgctgcactccagcctatctggatgatggagcaagaccctgtttaaaaacaaacaaacaaacaaaaagtagcaattcaaaacctgtgctataataagagaatatttcataatcatcagattaggtttatctcagaaatgcaaacatgatacatcagaaaatacattaaagtagtttaatatattgagattaaatgtgaaatataaacatcttagtagatgtcagagtatttgctaaaagttaatttgtagttacatttttttaaaaagtcttttcaaaataaagataagaaaatatggaaaggaagcctctaatgagcataatacttaatagtgaaagaatagaaacattcccattaacgtcaaatataggagtaatgttagtatccttgttacttttagcatatatctggcaatgtg

SEQ ID NO: 180388 - DNA, 590 bp, Homo sapiens
tgcagtcttcaggtttctgccccagcccagccacactggaaccacaatgccttcctcattacctgtttcaaaccttatctgactgagttctcccaaattcatttaactgtaatccatagtcttccggaggatttctcttgctctttttctccctgataccagcccctcctgtttttccttttacatttgtgaactttttctaactattcttagctggtggttgtttttctacccactttgtacagattgttgtttctggggtttttctttttgggcaaatttgccagattactccattcctatggtttcacttaccacctacgtattgcagacattcacatctttatatgctgcctgtacccccttcctgggcatctgacctctgacagcttcatctaggtgttccataggcactttaacctcatcatgtccaaaatgaattctctttttcctcaagccaactctttttcctgtatttcctaggccagaaattcaaggacttttctctgagtaactgagcagtaattaagtataattttttcctcaataatccaaagcagattgtgagaaaacattgcttttgaataata

SEQ ID NO: 180389 - DNA, 344 bp, Homo sapiens
tacataggcttggcccactatcctgaaagtttatttctattcagtcataatttagatacttagggaaattccaagaggaaaaaaaaaaaaaacatgctctctcaacatatagcagaagatggcaatgagaacagcagcttaggatggatgggaaagcagaaacccaggcccagaactgcggcttctcagaattctgagaagctgagattaagcctggagactttgttccttcctctgtttctttcattctttaaaaatgtgttactaatttatattttcagaccagaaggcaaccttattttctttaccagtcttgaatccagactggcacagcactgttatat

SEQ ID NO: 180390 - DNA, 351 bp, Homo sapiens
aaacaccaaaaatccagcaaaactgtccttcaaaaggaaggagaaattaagactgtcccagataaatgagggagttcactactaggagatctactctacacaaaatgctaaagtgaatctttttaagttgaaataaaaggatggtagagagcaacacaaagccttatgaaaatatcaagttctccagtaaaagtaaatatgtagacaaatgaagtgacctgtactattgcagatgtggttcatagaatttaaatgtgaaaaatataaaaagtaactttaaatctgtgttcattgctatacaatacataaatacgtaatttggagcaacaattatgtaaagtgaggaataga

SEQ ID NO: 180391 - DNA, 267 bp, Homo sapiens
agaaggggagtgggggtgggcccgagtcttagagctacatatttggattggaaatgttttaaagcttgagagccctcttagaggtgacccaaaccaaatttctgatctataacagtctctgcatcctgaaagctgtgcgttcccctggggtatggtaatttaagtgaagtctttattgggctgaaattacagtatcaactcatgtactttcatcatcatcactttgtttcatcatgagatggtaatactgtctccctacaactgcag

SEQ ID NO: 180392 - DNA, 1158 bp, Homo sapiens
atgtcctgcgagcttaggggtgctacaagttgaccactgcagcagtaaagatgactctgaagaatggcatgggatggatcctttcgaatgcacttgagcagcagtctccaaccacagggccacagagctggagctggatctaccatgaaagacttctgaatccaggaagagagactgactgggcaacatgttattcagggtctccctctgttgtccaaggctggagtgtagtagtgctatcacagctgactgcagcctcaaccttccaggctgaagtgattctcccatctcaacctcccacgtggctgagactacaggtgcttgccaccatgcccaactaatatttggaattttcatataagtggattccagaggggtgacagcaaaacgtgggaccatccagttgcaggaaaacaagcttaacacgcccactgattttacattatgctcctaccacccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcattacaatggcctctttagacccagctcctgcctcccagccttctctctaggccctgaactttctgaagtcgacctcaccaggcccagctcatgcttctttgcagcctctccaggcccagctcctgcatcttggtggcccctccaggcccagcctctgcctcccgtcggcctctacagtcccaacatctgcctcatagcagattcttgaggcccagcatctgcctcactgtggaccccccaagccaagctcccaacctttagcagcttctacacacccagctcctgccacccagtggcctctttaggccaagctcatgcttcacaagggcctttccaggcccaactttcgtctcatggcaaccttccctggccagattcctgcgtgtctcccagcagcctagacaggcccaggtcttgcctcacactggcctctctacatccagctcatgcctcacagtgacctctccaggcacagctcctgtcccagaacgtcatctccgggcccaaaacttactcaagtcagcctctctagtcccaactgctg

SEQ ID NO: 180393 - DNA, 1165 bp, Homo sapiens
aaaaaaaaaaaaaaaaaaaaaagcttttatgtctgtcttcctatctccctattgtttttcactctcttcgtgttaaatctcctcacagtcttccacatcattgtcatatcctggaagtaaaggaacatttaaatctgtagaaggagattatttttaagaatgatggtttggcagtgtatgttcagttactgatttgccacattctgtttctaaaaaagaagttggatatttaggtaaaaatatgcctatttattaactggcgatttaaaatttaagttaataatgtcaaagaatggacttctgagtcttatctgtgtttgtaaaatatatatcttctcctcacacaagtaaattatgtcagtgtcatcccacttaccagaccagcgaagtgtctccactatatttttactttctgcttctgcacttgtaagctttataccactaatttaatctgatttaaaatgttttatactatttagttttaaatgatatggtaaagattttttaaaagagccataggggtagctcttacatcctcccacccattttccttgtctcctttctccagccaaaaaccccacttgacaacaaaacaaagttattagatgtgtccaatataggtgtttttggtgccaggccttcccatctgcaagattctggagggagccgagtggttttattgagccgagtgtttttattgtccacaagctctgcttttatctcttctcagaaaacaaaagcacatcacctagaactttatggcccaggtagcagggtatttttttaatgatagcttttgttaataaaaatcccaacatttccatgcagtttcctttatagaacacacaatattttgaattgattattgttttagctagtggtgtttacttagcatttccaaccccagattttctgtccttgctacttgataatggacaccgctactgggatattcaaggaagtagatgatcagatggatttttttgatcttgtaggaaaaatggaaacaaacttgaaattaaaaagatacatttctaactcagtgccatagaattccttttttttaaatttttattatcagccaggtgcggtggctcaagcctataatcccagcactttgggaggctgaggcgggtggatcacttgaggtcaggagtttgagacc

SEQ ID NO: 180394 - DNA, 186 bp, Homo sapiens
  misc_feature (181)..(181): n is a, c, g, or t
cacaactttactgatgaagtaaaccggtaaatttgaggcttaacttttaagatcagtaataaatgctatatgttattagaaaaattatttagaggtagttatagaacatttgaagtacatataagttttgaattctaattttttttttttttttggtttttggtaattggtggaaacagcntatca

SEQ ID NO: 180395 - DNA, 291 bp, Homo sapiens
atttctctcttaccataaaatccttccatgactgccttctaaaaagttctggccaggcatggtggttcatacctataatcccaacactttgaaaagctaagctggaagaacacttgcaaccagatgttcgagaccagcacgggcaacatagccaagatcttacaaaaaactgaaaaattagccaggtgttgtgatgcacacctgtagtcctagccactgcagaggctgaggcaagaggatcacttgagtgtgggaatttggggttacagtgagctatgatgatggcactgt

SEQ ID NO: 180396 - DNA, 624 bp, Homo sapiens
agaaaaagagagaacaaataaaaaataaaatatcagacttaagccttaacatagcagtaattattttactttatttcatttatttttttatttactgagatggagtttcactcttgtcacccaggctggagtgcagtggtacaatctcagatcactgcaaccttcacttcccaggttcaagcgattctcctgcctcagcctcccaagtagctgggattacaggcgcccaccacaacgcccggctaatttatgtatttttagtagagatggggtttcaccctgttggccaggctgatctccaactcctgacttcaggtgataagcccacctcggcctcccaaagtgctgaatggattacaggcgtgagccactgtacctggccatcaggaattattttagaagcaaatggtctgagtactacaattaaaagacaaagattggaagagtatattatttttaaaaaatgactcaagtaggccaggtacagcggctcctgcttgtaatccctttaggaggctgaggcagaaggatcacttgagcctaggagttcgagaccagcctgagcaacacagggagaccccatctctacaaataatttaaaaattagccaggcatggtggcaca

SEQ ID NO: 180397 - DNA, 393 bp, Homo sapiens
tgactcctggacttaagtgatctgccgtcttggcttcccacagtactgggattacaagcgtgagccaccacagccctgccctttttattgtttttaacaccttccctccttcaacgtgttatagacatctcagcaaggatttatttttcttcctcgttttaggagagtagacagggtttcatgattatagggttaaggaaatgttttgtactcatgaaaaggaaatgttttgtactcacaggaaaagcaggtagatccctaaagataatgggagttgggacaaatggtaaacctgggaaggaagacctttgctagagtctgtttgcctccaaggcactactcttatgctctagaaggaatgggctcctggagaggtaagtgctttagggtcca

SEQ ID NO: 180398 - DNA, 807 bp, Homo sapiens
ccggctaggtacgaggcgggggtgaatcggcagaggtgacacagcagaggggttcaaaatatctggcaattcccaactgcaatattgaggacttttaaagccatatgtaaaagcttcctccacccctctctttataggcctagttaacccagcaactccccgattgggggaaataaaatttaaactctagagataaatggactaatttgctgtgatgcagatcattccgtgggctagtctgtctcctggggctggcaacaattgctaaaatccataagcatgactggtggtaagagtcagtgaggaaagccacaaagctccatgctgtcatggatgctgtttatgggatgcaacggtgaggatgggatggttaatatcgtctgttccctcggaaaacgaagtgttgtaagcgttgctgcgtgaagtctgcccttcccaggctaaaaactgagctttctgaaaggcaaatgaatggtccccctaaccatgcagagagagattccactgaagccaagagagagccatgacatggacccgagagccaaatgtaacagcaggacctaacactggagctcagaaggaagcagaagacacacagaggagcaaggagaaagcaccaaaaggggcagcagaatcaaaggagggagccctgcagggcacagcaagacgcctggggctgcggggtccgcaaggtgcacaggagagaggctcagagagctgggaagcagacaggaaggagagaagcagaaacaggaggacatgaaggaaaacctctgtcaagaaaggctgctggggacaaagatttgg

SEQ ID NO: 180399 - DNA, 1046 bp, Homo sapiens
gggtcacatggatacaggagatgtttttcaacagatgctttggtgaatgcgggcatggtttacacggtctcacaaagcaacctttcaggccgtccaactgcaatgtcattctgacccctgcttgcattctgaatgaattttgccatgaaaattgtgaaactattccttagttgagaaaggtcaggatacacttctcaataaacaacagcagtgttcactgggaatctgcctgaaactgaattaagtaactaaggcctaggcagtggctggattgctgacacagcagaggggttcaaaatatctggcaattcccaactgcaatattgaggacttttaaagccatatgtaaaagcttcctccacccctctctttataggcctagttaacccagcaactccccgattgggggaaataaaatttaaactctagagataaatggactaatttgctgtgatgcagatcattccgtgggctagtctgtctcctggggctggcaacaattgctaaaatccataagcatgactggtggtaagagtcagtgaggaaagccacaaagctccatgctgtcatggatgctgtttatgggatgcaacggtgaggatgggatggttaatatcgtctgttccctcggaaaacgaagtgttgtaagcgttgctgcgtgaagtctgcccttcccaggctaaaaactgagctttctgaaaggcaaatgaatggtccccctaaccatgcagagagagattccactgaagccaagagagagccatgacatggacccgagagccaaatgtaacagcaggacctaacactggagctcagaaggaagcagaagacacacagaggagcaaggagaaagcaccaaaaggggcagcagaatcaaaggagggagccctgcagggcacagcaagacgcctggggctgcggggtccgcaaggtgcacaggagagaggctcagagagctgggaagcagacaggaaggagagaagcagaaacaggaggacatgaaggaaaacctctgtcaagaaaggctgctggggacaaagatttgg

SEQ ID NO: 180400 - DNA, 427 bp, Homo sapiens
ccaaagtagccccacattgacatcctaccctcaactaacagctggcagaaggagcaggaaccacttggcctgacccacccacagctctctgctttcctatcccataccccagccacccctggcctcacctcaagggataaaactcagtggtgacagccaccaggaagagtcaagtgttaccagttcctaaggcctctgcaggtgacttctgaggcccttgttatctgtcacgtcatgggaagggctctcaaggatggatatgacagcacatgggtttgggaaactcttcccagtttcatgaaagcacccccccactctgacccctgttctcccaagcaggtccttggtgcccccattctctctgtgggcagacatggcagccttcccactcatctcctgcctgccatcctgaaacaccttcctcttt

SEQ ID NO: 180401 - DNA, 476 bp, Homo sapiens
cggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaataattggggtgagtataaagaggaattaggaacctgaatgtactccttatttaaagatatgcagtatcctttttgcaaatgatatccttttaaaagtaaaatttctaaactttatcttaatacctgtcacatattatagtc

SEQ ID NO: 180402 - DNA, 504 bp, Homo sapiens
ggactgcatcctggtggcaaggacggagaggtaatgtgccattaaagcacaggcaggaaagctgcaaaggccacaaaaacttcatttaatctgctctgaacagtagcagcacaaggctcatcttaatgctaatcacgtcttggattgaaatatgtcattctcagacacaaataaacctacaggacagaacactatagcacaaacatcaaaacccaatgctgcatgctgtttaagtacacatgaccaccgaaggggattatctgatgagcgaatcaagaaagcatcttttcagctcaaccttactcctcttcaagagcaataccaagcgttcccagttatttgggctactccttagcaagtatgggaggcaaccggctcagtctccttatagagaaactttcaaggtacattcatctttcccatttgttaatatggtcaggagccagggcttctctaagatccatggcccacttctcttccccaatcgcaggtgtcagaagcacc

SEQ ID NO: 180403 - DNA, 535 bp, Homo sapiens
taattcccaggccttggcttctaaatacaattctcctctaaaaggaaccagggctcctaggagaaatagctgattctagcactaagacagggaacgtgctagatgaacttggaacattttttgtgccaggaagcaaagaagtgctcaaagaatgatggggatacattgaagggacacgggagcaagcctgaaagggcttccactggccaaatctggggcagtctgagcatccaaatcagtaaggatattaacagatttggatccatcaaataaaacaagaagccatgagttcatacgcatctaaataagggaataaattgaaaagtttaatgagaaatggtatatttacacagtttcaaagtacctcccccacaaaatactgaatacaagggagaagagagtaactttcaatgcagaagtttggcaaaaacctagtcaagtcaaagtgatcaccatcagtaatggaagaaactgctggaccgcaaagagcagggcacaccatcactgctgcgatattcctgtcggagatgctaca

SEQ ID NO: 180404 - DNA, 126 bp, Homo sapiens
actataaaatctctgccccatcctccttaggtgctgagccattttaggcctcagcctgtctgcccccacgcggtgcgccttaaaactgtgttgctctacaccgccttgtgttgtttgttggcgact

SEQ ID NO: 180405 - DNA, 443 bp, Homo sapiens
cccttcctcctcctcctcctcctccttctctctcgctctctctctcttcctctgagtctctattctcatcgccattactttctttggaaaggagaacccatgcctctgctctggtaaaatgctggctgcatagtaacggtatattatgtaaacttgtcttgtttacccaccctagtattagtctgtttcttctagaggagttcttatagtatggtaattcaaataaagccatctaacggccacccataaaatacaaagaatcctttttgaaaatgaaaattgcttcagaataaatattggttattccagtaattcaaaaggatagaattaagctattttagaaaacattttaaaataattacaaaaattgtgcttaccacaactgaggcagaaaataagaattctgatttttttaaaatctgtcttctggagatctttatgta

SEQ ID NO: 180406 - DNA, 389 bp, Homo sapiens
tgctctttgcacccattatgatgtctggatcaaagacgatttagcacagaagttgttacacatgattttagagagtttcatttctacttcaagaaatttaagtaagcaaaattgccaatctttttgaaattcatcctcacaaatgtgaacaattttcagataacactttttctaaaaagatacacagcctaaatgtaaataactaaaaaacatcaaatacggtcatcaaagattattttcgttaataatatgaatgatagaataccaaaaaattctacaagggaggctgcctatcacaaaaatgatctctggatttccatggaatctaatctttgctgttctgactcatgttattattgatatttttacaatcactttccagttccaag

SEQ ID NO: 180407 - DNA, 238 bp, Homo sapiens
gaggaaagatgcatgcattcagtgcattaatgtcgatggctgtgctgacactgttgtctttcttttccagttaaccgcagtggattcgctgacagagagagacacaacttgcagtatcatgtgggtacaggaattctatatgcactcaatagttaaaggaattcaagacaccttgatgctttcctggtttagtagtaatcagtgtggctagagattacttgcagattttggccattgg

SEQ ID NO: 180408 - DNA, 202 bp, Homo sapiens
actcctgagctcaagcaatcatcctgccctggcctcccaaactgctgggattacaagtgtaagctgctgtaagctgctgtgcccagcctatattttcaagtctctctccttttttttttttttaaactggaaaggatagctgtgatggaaatggaagacttccaacagaataccttagttagcataactgtgtagtacaaga

SEQ ID NO: 180409 - DNA, 279 bp, Homo sapiens
tcttcccctcaaaaaaagggctggctaagccctaggatttagtgggaaaagtgaaataaccaagtgagaataagatggagttttgtgggattggggccaaacccaaaggggagatgcttgaggatcctcctggtggaagtggggctccagtgaaggacttgtcagatttggaacaagcaggaaggacctggggatttgcatggtgtggtggaagccatggaaagttcttgagcagggaacaggaaacatcattcattacttttgggagaagaccggctg

SEQ ID NO: 180410 - DNA, 594 bp, Homo sapiens
acgtatagctaatatcatgcataatggtgaaggacagaattatttcctcctgattgagaacaagacaaagcatcatactacctgattgcaaaacctatcatgaagctatagtaatcaaaacagactcagagtccacggggacagaaaattaagttcagaaacaaatttaaacatttatggtcaattaatttttgatgaacatgccaggaacaaagaaaaaggaagggagagactttttcattaacagtgctgggaaaactggatattcacatgcagaatgaaattacactcttatctcacaatgtataaataatcaatctcaaattgatttagaacataaacctatgacctgaaactgtaaaactaatagaaggaaacataaaagaaaagtcatctgataaatgctttttttggacatgacttcaaaagtacaaggaacaaagcaaaaataaacaaatgcgattacattatactaaaaagctcctgaaagacgaagaaaacaatcaacggaatgaagaaaaaaacctacaaactgagagcatatatttgcaaaccatacatctgataaagggttactatcaaaaatacaaagaa

SEQ ID NO: 180411 - DNA, 439 bp, Homo sapiens
ctggaatttatttttagagtggtggcccaggtcacacagtctgcctggccagggtactgtttactgttttagtgtttactgaggcttctcaggacttgcagcctgtgggagacttaggcccctcgaggccccaccaaccccaggcccagatctgtggggagcccagcaccgtggcctactgccctgaacccttcaagggcaggggccaaggctcaccgtatcccctagaggagtgcctctctcaggctggcacccagctgtggctcaggacggtatgcccagttgatctcctggccagacaaaccaaagggacaagaaagaaaaaaacagagtgagaaagagaggaaggaaagacggaaggatggacggcagaggggctggcttagaagaataaacaaactgaagaaatgaataaaggaacaaatacttgcatggatga

SEQ ID NO: 180412 - DNA, 178 bp, Homo sapiens
gagtcagatggtggctcagagattcagataccattgactaattccatggaagcccttggcactgccagagtgcagtgagtctggacaggctgggggttggcacatgttagggtaaactatacccatgaaatcatgagattagagacttcaaacatctcctcattctgtgtcatcagag

SEQ ID NO: 180413 - DNA, 391 bp, Homo sapiens
tctacaccaatttataaggtatgataagtatgaaagcatagcacaaaatgatttgataaacatgaagggcccaagacaaactgctgaaaaactgttagtttgaaactgtgcaggaactgggtatgccttaggaacaggaaaaaaaaaattaacagaatttcatgagacatataagaaaaccacatttatatcaatttaaaagtaatatatcaaagaccagagtgaaatctaaaaacagaataatgctggctaagttaaggaaagagttctttcctgactgaattcatagagaatagcttcaataacatttatggaaagctatttaagaaatcattaacagtcattgaaagagtgacaagcatggacattgagagaaaagaatcttactgta

SEQ ID NO: 180414 - DNA, 296 bp, Homo sapiens
ggtctctcactactgctgtatatattttttaactccttaatataatccagattaaataagggatttattagaaggaaactgggatagttaacaatgaatggaataggtgtaggaaccagagcaagctacaacctcaggaaccaaaattgcacatctgtatggaaagtcagctctttgttattgctgctgttgaatatggtctctttagcttttgactttaccatgtaagtccatgacacgtgcctgtcaacagctatgggtcacattcttatagctcttgattatagaaggaagaa

SEQ ID NO: 180415 - DNA, 339 bp, Homo sapiens
actccctacaactcccaagggtctacagactaaaaagtgcttcctgttaccaaagtgaagtcaaatgcagcacagtcaaattagtttctccatgtgggtgtccagctctaattatataacagcttctaattataaaacgttaagaatggctattaacttttgaatctcattaaaattaacggttaatttgctaaaagtcgcttgtttggaaaaactgctaatgaccgttctgcagataggtacaggtacaaaatctgcaaggacacaggctcaaggaaaaattttgcatttaaaatctcacacacctttgagtttttagctagtgtacatagtagctag

SEQ ID NO: 180416 - DNA, 391 bp, Homo sapiens
tgaggtaggatgtaatgggaagttgagcgaattcatatttagtcattcattcaaaaatacttaattgagttactgctgtgtggcaagcatcattctacaaacagagggcacagtgataagcaagccagtttgtactctcgtgtaacttacattctactttgagaagacagattataaataggttaaaaagtcaataatatgatgtttcagcatcaacaataaaaaattagggtgatatatagagtgccagggaaagtgctttcatggacctcttcattctctcctctcctggtgtcataagctactccttcatccatgctgccatttctcttggtttacggttccagtatagtactcatcacattattactatagagccatccaccttatg

SEQ ID NO: 180417 - DNA, 525 bp, Homo sapiens
tccaggtggctgtagacacaagaatgcatctaggaaatgtgatgcccggtcagcatccgaattctgcacagtgtagatccatgtgtttattttaacatattgcaaatgatagcggtaatgatgatggtgataaagagaaactttggaaaatcttggtagaaatgttgagaaatgtttccaaggaagactaattaagttgctacattataaaactaagaaatgagaaacaggccagcggatgctttcaatagaatttgaatttttcacttgtcatttttttcctaagaggtttagatttagatttgtaggttagactttattcatgcctatgaaaagtgattagctcaaagccttcatttttttctcccaaccacatatatgacagaagtgtctgagctgtatttttccctctttcgttataatataatgtcaggcttgtgacatatgacagcaggtttcacactccacttaatgacaggctgccagttcctggagaactaaaaaggaagactaatatgtatttga

SEQ ID NO: 180418 - DNA, 520 bp, Homo sapiens
ttggttcttttccagacttcgttctaggccaccatggcttttcgcgggaagggggtttggctgggatctaaatgaggcaaccacggttgggctgggtgactcgagaatttggatttgtcagactggatgagtcagttgcttggccggggcccaggtaagcttgaggtatcgtgagggaagccctgcttctggagtccaaccaaaatgtgctgggagggtaccagacccaccttgcggccgtgtgactgtgggccccacgtccttctgtgtgacagggggtgagtctgtcccccattcaggcctcgcactcagatggaacaagatggcaaacagggagtgactccacagtaatcaaaagaaatgaactagatattcaggaatcaacggagagatctccaacacatgagcatcgtcggatagggtggaaaaaggcaagctgcaagggaactttaaaaacatacacaaagcaaagcgcggtagctcacacctggaatcccagcactttgggaggccaaggcag

SEQ ID NO: 180419 - DNA, 362 bp, Homo sapiens
gcaccgccacaatggtgcgcatgaatgtcctggcagatgctctcaagaccatcaacaatgccgaaaagagaggcaaacgccaggtgcttattaggccgtgctccaaagtcatcgtccggtttctcattgtgatgatgaagcatggttacactggcgaatttgaaatcattgatgaccacagagctgggaaattgttgtgaacctcacaggcaggctaaacaagtgtggagtgatcagctccagatttgacgtgcaactcaaagacctggaaaaatggcagaataatctgcttccatcctgccagttggtttcattgtactgacaacctcagctggcatcatggaccatgaagaagcaagacg

SEQ ID NO: 180420 - DNA, 260 bp, Homo sapiens
catgttatgaaagaaataagggttcaagagagcatatgggcaggaaagaccacctttagataaatgggaagtctcttctgagagggtggcatttcaacaagacctaaaggatgagaaagaagctgaccgtaggaagagaatcaggggaagagtattccaggcaacagaaacaggatgcgaaaaactacggagctggacaaaagctgggtaggtatgttttagaagctgaaggaagaattcactgtaatgaagtgtaactt

SEQ ID NO: 180421 - DNA, 188 bp, Homo sapiens
caatccccggagcagcattgcacatgctcagtctctcaaagtctggcttttaaataattttctgcatctttccttgtaattgggtggagaatgttccactgggcagctgagttgaatcgccacaatctctccacttggcctctgtgcgacttactgtaaacatctattgtctcccaggcagtatgcag

SEQ ID NO: 180422 - DNA, 325 bp, Homo sapiens
tagaaactctagagtactagagatgacacattacctctaccttaatttcttcatttgtaaaacaaggataatatttcatctaacttatagggttaagtagattaaattagataatacacgtcaagcacaaaatccccgtctcagagtacaggctctacgaatgccaactgtcattttgttggggagaaggaggagatagctggtgcatgcatgtgcacacacatgcacctgtgatttcttacagagagagaccatgacttaccctcccctcccccagagtgggaacagttttcaacaagtgactggaatgggtggtacctccctg

SEQ ID NO: 180423 - DNA, 674 bp, Homo sapiens
ggattgctcgaagaatcttaaaattcaatgttctaatactaaatccaatgcataatcccattttcaaacctgcttttccttatatgctacagatttcagatcatggtagcactgattttccactgaccttaaatcaaaatttttggagcccttttagctgttacctcttcctctgatttgtgtgtttgtttgttttttggtcaatcgattctaattcttcactactgaaactgttcacttctttttatctgcactccaacccttaaatcattacttatctattattatgcaatggcctgctcagcatgacctgcctcatccagcactctttctagccatcttgccaccagatgtattgctctgatacatgattttgatcatgtatctctcctaattaaaaaatccttaagtttagccagacaaactttacggtataagtaccacattgtatttgtgtataactccttgctctgtgttagcttttatcctgttcctaaaatgtgcttcatgcttgtgggcaaagtctcattgatcctttcagactaagcctcatttcatccttttcggtagtctttctgactcatctccattcccgagccctaccctaggaaatcagccattctatactccttgctctctaacaatttatccacaaatggatctctatatcatag

SEQ ID NO: 180424 - DNA, 441 bp, Homo sapiens
cgcttttgtataaaggagggaagacattccaggacattataggctggttctattgaccacttgtattttaccttgtaagggagaggcattgagtttcgaccttggagaatagatggatggtgatatcactaattacattaggaaataaggaggggaagttagttgttgagctgctaatggaacttcccagtggaagttagttgttggcagttactaataggcagatgggtaagtaggtcttgacttggagatagctctgaatttgagacagttacctggtggacagcatgagtgtgggtgtaacagagtagcaggtggagcttagagtacctgaggagatgtatcaaccaagaagcaaggagttaaggatggagccccaacgttcagaagacagacgggaaaaagtagagaaaacttaggaagatgattacaaagaagctg

SEQ ID NO: 180425 - DNA, 269 bp, Homo sapiens
ctgaatcagctgatcaccaccacagaatgttgtgaagctaccatttgatgaatgtttatcatgtttactacaagtgttattaacagctcaagtatacatttaagctaccttttggcacacttttacattcactttgggtttttttgtggattcatggctctttaacatatccaatgtgatttgattgccagtatcatgttttacatttcagccattcctccaaagtaggaaccctcttcatggctggaacttggctctttgcccttctt

SEQ ID NO: 180426 - DNA, 277 bp, Homo sapiens
aattatttgcaggaagagtgaaatagactatttctgtgatcctttccaagctttgtttcagtacttgtggcatagggcaaggacagaaaaggaagacaggagggaggaaaagacgtttgaaaatcccagacctcaaggagagacaggtggatcacgaggtcaggagttcaagaccagcctggccaacatggtgaaaccccatccctactaaaaatacaaaaattagccagttgtggtggcgcacgcctgtaatcccagctaatcgggaggctgaggc

SEQ ID NO: 180427 - DNA, 478 bp, Homo sapiens
tgagtgtgttgttaactttgcaaatattagttaatataccaacttttattgttacttatttctaattttattctccttgtggttggagaacatactttgtatgttatcaatcctttaaatttattgagacttgtgttatggcttaacatatggtctagcatcaagaatgttctaaaaaaagaatattgtatatgcacttaagaaaaatgtgtattctgttgttaatgggtggaatattctacaaatatctgttatgtctagttggtttatactgttgtttaattttcttgttgctctcctgtctagttgtctattcatcattgaaagtgggtattgaagactccaactattgtttctaaattctctattattttcttcaattctgcccgctgttacttcatatattttgggggctctcctgttagctgtatacctattcattattgttatgtctggtctatctttttttttttttttt

SEQ ID NO: 180428 - DNA, 742 bp, Homo sapiens
agaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcttcagaatcagaggtatcaatggcgtgagcccaaaggttcgaaagatgttgcagcttctttgccttcgtcgagtcttcaatggaaccttcgtgaagctcaacaaggcttcgattaacatgctgaggattgtagagccatatactgcatgggggtgccccaatctgaagtcagtaaatgaactaatctacaagcgtggttatggcaaaatcaataagaagcaaattgctttgacagataacgctttgattgctcgatctcttggtaaatacggcatcatctgcatggaggatctgattcatgagatctatactgttggaaaacacttcaaagaggcaaataacttcctgtggcccttcaaattgtcttctccacgagttggaatgaagaaaaagaccacccatcttgtagaaggtggagatgctggcaacagggaggacaagatcaacaggcttattagaaaaatgaaccaaggtgtctaccatgatta

SEQ ID NO: 180429 - DNA, 346 bp, Homo sapiens
cagttgctgagatttgtgagctggctgttgagatttacatgtaggcctctgagagtcccaccccttttgtttgttcttagctgccggagacattctaactatgttgattccctcagactctaggtgagataagacagaattgggtcttcagctctatggggcattgacccagagactctactctgccaattagcaagtagtgcttaaaccagcaaggtggctttgaagtttgcttagataacagagctattatgactttatttacaacatgaatcctgaagtctctaaatatgtaatgtcataactcatcacatatcatctgcttgctttggtgacagaataagaa

SEQ ID NO: 180430 - DNA, 497 bp, Homo sapiens
tgcagagagctcaagaggctgcatgtggcccagtctttctcttgtctgccatggcaagacctgtttgtcaaatgcagagagtgtatgaggtggaatgcacaaatcaacactgtaggaaatcacaaaaggatgcaaccacgacgtggaatactcaatatgagaatgaataaggaaaggaagttctgcattaagaggaaaaaaaacctacacaagtagagactagggggctttgcaaaaactgacaaatcgaatctaattaaactaaagaagttctgcacaacaaaagaaaccattatcagaattaacagacaacacactgaacgggatgaaacttctgcaatctatccatctaacaaaggtctaatatccagaatctataagaagaatcttaaatttgtaagagaaatataaacaaccccattaaaaagtgggcaacagacatgaacagaaacttctcaagagaagacatttatgcagccaacaaacatgaaaaaaag

SEQ ID NO: 180431 - DNA, 739 bp, Homo sapiens
agccagcgcccccaccggaatttgtggccacttcgcctttggctttgcctcctgccatgccccgcaggcccggagaatgtggccccagactgaaatgagaagaaggtggccccgccgagggttgtctcaactgttggagtgatcagacccaacaccaggccatgggggctactaagtctggcggagtcaaagctggttgcagtgtttgataagcaagatctacatcatggaggtgatgacatcagtgccagctccatgcatacccagagcccggagagatttactagtgctagtgagcttggcaccaacaatgtctcagcctttcagtctgatcaagcagcaagtgaaattgaggtcacatcttcagtacttcatgcaaatatacctttgggagcccaacccttctgaccatccaaaggcaagcacaatattcctgagaaaatctcaaacagatggtatctactgagcattttactcaacaatacagttcatgttcgacaatattccttgatgacagcatagccagccagcctcatcttacaatgacactaaaatcatgctgagagcaaatggaagcacataacttatgtaagagaacctcttgttttgtgatacacagcatctgtgagtaacttaggaatatagttacatgtatctgaagagcaaaaagaggttttggaggaatattttaagtatgatcctgaacacaaattgattttcagatttgttcgtactctgt

SEQ ID NO: 180432 - DNA, 1128 bp, Homo sapiens
agccagcgcccccaccggaatttgtggccacttcgcctttggctttgcctcctgccatgccccgcaggcccggagaatgtggccccagactgaaatgagaagaaggtggccccgccgagggttgtctcaactgttggagtgatcagacccaacaccaggccatgggggctactaagtctggcggagtcaaaggaacgagaaaagacaagttaaaagagaaagtgggaccatgcagccaatgctagtgtggaggctgcaaaggccctgagctctgggatcccacactatttattgatgatcaaacaaagaaacaggcagtgaagatgtgggggttgaaaggaagcggtgtatcaagtgaatgagctacagctgtgacggtttagcattttctttgaaacatacggctacttgagataaagggagtgctagaagcaaggagccagcaagtctagacacattccaaagaccacgaggggttttaatcctagaccctggacgtgttccaagccctgcctcagcttctctcccaacactcagcttttctcccaacactcaacattggccattgagagccccttcagctggttgcagtgtttgataagcaagatctacatcatggaggtgatgacatcagtgccagctccatgcatacccagagcccggagagatttactagtgctagtgagcttggcaccaacaatgtctcagcctttcagtctgatcaagcagcaagtgaaattgaggtcacatcttcagtacttcatgcaaatatacctttgggagcccaacccttctgaccatccaaaggcaagcacaatattcctgagaaaatctcaaacagatggtatctactgagcattttactcaacaatacagttcatgttcgacaatattccttgatgacagcatagccagccagcctcatcttacaatgacactaaaatcatgctgagagcaaatggaagcacataacttatgtaagagaacctcttgttttgtgatacacagcatctgtgagtaacttaggaatatagttacatgtatctgaagagcaaaaagaggttttggaggaatattttaagtatgatcctgaacacaaattgattttcagatttgttcgtactctgt

SEQ ID NO: 180433 - DNA, 273 bp, Homo sapiens
tgctagattttatttgaatgcttattctgtgtctattgagatgattgtatggtttttatttttaattccatttatgtgatgaatcgtacttattgacttgcaaatgttaaagcatccctgcagccctggatgaaacccagggtgaattatctttttgatatgctgttggattcagtttgctggtattttgctgagggtttttgcatccatgttcatcagggctattggtctgtagtttctttcttttttttttttttttgtccgttagatcct

SEQ ID NO: 180434 - DNA, 203 bp, Homo sapiens
gtgaagtttaggtgaaagaatttggatatctaattgctctagcaccatttttggaaagtgctatcctttctgcaccacccccccactccttttttttgtaacagactctcactctgttgctgaggctgaagggcagtggtacgatctcagctcaccacagcctcgacttcttgggctcaagtgatcctcccacctcagcttcc

SEQ ID NO: 180435 - DNA, 337 bp, Homo sapiens
cctgcagagcaacacaccgcatacacacacatgcatgcccatgacacacgcatgcatgcccagacatgtgcacacacgccatgcacacatgccccatacacatgcatcccacatgcacacatgcatgccatgtacacacaagcacacccacatacacacacaccatgtacacacatgcacacccacatacacacacagtgtacacaaacacaccacgtacacacatgcacacccacatacacacacacacatgcaccgatgtgggctagagccagaggcaagagggaaaaatagatcagaaaatgggaccaataggctgggtgcagtggctcatgcc
